United States Patent 7,868,149 (PLANT GENOME SEQUENCE AND USES THEREOF) - sequence listing, part 83

SEQ ID NO: 44023 - DNA, 12225 bp, Oryza sativa
gagggcttctaggcgctcgtccccagctggagctagcgtgttacctcccagagatggcacgttagtcctggtcagatatatgccaggcttcatcctaaccattacaggcaagatgttgtgtgaagaagggcgaacatgtagattgctaagctgacacgtgggggacaagaatgaccgacgtaactggtctgacaccggtcatgtcgtcagcagacagccacgattccacgtcgcacctgctcccggcgaaagtggaggtagttgtggcccgtctcatcagaaggtgactcggacggcaactatacaaatctccgtccatttatgaaaaggtagggtaagtccccacagaaaaagagagagatggtgcatgtggtatccccttaagatataaaaaggaggaccttgcccactgagaaggggaggggacttttccagattttaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacgggctatagagcggatgcgccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaactctcatttcacgcttccccaccctgtgccgacttggcccgggagagagcagggaggagaggctcccgagccgaacggtggcccaaggcccccgacgaccggagttggccctctgcccgcttgtcagacggtgctaggagcccccgaccccaggaaggccctgaggccactgtgggaaggccgcacctatcgcccttcgaccccgaggctaaccctgtgctgacccgacccgggaaagagcagggagaagaggcccccgagccgaacggaggcctaaggcccctgacgaccggagttggccctttgcccgcttttccgacgacgccaggagcccccgacccccaggacggccccgaagccactgtgggaaggccgtccctgttatcctccgacccagaggtcatcagcacagaagacaagtgcgccccgcgaggctgcttggacgaagagtgccccagggatgcggcccctagcaaagaggatcggccccaccgaaaggtgcagcggcccgtctactttgttaatgaggcctccgggacgccaaaacccgataccctcaggcccagaagatgctttacgctattctgatggcctcgaggaaactgcgccattatttccaggcgcatcgggtcactgtagttacgttttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccagctcccgagcccgtctcgatccccgaggccagcacggacccctcgcagctgcctcacaccgcccactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctggactggggatccgccgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcatgtgcctagacgggataacatgattgccgacgaactctcacggctcgcgtcctcgcgagcccagatcccaccgggcgcctttgaagaaaggcttgcccagccgtcggcgcgacccgaccccttaggggagacggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccgcagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcatctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcatcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgaggcgggggtcgggtgtcaggtttcgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgcgccccgaggcgtggtgaactccggggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggactgggggctcaatccgatgcgcccggatcgccggcctcgacgtcactgtcgtctgcaccaccggcattgccctcctcgtcggagttgggggcgaacgcaagccgaggggccgagccctcgaagctgttgacgatatggttggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccctggcggacgagtccagcgagccctgcagatcggcgatggtgcgttcggcagctgcgaggcgggcggctaagtcgctttcgcccgtggccgccctgccgctgcgcgccctcgcgtccagctccttcgcccgcgcctcgagctcagcggcccgttggttcagtacggccctctcggcgcgggcaccttccagattgcagcgcgcctgctcctcctgcgctgcctcgcggagggacaggttgaccgccagctgttgcgccgtggcctcggccccctcgagagctcgctcccgtttggtgagcgcgtcctcgcggaggcggagcgtgaactcttcttcggcgcaggcagcctcgtgcgccaccagcgttgcttcccggatggtgacggcggcctcgcggtccgccagatccctctccacgaccaggcgcgctcttccagcgccatggcgcgcgccctcaagggccctcttcgcgccgccgggacgccgctcggtctcgccgcccgctgttctcgggcagcggcagcgtcaagcaccccctgggcggcgtcgagcttcttccctagctcccctcccagctcccgtattgaaggcggagggtgtcctgcgcctcgttcatcacggtggtggcaataagggcagccccccgctcctcctccacttccttggcaatctccgccagcaccttcttacgggtttcaagctccgagacgtgccggcggtgagccttacggcccacctccaccatggcctccatcgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgacgccagctgccccggaagttgtcgcctgagtgtcgcctgagggagtgggcccaagcgacgcgcccgcggcctcgtcgcgagctgcctcggaagtcgccatcgcctcgtcctggcgaaatccgacctcctcccgagcggcttccccggcctggcgggcccgggcggcctcctcccgagcggcttccccggcctggcgggcccgggcggcctcctcccgagcggtttcctcggcctggtgggcccgggcggcctcctgggcggcctcctcggcttcccgtaggcgacccgcggcctctcgccggtcagattcccacctgagggcctctgcggccgccggatcctcggcctcagactggccggacttggaatggcgggagggacgcgacgggatctcgctgaaacaaaagaaaaaaccagaagacgaacaagatgggtgagtgaaaactcgcgttaagagaatacagtcacgatgggtgagagacgaacctgcgagggggtcggttaaacgaccactttggaggggaaatgaggtttccccgagatggttctgtctcccccatcttgcggggccgcttcttcttgcgctccccctcgggctgcgatgttggcgcggccccctccgggcgcctactgctggcacgcgccgccccgccccctcggggaggagatgggggaggtgttcctccctgcttcctctttccccgggcgtcggcagggcggctgctccccggacccctgtcacgggacccagaagcacgaccccctctcggggtagattgttcccccctgcggctcccgcttgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgccgctggagcggcgcaatccgacgacggaggtagtcgccgtacaccatggcccctgtgagcccctgggatcgcaggcccgccaggcggtcgaggacggcgtcatagccattccccagatctaccggcgcccgccagctggaggcctgcgctgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaggggagaaagaagacggaccgccccgggtagtctggcgccgggcgtccctcgcccagcgtgactatctcccggccggtggcagattccggcatgaagcggtgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggctcctcgcttctcgcgcccactatttcgccccctcgtttcccgcgcccacgcttccactaatcccattcgcccgcttgcggcgcatgaggtggatatgcggttgtggcagtcgagatagatcatatcgtgcgcgcgttaattacgcttgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccgcgagggacgtcgggcccgagggtgatgcgttcgccctcctcttagtccccccgagggggtcgggccgcacccccctcggccccgagggctgaggcgccccgacccctcgtgggttttttgctccgcgtatgggttaggtgagtacagtggggcttacctaaccacatttattgcggtttggttgagcgtgtcacgccgcatgtaacgcagtgcagtgcactcgtttatccggtctgtgaccagtcacagaccggtcagatcgcgggttaggtggcgacaggcgatctgacacacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgaacatgtagattgctaagctgacacgtgggggacaagaatgaccgacgtaactggtctgacaccggtcatgtcgtcagcagacagccacgattccacgtcgcacctgctcccggcgaaagtggaggtagttgtggcccgtctcatcagaaggtgactcggacggcaactatacaaatctccgtccatttatgaaaaggtagggtaagtccccacagaaaaagagagagatggtgcatgtggtatccccttaagatataaaaaaggaggaccttgcccactgagaaggggaggggacttttccagattagaaacccagaacaagggagaggctggctcatactttgtagctcctttatacacagatctcccaaaaacacaggagtagggtattacgcttctcagcggcccgaacctgtatacatcgcccgtgtcttgtgtgtttcctgtctcgcgagccttccacatacagagagcttagaatctctccctgagcccccggccgaaccggcaaaggggggcctgcgcggtctcccggtgaggagccccacgctccgtcagggtctgttcgactggcattttttacagctgcacgaaggctagctgcagctgcacaacacaagcgctgcagccgtagcactgtcgtaggaatggcagtcgaacatgcccatgggatatacgactccatcttgacctccttcaggcttaggattgatcgatgggggtctggtcccgctttaagggaccatttgattccgtggccatgccgtcactaattgcaccctctctccactgtcgcctatacccagatccacagaagatgggttagtcaccgacctcagtcctgctcgccgctcttcgcccattgtctatctccgccttgttagccgtcctccgctgtaggcctccacagaccttgagtggagatgggagggtcgaggcggaggacgggaggaggagaaggaggtggcgaacccgcagccaccggctactcaccttctcgatttaggtttaattatcatgcgggtacgttcaccttctccctttctttctcttgacactgacgagagacgagctaggagagagattgaacaagaatcgatgagagagcgagaaagagagagataagtcttgaccggctgctcgtgctgatctggcccagccggccaactcaacgtggcaaacgtgtgcaaactaactggagaaaacgttgcactattgtattgtgtgattatacaatgcacgggcaaaaaaaagtcatccatttttgaaaacactatactacctccataaaaaaaaatttctatgaaattaaggacaaattataaagataaacaaatgatcacattaaccttaattatttaatgaacacagtacacgcacacacattatatataaacttgattaaaaataaggttgagacaagaggttaagagatgaaatggaaagaaaggagattacaaggaaacaaattttgatgtaatcaatttgttttgttaggtcccacattagtagacataaaatttttatgggacaaagatttaaaggtagaaattcaatttttatgaaactaaggcagtagaagtttcataaaagaaaacgtgtgatgcaaaaatatttaatgacctcagtctaaattttcatcaattgactacagcgcaaagaaccgagtcgttcacgaattaaattttaaaatatactgttcattcatttttttctcaaaaatattcgggatgcaaaattttttacagaaatataccgtcggtctcgcacaactgttgcgcaaaaatgatgtgggaatgacgtcgtgggcggtatcgcgtaacggaatagcgagaccgaacggtctcgctaaagcaacgagcgacactgtctgacagctccttttgattagtgattaattactcaattaacaattaactaataataattagtgattaattatcctgattaatgattaaataattattaatcaataattaattaatcgctaatgaaatcggcatggcacggtatcgcgcattgcttcaacgagactgaaatctcgcgccgctgcgcgctttcagtgcgcgataccgtctgacgtcattcccacatcatcttcgtgtaatggttgtgcgagaccggcgatatatttttgtaaaattttttgcataccgaatatttttgagaaaaaaatgaatgaacagtatattttgaaatttaattcaggcgttcacccatctgtttctcccatgctaaatcatcaggcacacacatcaagatcatcgttcacatcccgaacgtgtagagccattgtttcaaacaaaaatataccttttgtggtaattacactccgtcgatgtttatgattttgctccggtgcttggataaatcattgaggtcaaacctcatccaccttaccattacccagtgcaatgcaggagtattttgcaaattttacaaaaaaaaatgaattaacccaactagcaggatgtctcgagcactccatgaatttatataacgatgcaaaaactatatatacgctatatcctatattataagtagttgaaagtttgtcctaaatgaaacttcttaaaagttgattaagttggtataaaatacactgtattttaaccataaaaccaatattttatgaaatatattcaatagtaaatttaattaaactaatttgatgtatgccgtagaagatgttatattttttctatatatttagtcaaacccaaggaagtttaacatagtacaaacccataacatcttatttttcaataatttacaataatcaactcgttgactttgtttgtcaccaatagtagatttccatagtagtagtagtttcactgccatctcatctagagttctgactttatcatagaagtactagtgctacgaccgttcttcttggcaaaatttaccacatgataccaaaaagtcatctaattggttgggatatatcaatggacatcacaaaatttgtgtaactggttgtagcgcacccgagacaatattgtatcatttccaatgaaaaagatatataggatagaaatttcaaaagaacataaatgcctccggcctcaacagcatgtaaaccggcctggcctattggatcttgttcaagttcaaccggactcaatcgcactaatcgttcaccctcacaaccgaaatccccatccaaacctaaccctaggcagccggtggcggtggctttggcggcggtgggcgagcggatctgggaatcaattgtggggctttaatggaacctcaatgctcgtaaaaaaaagccactttcttccctgctaacttcttcctcggcgacatcatccccaatgccgtcgacgcctaccaatttcacagctccaccccccgtcgattcccagagccggtcgctcgccacctccaaccacctagggttagatttggatgagaatttcaggtatggggttgaacggtgagtgcgtttggttgaacctgggttacatgctactgaggttgggggtatttttgtccttttgaaatttctctctcatctttttcaccggaaatggtaacatattatctcggatgtcgctattgctaattatataaaggcaaat

SEQ ID NO: 44024 - DNA, 5383 bp, Oryza sativa
attgcgtgaaatgtcaaaaatgcccttgggcccacatgtcagctctatctcctatctctcttctcctcttcctgcccacatgtcgctccccgccggtcgtcgaccgtgcacgcgcagacagcggcggaggcaacggcgagcagcagcagcaccccggccctctggcggcccaccagccgcagcgcgcggtggagcagctgcagccgctccttctccccgctgcctcgccaccctcaccctctgcccccacccttcctcccgccgccggccgacgcgagcaagtcgtagctcccgcaccgcatctccagcgccaacgccgagccactcatcgccaccgccgccgcctttctctcatcccaatcgccgaatcacgacactgctgccgacgacgatggtgacgagttcgaggaggaagaggacgtgcgtagctcgtcccccgcccgccaccacccgtgcccgccgcatccagctcatctccgtcggctgtcgcccgtcttcaccggcggcgcggagcggggcggtggctggcacagcacgcaggccggcgaggaggtggttcgcggatccggcggtgcagagcggggcagtggcggacgacgacgacgatggtgacgagttcgaggaggagcaggatgcgcgcagctcctcccccgctgccgcccgccgctcgtgcgcagctcctccccctgcgcgggcatggccgaaggccggcttggagagcgaaatgtgggcaagaagaggagaagagagatagaagatagagatgacatgtaggcccaagggcatttttgatatttcacgcgatttcactctcctcttcaaccgaaaattattattttaatcggcgtggtgtccactggcaaattaccacgtttatggagtgttttcccccaaaagtgagtttgggcagggctctagggctaaaaccacatataaggagtgtcctgtagcaaaatttcccttatataaatcttgtggtgcctatcagcaatgtcacgtatttgcgatgtctcttaaccaattacaatacttataatgttatgcaacaaattttatcaagaagaacacagtcgtagcactagtactactatgataaagtctgagctatagaaaccaatttcttttggtactaaaggagtacatgaaatggtctgccttctgcaacacctctcatcatctataaatacccgggacgtgcgtgctttcccctacaccaccactagccaaagcagcagtcaactgccgcatcgatcacatcacatcaaccagtaatcaattgaccaagcggttcttgcgcctagctaggtagctcgagcaatggcgaagtgggcggcggaagcgacggtgatggtggttctggcggtgacggtggcggtggcggtggtggcggcgcaggcgccaccgccggtgcagtgcgatcccgggaagctgtcggcgtgcgcggtcccgatcttctttgggactgcgccgtcgaagtcgtgctgctccaacctgcgcgcgcaggagaaggacgggtgcttctgccagtacgcgagagacccgatgtacgcgtcctacatcaatagcaccaacgcccgcaataccatcgccgcctgcggcatcgcctttcccagctgctaggctagcttcgatcgccatgatgcatggcgtatattaaatatatggtgtgtgcttgaataaaggatgtgagtttgaatcagtaagaactatcgatcgattaatgcacccccgtacgtacgtgtttgatcgatcgatcagctggtgtctcctgactatttaagtttgagctaatttccgatcttgtgtggtactatcagtagtagtactactacactactactagtactactactataaacaaacatatattttttatgtataaaaaaatatacacatatacaaattttgtatatgatgtgtgtcaggattacggataaggtataccttctacccttggatttatgctgtataccgatacggtatacctgtgcgtacacggatgtttcctttactcattaaggaaattcatcgtgtaacagaaacgaaatccacggacggaaggagtcctactcggactgaactgggtcgttactgtatcgtggtctgatatctccgagttatacttggagatcaactgacccgcgatataaaagggacccccggggggacctaaggcatcgaatctcatcgccaacacaaccaccacagcctgcgaagtcggatcctacaggagccaagttgccgggtgatctagtcgaacaactcgactacagtctcgtcggtatcatcgagttctactattccctttgtaatatgtggtttccattatataatcccataccaactggattagagctattacctattaaggggtctgaaccagtataatccctatttcttgtttgcttgatgtcgtattacatagatcttcgtaccagcgtaccccaataccctctatatcgatctacgagtatccatcgtcgacaatgtgtataaactttatatacgatgtgtacaaactttatatacgaagtgtgcaaactatgtatatgtacgtattaaaaaaccaaaaaaaacatcatatgtatacatatacgtatacaagtatacatactttatatacgtatgtataccaagtttgtacatacgtataaaaagtttgtatacgtatatgttaaaaaaccgagaaggaaaaaaagaaagaaaaaaccagaaaaaatgaattcaaaaatgaagaaaattttctgcgcatacaaaatgtgcaagctcgataacacatgattaattaaattttaattattatatatatttaaaaatgaattaattttattttttaaaaacaacatctatataatttttttaaaaaaacacactatttaacatttaaaaaacgtgctaacaaaaaataaggaagttaaccatttaacagttttaaaaccgcactagcggaaaacgagaagtttaagtctcaagttgaagaaaagaacgaagccttagtcattgtctcgtacctgcaatgcacgacacgtactctacaggatcgctgaacatgacagcgccaagaagaaaggatagaagaaaggaagaagggaagtggaactagagacgggcggatgcatttggatttttgtcagttcgtgcagggagggcatacgcaagtgttggagggattttcgtttacgtgggttgaacaaattgatgtcaacattgtagctatcgagagccaaagttttgtgcaccttctgtgaactgtggcttcgaactagagctagagctgtccttaacattcatctacctcgatgaggactctgttcttagagtttgatgtagtcttaaaatgaaagaatttcatagtattgatctgagctaattcatatttttgtaagatctatatgtgttataaaactagctccgaaatcgacattggtagctaaacgcggaagaaacaccataggagatccaaacacgataatgacaccgagacacgatatttagtaacggagttcagccgcagcctacatcttcggggcactgattacaggtgttcctcttcgatctagcatattacagtgtatcagagctacagcgactcacggccggttgccgccggcagctgctccctctcgctatgctaagttgccatgaagttacaacaagcacacccttctacttatgagagatcctaggatagagtccgactcttactctagtcctaatacctattacaactctaagtcctaaactttaaccgactttgtaaacatattcatcacaaactctaacaaactccacctaacactaacaaacttcaccttgacaaatatatcacgccaacccgaatctgttacttgctcaaacctccgttacatttccagccaacacagtcacctctcacctacaaccatagtccccacgtcttcgcctggtcgtggtcaagatctggacgctggagcttgcctaaccgccaatgcccctagaaagctgccaccgagagcctccaccgctgtcatctccatccgccgtagccaaaccgaccatccaccaccatcgtcatgtgcattcgactgacctgccatcatgaggggagggctagcccccaccgctgccagtgttgccaaccctcaccacgggtgacagtgaagggacgaaggactagtcaatgtctccacccaacggcaccgccgcccaccaagttcaaaggtgacagtggaagggacagcggactagcccccatccccgcccaacactgccgtctaccaagtctgccaccaccgccagtcctctcactgtcgatgagagaggaagggacggcgattagatggttgttactagttgagatgaacaagtatgtagagaaattaaataaaagatagttgtaatttgctgagataaagaaagtaggtgaaaattagctcaatcttggaataaattttgaatgctcaagatgggaaatacatcacctgttctttaggtggacataagaccaccagtaaagttatggtggtgaaaaaggttgacagttggataaattttcatggaaaaaaagagtatattttccttttcgagtagtacggaacactcttttgaagactgaggaagaatgcattttttttctccatgcaaattggatgcacgtccacacactcacacaacccagaactgctatttttggtgcatgcatttccagtaccatacgcactacagtttacacacgtttatatagacgtgaagagaagtgtgtcgctcatcgtggttttatcagacggttgttttatctatagtccatacgatccaagtgtttaaatttttggacgattttgtttatgagaaatttgagttgagaggtcgatagacaaacttgaaaacacaaatcatcttagaatacttaactcttaaagtagcatttcacgctcccacaagattagaaattcaaaactcaaacttaaatcccagaagatacctgatcgatcgatcaaacacgggtgcattaatcgatcgataatttatgtattcaaacacacatcctttatattattcaaatacacagtacaccatatatttatatatgtttccacacattgtcctttattttattcaagcacgcagtacaccatatatttatatatgttgccacacatcatggcccgcaccggtgaacggcggcgacggagcctagctgcagttgggaaaggggatgccgcaggcggcgatcatcttgcgtgcgttggtgctgttgatgtaggacgcgtacgtcgggtctttcgcgtactggcagaagcacccctgctgtgctttcaggctagagcagcacgacgccgacggcgccgtcccgaagaagatcggggccgcgcatggcgacagcagcccggggtcacactgcggc

SEQ ID NO: 44025 - DNA, 11868 bp, Oryza sativa
tcacaacacaagaacaggatagcacccaagaaaatcgtccaagcagatgtacaagactgcacgcaggcatccattggagttcatttggtcatcttatttgttttttcgtggacacaggaaatcaattcaacactttttacacattaatatttgtcaagcttaatttaaatgttgttcggtttgaacgtcatagtcactccacctgtttttaaaatatagttgttatagactatcaccgtgcaaaatgtatcaagcgtatatgtttatagctccattttctctctcggtaccagcgacgtcgtcatatccatgaacggtggttgcttgagcttgaggagcatcgccttctcgagaacgccctctcgatgtgtatcttcttcttaattaggccctgttagttgcttcaaaaacgaggaaaattttctgcgcatgcaaaattaagaagctcgataacacatgattaattaaatattaaattttacatatttaaaaagaattaatttgattttttttaaaaaaacttctatataatttcttttgaaaaaacacatcatttaatatttgaaaaaagtgctaacgaaaaacgagaaagttaaccatttaaccgtttgaagaacgtgctaacggaaaacgacgaggttaaagcttgaagttgaaaagaaaaaaaaaactaagccttagtcatcgtctcgtacctgcactgcacggcacctgctctaccggattgctgaacgtgacagcgccaaggagaaatgatagaagaaaggaagaaacgaaggggggtcggaacgagagacagacgggcagatcagatgcattcggatttttgtcagttcgcgcagggagagtatacgcaagtgatcgagagatttttgtttacgtgggttctataaatcgatgtcaaaattgtagcaatagtagccagagttttgtgcaccttatgtgaactgcagcttcgaactagagctagagctgcccttaattcatccacctcgatcaggactctgttcttatagtttgatgtagtctttaaatgaaggaatttcatggtattgagctaattcatgcaccctctgtatttttaatgtatgacggcattgaccattcgtcttattcaaaatttttgtacaaatataaaaatatttatgtcatgcttaaagaacatttgatgataaatcaagtcacaataaaataaatgtattacataatttttttaataagacgaatgatcaaatgttaataaaaagtcaacgacgtcatacattaaaatacggaaaggagtatttttgtaagatctatgcgtttcaaaggaggctttatactggtacgagtaggactcaacaatattttttcatctattttaactggatttcatgtctacatggtttagtggcgtagatctaattaacccttgacccttgttgttatcgcagggattgaaggtgctattttcatagtcaacagggccaacattacgagggctttagaattttttttaagaaaactgaggagagaatagaaactatataaaaaaattacaaattgcatatctctactgttataattttcggagccgttcacgtgagggacgtgcggcggcgagcagactgcccgagaagccggaaaggctagcgagcagtgaaacttcaccttttacttgttttttcagtttcagctgacacgcgctactctttttattttctctgtttccattttctgcttttacgtgattcttatctttaatatttcttcttcgtgtgattctccccatattttctatttttcgttatagtctttctttaatgaaaactttttatatgaattatttctaaaagacggtataaagactttatatatttaaagtttataggtagatactttatgtgtataaagtttataggtaaaagattttatgtatataaagtctatgtgtaaggaatttaaagtttgtatagataatttgaaagtttatttaggtataaatttcaataaaaatacaaaagttggtctataactagatattttcgttaaagaaaatagagtccaatcctaacaaactattttttttccaacgctggtggtgacttcgtaaatctctccaggaggatttgccggtccagtcttcgaagatgttcataggggtagggttggtgtgcatgtgtttatagggggtgagtgcgtgtgcgttgtgagtgtctgcactgtactgtgtaatttaaaaaaaaacttgataataagaaaatgataaaccatataccaggtcatctaactgaaacaacggaatactagtgcttgataggagcaaattatggttaagcacgtcattacaacagaaaaggagtattttacagttaagcgtatcattatcgtggtttgatcagatgattgatttatatatatagtgaggggtggatctagcgtgagtgctgggggattcgaacccgctagatcaccattgatagaaggaaagaatgaagggagaaaaggaggaagattagtggcagctcaaggaggaagaaatagatgagtcatcctatgttcttaattattctggatccgtccattatagttcatactattcaaatgttttaaatttgttgatgattttgtctatgagaaatttcagttgagagattggtattctgaaatagcatttcaatcaaattgttaatgtgtgactaacagtgcgcgcgccctcccccgcggcgaggcacatggcgcgcatggagagggccgtggtggcagcgcgtgcacagtgtgaggcccgcgtggttttttttttcttttttttctgtttggttttttatttctgttttttttttcctctaggaggcgatgctcctcaagctcaagcaaccggcgtccgtggaaatatgacgaagtcactagtaccgagagagaaaatggagctataaacatatacgcttgatacattttgcacggtgatagtctataacaactatattttaaaaacaggtggagtgactatgacgttcaaaccgaacaacatttaaattaagcttgacaaatattaatgtgtaaaaagtgttgaattgatttcctgtgtccacgaaaaaacaaataagatgaccaaatgaactccaatggatgcctgcgtgcagtcttgtacatctgcttggacgattttcttgggtgctatcctgttcttgtgttgtgattcaattaatttggcagacaccaatttgctgcacgtgtacatatcgacccactgttactagtcaaagagacccatatatgtaaaaatacgagtatccaaaatgcacgaaactgagaggatccatgtctctttcttcttcattcattcttcctccgttcagctaaagaagaacagttatagtactactaccactatggcaaagtctaaactctacacatcaatttattttggtatgaagagagtgcacgaaacggtctgctttctacaacacctcgatcttgtctataaatactcgggacgtgcatccttcccctacaccacatcgatcacattcgatcacattcggctagtaaccaagcggctgttcttgcgctagctagctcgagcaatggcgaagtgggcggctgcaatggagatgcttctgctggtggtggtggcgacggtggcggtggcggtggtggtggcgcaatcgccgccgccgccgcagtgtgaccccgggctgctgtcgccatgcgcggccccgatcttcttcgggacggcgccgtcggcgtcgtgctgctctagcctgaaagcacaacaggggtgcttctgccagtacgcgaaagacccaatgtacgcgtcctacatcaacagcaccaacgcacgcaagatgatcgccgcctgcggcatccccttgcccaactgcggctaggctccatcgccgccgttcgccggtgctggctatgatgtgtggcagcatatataaatatatggtgtcctatgtgctcgtataaaataaaggacgatgtgtggaagcatatatatatatatatatatatatatatatatatatatatatatatatatggtgtactgcatgattgaataaaataaagaatgtgtgtttgaatacataaattaccgatcgattaatgcacccgtgtttggttgatcgatgaggtgtcttctgggatttaagtttgagtttctaatttccgatcttgtgggagcgtgaaatgctgtactttaagagttaataagtattctaagatgatttgtgttttcaagtttgtctatcgatctctcaactcaaatttctcataaacaaaatcgtccaaaaatttgaacacttggatcatatggactatagatagagcaaccatctgatcaaaaccacgatgagctatgcacttctcttcacgtctatatgaacgtgtgtaaactgtagtgcgtgctggaaacgcgtgcgccaaaaatagtagttctgggttgtttgcatggataaaaaaaatgcattcttcctcagtcctcgacgagtgttccgtacttctcgaaaaggaaaaatatactctctttttttatggaaatttatccaactgtcaacctttttcaccaccgtaactttactggtggtcttatgttcacctaaagaacaggtaatgtattcacatcttgagcattcaaaatttattccaagattgagctttccacctaatttctttatctcagtaagttacaactaacatttatttaatttctctgcacacttgttcatctcaaccagtaacaaccatctaatccccgtcccttcctctctctcaccgacggtgaggactggcagcggtggcagacttggtggacggcagcgttgggcgaggatcgatgggggctagtccgatgccccttcccctgtctccttcggacttcaacccttagtgagtccctatgatgcccattatccgtcagccctgctcgctcacatgttcacccccttcattggtccgtctaccaccgtcgcatgcctctctattgttaccaagaccttaaaaatcaaaccgtatcatcacccttttaataatttttagaagttccgccagtcgttaccacccttctgctcgtttgctttatgtcactcctcttcgttgacatcacaatctttaaaagtcaaaggtttgatttttatagtttttaggtgccttgcctatggccaccttcctattgttttgccctgtgcacctctacttccctaccacccaccccttctctttgttgtcatcatcaccttcatcggagttccgctcatctgcacgaacgcaccttctcttccttatcatcatcttcatcagggttctgcttgctagaccgcttccccttcaatttgttttcattggcaacttaaacaatcgaaccttattattgtcgcctcctccctactcatttgccacccctctacctaccactactcttcttagttatcgttggcactttacaaaatcgaattttatcattgtaagggctccattgtcactgccttactcctttgtcaccccttggctcaccctcccatggcaaccgccgtctccctactattttctcgccctttcactcacctgcctgcagcccttcctttgttatcactgacactttacaaaattcaacgtgttccctctaaatcgaacagtaaggtgttgcgttagtgcctcaagcccatgtgtcatgaactcagccatatttttttccacgttaccttggcaagttttagtactattgatgggttaggtatgagactgtagtcggcctactatataatactctcgtacgaaagattatataaaaaaatttattctggataaacataataaattaaattattgatttggaaaaggtacgattgactgtatatagaatatcgcttacatgtctacatacatatcggatgtatctatgagactatggaagattaatttacaaaactaatctactaattacccgatgcgtcctttttggagataatgaagtttcgaggtacacttgtgagtatgcatagcaaaggggaacttaggaggtaataatcatactccattgtatagtatatatccatgtgtatacgttgactggctataatgcacgtgaatgtgttgggttggcttcctgaccactgtttggccttctgaccatgcgtgatgctcgtacgcgcggctggttccgtggtcttattcatgccgtatgctcctgtgtcccgtggatcaatatgacgccgactagctagtagatcagagcggctatcctctctgcagttggcagtacgatgatggaggtctcgtgatcgataatattgaactgatattctccgcagtagcagtgtcttgaagttttttccatcccaatagattgaattgtcagacagcgatggtttcgatctaaagggaaacgttctccaattgggttatatctctcagagccaaagtcgtcggagtacccttgtcggaagatctttaatggcaattaatgtcttgatgaagattgtgacaccattgcttcctggtcttgtgaacgggctttgtgatcgatatgttgttcttggcgggaatacgttggaggaaagatcgatgacgtagcagcaaagaccagaaaagtgatggatccaacttggagaaaagtaaacgtcggttgggtcatatctcctaggccagggcgatcatagaagtcgacatcaaaaaatccgcctcgaactcatctcgtcgaaatcttgaagcaccaaatccctcaagcgaatacggtgacgcgtttcaatgctgtcttataatgatataatatatataataaatagatagataccacgaaattcattcatttaaagacgacgtcgagctctaagaacagagtcccgatcggagtcccgatcgagatagatgaatgttaagggcaactctcgctatagtttgatgctgtagtttatacaagtaggacaaaactttggctcgatagctacaatgtttaatatcaactagcatggtggcccgcgcaaattgcgcggctagcatccttatgttttctctcgtataatagcatatatatttctttttttattaaaatatctttaaataacaacataatttaaatttctatttcctaatttctattatttctaaattgtatttctgtatggactctaaacttctctttcaatatgtctttttttaattccgaatttcagttatttttaaaatgtatttctatatggactctgtattcttcttctgatattccttttttttaactcgaatttttgttatttctaaattatatttctatatatactctaacctttatttttaattttcttattttttttaattccgaattttcattagttctattgtatatcgttatggactctagttttctcttcctatattccttatttttaatttcgaattttagctattttaaaattgcgttcctatatagactcatattttttaatttttctctgattaatatgagaatttgtagttcatgagagtgaacgtggcggcttcgttttctattcctttaataagttaatagatttgtagaacccaccccaagccttccattctggtgatggatccagaaagtagccatgatagacagcaaatcatgtcaaccagttactgatccaatcagatcagacccttgtccttggtgctatcacgttcagtatctctgtggattaggtgcaggacgacattgatgaggttgggtagcgcaggtacgagaagatgactaattattagcatatgaataattaagtattaattattttttaaaaaatagatttaatataattttctaaagcaaatttttatatagaatgtttttttaagaaaaatatcgtttagtaatttgaaaaagtgcacgaaaaaacgagtgggttgagttgggttgggaacttaaacaaaagaacacaagcctaaagatatgcatgtcgaggacctctctaaggaggcgatgttcctccaactcaaaaaactggtgaccgtggatatgacgatgtcgccggcacccagagagaaaatggagccggggatatacgcattcaaagcaggtgtaccaacagccatgtgcaacaaagaaattttcgtcggtcgagttcgactactccctccgtcccaaaataaaccaatatcatattaggttgtgacacatactaatacgataaatttagacatactaagatgtgtcacgtcctattataatgttgatttattttgcaacgaagggagtacttttgaagtttgatttttttttctctgacacgattggcacagtgtgttatgttcggttttttttttttgagtagttttgattttaacttcagactggatgctcttatgattcgaaccaatatcttggccacacttgaacaggccaaacgtgacaatgacacctttacagtcagcttgtgttatttcacgtgaaaacgcttacgatagatattgatttgtacgattatgtccaaacgccttcagtttatttagcatagagtctgttcatttttgtagagcattcacaatgacattgaaggccaaacagattagcagaagattgatgagccatttattagggggggactaactatatttatgacaccacaaattttaaaaaatagtcaaatattgtaaattacatacaattaaaatacattataattatattgtaatttttgaaaattacaatctaattttttaaaaaattacattataattatgttgatattcattgtgtaagagatgggttacaaaatattaattgccgatgttgattatatatcaaaatagcgttgactaacaagcaaattgaaaaacgaaagagtaaggcccactataatttttaataagtctctatcacatcggatgtttggacactaattataaatattaaacatagactattaataaaacccatccataatcttggactaattcacgagacgaatcttttgagcctaattaatccatgattagcctatgtgatgatacagtaaacattctataattatgaattaattaggcttaaaaaatttgtctcgcgaattagctttcatttatgtaattagttttataagtagtttatatttaatactctaaattagtgtctaaatacaggaactaaagttaagtccctgtatccaaacactaccgagggatacaaatgtctctaacggcaagatatacggacgaacgcatgcaagcctcaatcactttgtggctgcagaattttagcaatacttttagcggacggacgcatacaagcccataaatcagtcacgaattgaggcggcatattttagcaatactgttagggcatgtacaatgttgtactcctatttaataaccgttctcttcgtcgacatataaataaatttaacgatatgaaaatccgcatgtccgaaacggcacgacacaattggcagtggtacagtactatgtacctactggagaagtaatagtaataaaatcttggtagaactgaaggaatcgatccaaatccctcgagagatatcctctcgtgtatctttttttctttcaaatccaatataaataattatgaaaaattatttaaaaaatccaatataaataattgtgaaaattatgtaaaaaattgaaagtttagattatagtgatatttgttagtccaccaaaaataagctcaaatttgacctacatgttaaggcaaaaaaaataaatttaggtgcaaacagtacattgttattcatacactgattttatccatttatatctttgacatgtaagttgagtttggatctaatatttcacgaaatgatgtataaatgttatatgagtgttaccaaaacttttagaattttttctaactgattaaatggtttttaaacaaacaagggaacatctcgttcccttcgaaggatcatatatatgtatatatgtatatatatatatatatatgtatatatatatatgtaaatttgtttggtgctccatggtgcccgggcaccacgattgaaatttactatatacccaattcaaatgagtatgaaactttttcaaatatttaggtattaacgttaactactttactaactagttcaaagcaagtttgaactgaattcaaacttgcttttgttagattttgattctaggtacatagcatccaaatatataattagttaggtatgtaataatggattgtgaaataaagttaaatttgagttgttttgttgctaggtataggtatgaatcgaatacttataactaggtatatactcacaatttgaaaattttgaaaaatttggacgaatttgtgtatttcataccatggtgcccgggcaccatggtgccccatatgagtgtcctatatatatatatatatatatatatatatatatatatatatatatgtatatacatatgtatatatatgtatatatatatgtatatatatatatatagtgtgtcccgtagaatcaatatagatatgccaccacctcaatttatcaatagcatttttttatagcagaatttataaatcaatgtttaaaatcacctgctgataatactaccaattaagaccatcataaagttactcaccattgcattgtttttatgatagcagagcaatataaattaaacatcaccttgattaattcacagtactccgtttttataaattttgttttgataaagtgatcaaaatatgcctacataggatgtttccccatggaaaagtaacacaattgactcaattcaatcaaacttttgaaatttaaccatcaacggctcctaaatgtttttagtctagaaacataaaaacgatgtgtgtagattttttttataggtactttcataatattatagttttgcttcatctaagaattacattctaataaaaatagtggtcaaaagttacacacccaaaccaaataaatcaatagtgtcatatattcaaatatggacgcagtaatattttaaaaagaataaatttttgaaaaccccatattttatagccagagttgcaaaaagaaaaactaagtattataattggtatttacataacttcagatattatggatctaaagtttaacaagactccacgcctatacttgttgagtataaatttacttaaatttttaaaatagaatgtgtatgaacttttatgttattgagctcttgacagagattggtagttttactctttgttacattgaaaaatattgtttcaaatatactaaaattaacttagatttgaatatatgcaaaatttataaaatatttaaataattaaatatgtgattatgtgccatgagtcataatatataactaatataaatattcgtatttttcctttcgtcacatctattttcgtcccgttcatccacgtacgcaatccgattcggttagcaatagccatggaaaaaaattgaaaaaaaaaaatcggcggccgccgacgccaccaccgccgctggaggaagaagagaggcagaggagggagcaccgccgccggatccgcccgcggtggccgccaccgccgacggatccaccctcagacgacgccgacgctgtcgttgccgtcgacgccgccgttgagagggcgccgtcaccgtcgaggccgacggggagagggagagggagggagggggagggacggccgtctctgccgcaccccgccgtcgttgcgccgtgtcggcgagacgggaaggagagccactgccgccaccgccgctagcgtggggaaggtcgccaccgccgccacagctagcgtgggggaagtgcgccgtctctgccacaccccgccgtcgccgcgccgtgccagcgagaagggagggagaagggcagggaagcggcgccggtggtgggagaggcggccagctggggggaggggagaggcgggagatggggagagggagcggc

SEQ ID NO: 44026 - DNA, 31840 bp, Oryza sativa
gggggagggttagggttttcataaggccgtgggccaaccggcaagggacggaaataagtctattttacatccctcgggccgaagaaaaagagaagttcatttttagtacttcattttttcagaagtattacaattatagttattgaatgtgtttatttcgaagcaaacctaaaaggaagtatttttattcttcttccaattaaataattgttaaatgttatttgtattattaaaattagcaattaagctctgaaaattccaataaaatttcaaagagcgtaattaatcatagagaatttaataaaattaaatttaaccatgttattttatttctcacacttgcttgacttataaatttatttaattatacacatacctaattaaaaatatcaaatatttcagcgaatttgtattttaattaattgcatatttttctaatatgtacgcttcccgttgcaacgcacggacacttttgctaaaccaaacaacacttttggtcaatatacatactccgtaatcaaccagtgcaacgcacgggcacttttgctagtaatatatgaaataacgagattgtcatcgattcggttcagcacaaactgagttgggctttggcccacccctacaggcctacggagagtagacagtagaccctatgaacggcccagtactacggtacccactgactgcaaagatctcagagaagattgctaattaattattgcacgaactcggaaaatattctgatgttctaataaccctgcatcggaattgcttgaggactatcgacagttttcttgagtgaaaactgttaaattttttagccgtcgatttcgttttaagatttgtactgagatattttactattagatataaaccctcttttcacaagctagtcccatcattgcatgtttacggtagatttgttcaagttatatctaagttacattccaattacatgctagttacattgtagttacactatatttacattgtaactatagtgtaactacactataactatattgttatctctatataaattacatataaagttgcatatattattttaggcaacatatcctatgcacacaggccctcacgggtacacacgtgcacaccaactaaaaaatgtcaccaaaaactctagaaaaaatcatacacatactttcaattgtattacacctagggttaaaatcttaatgtcaaattcattatattttagccgtaacaaaaaaaaacaaaaaatctgacagttttaaggttgcaattttgtcagaattttatcttttttgttattctctatgtagaatgaatttgaagatgcgactttgcacgtagatgtaatactattgaaagtacatgtatgaatttttctagaattttttgtgataatttttagttggtgtacacggtgtgtacacgcgagtgcctgtgtgcataggatacactcccattattttaatacatatatatataagttattattattatagtatagttatagtgaaattatatactatagttaaatttgaaagttttcccctcaaaaaacactcgacacttttttaagctttgggaccagatgaatctgctgatctaagccacagtaaatctgacgaaacaacaagctatcaaccaggtgcattatttttcaccaatgcattattgtccgcttatagataatggatgggctcacggcatgtttcctaaattcctaaatttacgattttgtacaaaacttctgcatcagtatctcttaggaatctgtctaaacaaactttcaacttttcaatatttagttatttcatctccgctctcgaataattatcataacctttagtttcacccataatccatcatccaccagaattttggagcataccccttatgatggaactggtcacaccatattttcttatctcacttttctttcttcacaacaaaagccaagcatcaggaattatacaacacaacacactctagatgagaagctaattcatgttacagttacacacaccaatggaagaggaagaggaagaggaagaagaaagaaatattattgtggggggagatctacaatgctgtgtattgtgactgaccacacccttgctaacctgggtacctgtgtcctctgcagagcacctagatattgtcctcatttcatacaactcatccagctcaacagccatcaccagctgttctctgtgtatttcttcagggcacgtaccgtcatcaccagctgctgcctctcgccttcgacttccgcgaatttcaggcttatctctgagtacggcccgtgcagttctttcagctcttcctctagtgcagtgttccgcgcctttaccgactgatcatgagctgcattctacattgattgataattgccaccagcaaagtctgtcagcaatggaccatgtggtactgaattatagaaaggtaaagctttgctacagctcccggtggctccgtcgtatgcttgatgtgcgttatagaagctgttttaaaaaatcaaattaatttatttttaaatatataatagttaaaatttaattaattatgtgttatcgagcttactcattttgcatgcgcacaaaattttcctcatttttttgaagcatcgaacggggcctaagaagaagaagatatgcattgagagggcgtcctctaggaggcgatgctcctcaagctcgagcaaccggcatcagtggatatgacaatgttgctggcaccaagagagaaaatggagctggaaatatatatacgcttgatataagttgcgcagtgatagtcgataacgactatttaaaaacaggcggagtgactgtgacgttcaaacgaaacaacatttaaattaagttaagcttgacaaatgttgatgtgtaaaaagtgttgagtgtccacgagaaaacaaaaaagatgactaaatgaactagctcccacggatgcctgcgtgcaatcttgtatctgcttggacgattttcttgggttcgatcctgttcttgtgttgtgatccaattaatttggcagagaccaatttgctgcacgtgtacgtctcgatccactgttactagtcaaaaagacccatatatatatgtaaaaatacgagtatccaaaatgcacgaatctgaggatccatgtctctttcttcttcattcattcttcctccgttcagctagaacagttgtagcattagtaccgttatggtaaagtctaaactatacatatattaatttattttggtatcaagagagtacacgaaacggtctgctttctgcaacacttctcatctataaaaacccgaggcgtgcatccttcccctataccacattcgatcacattcggctagtaaccaagcggttcttaagctagctagctcgagcaatggccaagtggacggctgcgatggagatgcttctgctggtggcggtggcggcggcagctgtggcggtggtggtggcgcaggcgccgccgccgccacagtgcgaccccgggctgctgtcgccatgcgcggccccgatcttcttcgggacggcgccgtcggcgtcgtgctgctctagcctgaaagcacaacaggggtgcttctgccagtacgcgaaagacccgacgtacgcgtcctacatcaacagcaccaatgcacgcaagatgatcgccgcctgcggcatccccttgcccaactgcggctaggctccatcgccgccgtttgccggtgctggccatgatgtgtggcagcatatataaatatatgctgccctatgtccttgtaaaaaataaaggacgatgtctagaagcatatatatatggtgtactgcgtacttgaataaaataaaggatgtgtgtttgaatacataaattaccgatcgattaatgcacccgtgtttgatcgatcgatgaggtgtcttctgggatttaagtttgagtttctaatatccaatctcgtgggagcgtgaaatactactttaagagttaataagtattctaagatgatttgtgttttcaagtttgtctatcgatctctcaactcaaatttctcatacacataatcgtccaaaaatttgaacacttggatcgtatggactatagatagagcaaccgtctgatcaaaaccacgatgagctatatgcacttctcttcacgtctgtaaactgtagtgcgtgctggaaacgcatgcgccaaatatagcagttctggattgtgtgaatatgtgtatgtgcatccaatttgcatggagaaaaaaaatccactcttcctcagtcttcaaagagtgttccgtacttctcgaaaaggaaaaatatactctcttttttttcatcgaaatttatccaactgtcaacctttttcaccaccataactttactggtggtcttatgtccacctaaagaacaggtaatgtattcacatcttgagcattcaaaatttattccaagattgagctttccacataattctgtatctcagcaagttacaactatcttttatttaatttctctgcatacttgttcatctcaaccagtaacaaccatctaatccatgtcccttcctctctcaccgatggtgaggactggcggcggtggcagacttggtggacagcagcgttgggcggggatcgatgggggctagttcgatgtccctttccctgtcaccttcggacttcaatccttagtgagtccctatgatgtatgttatctgctagccctgctcgctcacatgtccacccccttcattggtccgactaccatcgtcgcatgcctctctattgttaccgagaccttaaaaatcaaaccgtatcatcacccttttaataatttttagaagtttcgccagtcgttagcacccttctgcttgtttgttttatgtcactcctcttcgttgacatcacaatctttaaaagtcaaaggtttgatttttatagtttttaggtgccttgcctatggccaccttcctattgttttgccacgtgcacctctacttccctaccacccaccccttctctttgttgtcatcatcaccttcatcagggttccgctcatccaccccttctcttccttatcatcattttcgtcagggttccgctcgctagaccgcttcccctccaatttgttttcattggcaacttaaacaatcgaaccttattattgtcgcctcatccctactcatttgccacccctctgcctgctgctactcttcttagttatcgttggcactttgcaaattcgagttttatcattgcaagggctccattgtcgttgtcttactcctttgtcacaccttggctcaccctcccatggcaaacaccgtctccctactattttctcgccctttcgctcacctatctgtggcccgccctttgttatcgctgacacataacaaaattcaaggtgttccctctgtatcgaacagtaaggtgctgtgttggagcctcaagcccatgtgtgatgaactcgaccacattttttttccacgttaccttggctagttttagtactactgacgaggtaggtattagaccgtagtcggcctactatagaatactctcgtacaaaaaattatgtaaaataaattgttctaggtaaacataataaattaaattattgatttggaaaaggtacgattgatggtatataaaatatcacttacatgtctacatacatatcggatgtatctatgagattatagaagattaatttacaaaaccaatctactaattacccggcccatgcgtacgtactctttggagataatgaagtttctaggtacacttgtgagtacacatagcaaaggggaacttaggtggcaatcatactctatttataccgtatacgttcgaaaagcctaatgggcgatcaatcaccccgagtgattaccccctcctccatgtggttttttttttagaaccgcattactttcctattttagtaaatttatgcacctaaagtatgaacatataaagtttacacatctaaagtttatacacctaaagtttagagacccaaagtttatatatctaattcaaaattaaatttgaattcaaatatttttatatttagtattttctaaacatctaaagtttatacacctaaagtttataaacccaaagtttataagtctaaaagtttatatacccgattcaaatttgaatttgaattcaaatatttttatatatagtatttctatacataagtttttctaattttgtgtttttttattttttttaaaaaaaaattatggtgtagagacctaaagtttagagacccaaagtttataagtcaaaattttttatacacgattcaaatttaaatttgaattcaaatattttttgtatatagtattttctatacatctaaaatttatacacctaaagtttatagacccaaagtttataagtcaaaagtttatatatccgatttaaatttgaatttgaattcaaatattttttatatatagtatttctatacataaatttttctaaactttgtgttttttattttttaaaaaaaatatggtgtagtaggaaaagaagaaggggagaaagaagggagagaggagcgtgttaggggggatgggggtgaacgcccacaacaatcacccacccattagcgacacccgtgtatgtttgactgatcatttggctataatgcatgcgagtgttgggttggcttcctgaccactgtttggccttgactatccatgatgcatgcacggcggctggttccgtggtccttattcatgccgtatactcctgtgtcccgtcgatcaatatgaagccaattaggagtggggattatcggtttgttaagcggtctacatgttaaaagagacctaaggttgtaattgtcgcggtattgccgtagctccctgtcaatttgcaccacctctgttgtttagtttcaataggaagtttacgatcttagtgcagttttctcctctgtcgatcttgttggatctttgccttaagccattccctttggcgatgtacgggagcttgcctccttgatctgttgctttaatatatgtttaagtttttttaaaaaagataagacaaggagagcggctatcccctgcagttggcagtacaatgatcgaggtcttgtgatcgataatattgaactgatattctccgcactggtagcgtcttgaagctttttcggtcctaatagattgaattgtcagacagtgatggttccgatataaaggggaacatacttcggtcggatatctcccaaagctaaagtcatcggggtatccctcgtcggaagatctttagtggcaattaatgtcttgatgaagattacaaataggctttgtggttgatatgttgttctcggcgggagtatgttggaggaaatatcgacgacgtagcagcaaagaccggaaaagtgatggatttgacttggagaaaagtaaacgttggttgggtcatatctcctaggccagggcaatcatagaagtcgtcatcagaaaatctgcctcgaactcatctcgtcaaaatcttgaagcaccaaatcccctaaacgaatatgatgacgtgtttcaaggttatcttataatgatataatataataaatagttagataccatgaaatttcttcatttaaagacgacatcaagctctaagaacagagtcctgatcgtggtacgtagatgaatgttaagtgcagctttcactatagttcgatgctgcagtttatacaaggtgtacaaaactttggctcgatatagctacaatgtttaacatcaatttgtagaacccaccccaagccttccattctggtgatgtggatccagaaatagccatgatagacagcaaatcatgtcagccagttgcgcgatccaagcagagatcagatccttgtccttggtgctatcacgttcagtgactctgtggattaggtgcaggacaacatggataaggttgtgcaacgcaggtacgagaagatgactaagtctgagtgtcgggaacttatcccttgcgtactgaaaacgaaataaatttattagcacatgattaattaattattaattattttttaaaaaatagattaatataaatgtctctaacggcaagatatacggacgtatgcatgcaagtggagggatacatatgtctgcatatgtctgtgacggcaagatatacggaggtacgcatgcaagcctcagtgacgaattgtggctgcagattgttagcaatacttttagcagacgtacgcatacaagcccataaatcagtcacgaattgaggcggcatattttagcaatactgttatggcatgtacaatgctagtactcctatttaataaccgttctcttcgttgacaaataaataaatttaacgatgtgaaaatccgcatgttcgaaatggcacgacacaattgggcagtggtacaatactatgtacaggagaagtaatagtaataaaatcttagtcaaattgaggggatggatcctaatccctcgagagaattgagatatcctcccgtgtatcttttttttctttcaaatccaatataaataattatcaaaaattatttaaaaaatccaatataaataattgtgaaaattatgaaaaaaaatgattgtttagattatagtgatatttgttagtccaccaaaaataagctcaaattcgacctacatgttaaggaaaaattaaatttaggtgtaaacagtatattgttattcaaacactgaatttatccgtttatatctttgacatgtaagttgagtttggacctaagatttcacggaatgatgtataaatgttgtatgagtgtttccaaaatttttagaattttttataactgatcaaaaggtttttaaacaaacaagggaacatctctttcccctcgagagatcaaaatatatagtttcccgtagaatcaatatagatatgccaccacctcaatttatcaatatcagaatttttttttatttatagcagaatttttaaatcaatgtttaaaatcacctgctgataatactaccaattaagaccatcacaaagttactcaccattgcattgtttttgtgatagcagagcaatataagttaaacatcaccttgattaattcatactccgtttttataaattttgttttgataaagtgatcaaaatatgcctacgtaggataatcccccatggaaaagtaacacaattgactcaattcaatcaaacttttgaaactttaaccatcaacggctcctaaattttttgagtctagaaacataaaaatgatgtgtgtagattttttttataggttctttcataatattatagttttgctacatattagaattatattctaagaaaaatagtggtccaaagttacacacctaaaccaaatatatcaacagtgtcatatatttaaatatggaagcagtaatattttaaaaagaatacattttagaaaaccccatattttatagccagagttgcaaaaagaaaaactaagtattataattggtttttacataacttcagatattatggatctaaagtttaacaagactctgcgcctatacttgttgagtataaatttacttaaaatttttaaaattgaatgtgtatgaacttttaattattgagctctagacagagattgatagttttaccctttgttactaaaattaactgagatttgaataaatgcaatttttataaaatatttaaataattaaatatgcaattatgtgccacgagtcataataatgtatgaaataacaggattgtcatcaattcggttcagcacaaactgagttgggctttgggccacccctacgggcctacggagagtagacagtagaccctatgaacggcccattactacggtacccactgactgcaaagatctcagagaagattgctaattaattcttgcacgaactgggaaaatattctgatgttctaataaccgtgcataagcttagggaccagatgaatctgctgatctaagccacagtaaatctgacgaaacaacaagctatcaatcaggtaaattatttttcgccaatgcattattttccgcttatagataatggatgggctcacagcatgtttcctaaattcctaaatttacggttttgtacaaaacttctgcatcagtatctcttagaaatctatctaaacaaactttcaacttttcaatatttagttatttcatctcagctctcgaatatttatcataacctttagtttcacccataatccatcatccaccagaattttggagcataccccttaagatggaagtagaactggtcacaccatattttcttatctcacttttctttcttcacaacaaaagccaagcatcaggaattatacaacacaacactctagatgagaagctaattcatgttacagttacacacaccaatggaagaggaagaggaagaagaagaagaaagaaatattattgtggggggagatctacaatgctgtgtattgtgactgaccacaccctgctaacctgggtacctgtggcctctgcagagcacctagatattgtcctcatttcatacagctcatccagctgcctgcctatacaaaaccctccggggtatcatctaaatcttttgtactacaacgtgtgtgaggagcatagatcaagatcacctcagggagttcttcagggcgcgcaccgtcatcaccagctgctgcctctcgccttcgacttccgcgaatttcaggcttatctccgagtaccgcccgtgcagttctttgagctcttcctccagtgcagtgttcctctccttcaggatttccagctcctttaccgactgatcatgagctgcatccctacattgattgataattgccaccggcaaagtctgtcagcaatggaccatgtggtactgaattatagaaaggtaaagttttgctatgagtgtagattatacctcctgtcatgcccattgcagtcaccatttgcattgtgtctgttggtgcttggcagcacgttacagctcccggtggtgccgtcgtcatgcttgatgcgcttagaagtagcatggtggttgtcctgaaaaaacacaacattgtgtgtaactttctaggtaccaaagcgtatgattacaatctaagcataggtatgtaaaggacaggcagctcaacaaatatataatatcacatcctagttagcggggacctctattcataaagatatcccctacctatcagaagggatctgtacaactgaatggtgaataaaaacaaatttatctccccatgtgcaaaaggatgtaaatcatgaaaaaaattcttatagaagatagtcctacttatctgtggtcacaactcgcaactacatgagtttttaagagtagcccagcatgctgacttcaatacgaaagggaagttacacctacttgttcaattgtgtggtcttaaggaatacttgtatcattttcttctaacaagtttctgttagttgtgtttggagcaattcaattgtccctaacaacttaaacctgatttggttatagatatgatggagaaaagcatggaaggaatttcaatgaagaaacttaaaaaggagagttagagaactatttgtgctacagaaatatctgattatgcaatatttacctcatctgatttgacaccattttgtttcacatcctccctgctttcaagggctctccgaagcttcagcacttgggaagcaaggttgtgtttctcagagtcgttagtggacatcaaaattttcaggttgtcatactcgaatttcaacgatctaatctctgattgcagcttctcgatcatctcctccttttcattctttgaactttttaaagtgtttatctcctctaaatatgtctgcacttggtccttgattgaagcaagttctttgttgagcaaagctatctcagcatctctatcctgcaagaacatatccttttgacaatttgcagctaattccttgtccttctgctcattctcttcgaagagattgtctcgttcatttgacagattctcaatcttagctttgagttgatctatttcttctgagagaacacttaactttgcttcgttgcatctcttctgattctggaactcatcactcttgcttttaagctccattaccagcctgtctgtctcctttgacttgaaatccactaaggtcagtaactgttgaaccttcactcggtgttgttcttggattgatccaagatcttcttgtgccttctgtagtaattcttccaactggcccttctgtaactgtagctctgcagcctcttttctagcttgcataagcaactgttcatttgcgctgaaagcagaggaaacttgtgaagacaacatcttgaattcctcctggagtcgttcagcagtagtggcattgttccatcttgctttcctcagggactcctcggcctttatggccctttgctcttgttcaacctttgcacgcattacctcttgtatgtcagcctctaatcttttggattgttcctggagttcattctccaggctctcaacattggcttcaagatcgcttattatagacaaatgtgctgaacactcgtactgcatccttagctgctccctcaactgtgtttgctccagcctagaagagatgtcatggttctcttgcttcaggatctcatagtcaagtgcaagttgctccatttgcatctcgaggtcttcacggtccttcttatacaactcgatttcattgctcagctcaacaattttattttgaagttcagaggtagcgatgccatcggttgtctttgccaatgcatccagcatcagctcatcttctttctcttgaactgaacttgtttcagatatgtctattttgtgtccagcattatgcacatttgacaatgctagctcatattcagcctcctggggatcctccagtgtttcttcatgcaaaagtgatatctccttgttcttctgctccagcatctcatcaagatccttcacagccagaagtagctcagagttggattcctgcattttctgcaattgtaaatgcagatctccatttagattcttctcatggcccagttcttgctttagctcttcaatctgcgaccacgggtcttccccgcttgatagtcttttaccagatccgtttgcatcatggatagtctttttcatccctctgagtgcttcacattctcttctgagagcatccctctcatccctcaagctacccacttccttggaaagatcttgccctcgtcgactctccttcacaatttgctttctcagtgtttgcaactccatatcggagacatccaatttccgcgtcaaagtggctatctcacttcttagcttctccacatcatcctctgcctccctcaaccccgcctcaccggagttgctggttgacccgtcggtgctagcatcaggagctgagcttcccgaccagtcaccggagctggtcaatgtgttcctcaggggtgagagggtattggtgccctcctgaagaaatgtgctgtgcatacttgcattgtttttgggggtaaatctccctgagctcccatctgaacccgacaccgaaatggcatcaaagctgttggaattgtgaaggtgatcgacaggcccacgcatgtttcttctcgctgaaaacctcatcccaggaggtttgtttatcaccaatccgtcctgtaaaagagatcaccacaaaaacaggcgaaagtcagatcctacatccattgttcagtgccaaaatctcacccttctcaagcaaaaagtgaaacgatatgattaaagttcagcaagagaaattctgatctcaaacagttcagcacaaaaaattctgatctcaaacaaaaaatatcacacagcaacaaaaaaaaaattaaaacagtacgattcaagttcagcaagagaaattctgatctcgaacagttcagcatgaaaaattctgatctcaaacaaaaaagaaaaatcacacatcaacaaaaacttcccaaatgatcaatcacaaaaatgtaagctccctttcccctctttttcttttgcaatcttctttgcatgccaaaagccttcttttttatccatcaccaaaacgaaacaaagcaatgcaatgatgatgcacgaaaaaggaaaagctctcaagaacacctccaatccttacttgcatagggctcatcgcatccgccgccgccgccgccgccctcgccttctccgcctcctcgtcctcgcaccggctcagctggctctgcagcgtcttcctcggcggcgtcctcgccaccaccggcgacacgtcgccgccgttctcactgccacacagcaagaacaatcactcacctcaaatgcctaaatctggttgagctcagagcacaatgcagcagcagcaatggcgaaatctgctgcggcagccgcagaagaagaaggagaagaagagatggtcgagattaaacaaccaccagcaacacacccacctggcgtcgtcaccgcacccaccgccgccgccgccaccaccacccaccacccgctggatggtcacctgtcacagggtacaagcaccaccaacatgagccccccaagaaccaccgcgagcgcgtcgccgtcaaagctcacaggaaaaacaatcgccgatcctttttaagggagagagagagagattgaggtgagattgggacgaggtgctcacgtgcagctgcgcgccggggctgccgctgagcggcagcgtgacgatccacggcttgaacgcgtcggcgtactcggacaggttcagcgtcgcctccccgagcagcgccgccttggtcgagccctgcattgtgcggcgggtgagacaaatcgtcgagcacatgacgggcaagcgagaagcgggggggtgagtaatggcggtgtcggtggcggtgggcggtggcggcgaggagagggaacgcaccgtgtcgtagacgaggaactggtagatcttgtccttgccggaggaagggagcttggtggcctcgtagaccggggcgggccactggcacgcgccgtcggcgacctgcgcgctctccgtcctcgccgtcggccggcccgcgtcccgcggcgtcaccaccaccatcatcgcctcccatcccacctccggcacctgaaatcaacccacccaaccaacccaaatcatcatcacaaaaccaacaaatcaacaacaacaaaaattcttcgctcgtcgcggcgagcaaattaattatccgtgcctgcgtggcgtggaactgcagcttgaacaccgccttcgccttccccccgcccccgccgccgccgcgccaccgcgccgacttgaacatcccgaccaatcagtctcaaccaagaagaaggcacagctcgctcgcctgtgcggcgctaagcttcttcttcaccggcggccgcattgcaatgcctccgcctccgcgcgacgccgtggcattgctagctgctacagcgagaggaggaaagacgaagagcaagacagcgagcaagtgagcgagtgggtggcacactgacacagccagcaacggcaagcaaggcaaggcaaagcaaaacaacggcaacagcaaagcaagccacacagatctagtgagagaaagagagagatagagagagagagagatcaactgaattttctctctctactactactacttgagctctgcttttggtccctttctctctttctctctctgtgatttgtgggggggtttagggggaagaagagaagaacaagaaagagaaggttctgagggctataaaaatggcggtcaattgttcggggcgatggactagtagtagcagtaggggtttattagagctaacagagagtgtgattggcgatggcgatggcgatggagtctggtggaactgtgcaagagacgagcacactactatacacaaaaaaaaacaatctttttttcagatattacacaaagaaactttttttttttagaaatataagactagtcccaacccaaaacactaagatatagtttttataaagtcacactatcaagaaactagtaatagacaccactctttcaatgcaaacaccacttttttttacttaaattaaatttaatgatacttatcatacatgatgttttgaatgttgtgtggaaaccatgtctcaagcaagatctggtttccttcccttttctcatttattcacttacgacatcatcttttattttagatgacagcttatttaatgctatagacatctcattaacttaaaaatggcctaatcgtgcaaaaaaaaaaagatcgatcttttcttcttctttttttcccgaaatcgagtctagtctcaagtctcaactgcagttgcagtagtataggagtacagccgttgcgttgcgtgagcgtcacagctgcagcggctgcggtcgtctgcagctgcggggacctgccgacggcaacggttgctctgcgtgaaggggatcgatgttgggtgttgggttcttggatccatcgatttgtcagtggcttattgtacttgcttgagacctaagcctcccctcctctcctctttggagttactgcctccatcttgtactagcatcatccatttgtctagtaaaaagtttgtttctgaagtaaattatactgctcccaatacgcatttaattgaagtattctatctgttcaataaaaaaacaaatctagtatgagatataacatatactaatattacgaatcttaacaaaccttgtatccaaaatttatagttgtcacatcccgtactactagaaaatctatcttatttcagcacactactaatttatcctattactactagaagtggtgtttttttttgttgacggagtgagtagcatgaaatatcttctcgcaaattactaatgtgtgctaagagcaggtacaatagtagactataagccagctataaagaaagagagagaagagcagtgagctacatatctgtagccagctgcagcacggacttcaagacgtaatgtgtgtatggcaggtgggaccaggtattaatagtatagtaagcaactattgtatgaattggctattacgttgggtatagatgatttggagctagcagtgggttatactattaaacttgttctaagtgtggtcgatgttgatgtcaaatcgcaatggtgtgatcttgctgtcattgggtgagattaggggaggggagtttggtggttgcatttcataggatatcgatgaaaccttcacgaatctgttgaaaatgtgttggagagttttgtagtttgttgcgagcattggaaaggattcattgagggtattaatgtggaagtgtaatgggtagtctatgtttgaggtcaaaatgtagtgaagcatatgatgtcattgaagtttagagcggtggcaatgatgacattacttcttgtctttttcaatagagtacaaaaaacacgttgaaatattatttaatttaagagtgttatttaaagttgtgtttttatctaattaataaaatggtggattaatgcaacacacttccccgaatttatggtgagatttttattaaaattttatgcatacaaatttctttaaataatcatttaaaatatattttcaactttgtgatacttaattaatttatatgtatcttcctcgaaaaaatttcatccatcttcaatgaatggaaaaaaaaggacgatcaagataaactaatcagtaaatgatgatgtaacaaatatcaaattaattactatgcagaagaacttatcaaacgcatacacgtccgattgcaagcaacacctcgtacacaaagccacggtcgatggatgtacatttcatcgcagcgtaaccacctacaaaatgaaatcccaacaaacacaattaattagtttcgtatagacaatccccaatcccagcaacaccattagagcaagtttaatagtatagccaactactaactccaattcatctatagccaatctagtagctcatttatacaatagttacatactacactattaatacatgatcccacatatcatatatacactgcgtcttagagtctgtgctacagctggctacaaatctgtagtccgctgctcttccctctctttatttatctccttatagctaacttatagccttctattgtacctgctcttacaccaccaatgacccatccaaccgtgcatgctccccaaattctggaggcaatggagcatggtggaaccatgcagccagccatggcaagcaggcaaaagcacaacgatgatgcttacaactcgacaagaacaattcaaacgaggacgagaaatggtgcacgtacgatgggtcagatcatgggtaggaaggatttcaggtgagcctagctgtgcttgtccatgccggccttcgctggttgtgtcattgtgtgacctcacctcacctgaattcttttctgattcaggcaaattctacctttggttttcattaaaacgttgtgttttatgtgaagttttcctataaaaaagttactctaaaatatcaaataaatctgcttttttataatttgtaataattaaaactcaattaactatataatgataactttcttactccctctgtagtaaaaatacaagggatttttggtggatgtaacgcatcctagtactacgaatccgaacagatagtattaggatgtgttaaattcacctaaaatctcttacggagtatattttagaacggatggagtattttattcgccctgctactacttagggcatcttttgccgggggccggttgtgtggctgacaggtgggtctcacgcggcagccccggcatggtgcctggggggccttggcgcatgtggaggttgctctgcactgatctactcctatccatccatccgtcgccttttacaacgcgatcggcgtgcattgcttttttgtgttttttcgtcgtgcttttgctggcaaccaacctcagcaagttatttcatccatccatccatccatcccgaatgtgatctgctttgatgaacacagcaacagcacgtatacccaaaaaagggaaaggtattcttacacatgtacacacatggtgcgtatgtacatctaaagaaggagcatatatccaaacagctagtatctactactatctagtacattgctcaaacagagtagtggtactagtgtactatatataccggtggttttttcctacttgtatatacatcgtacacatggttacttgaataatcatatgatatcaaccataaattagtgtattattgatataattagctctccgttctttgttggtggttaattgtactaattgatatatgaatgaaatggacaaatagcagaaagttattcttgcaactctagttacaaaataacaaaggacattttattcttccttcaaaacggtgaaagctggcacagtttttcgagaaggatatttttttagccgggctctatatctaaccggatatatgcagccattttaatcatgaacttaacctatcgaataggaaacttagccctcaaataactcaatctgaaattcactcctatgaagatttgaactcaggaccttgggtgctactcatgtcactgcaaccactaggctacatgccatttcacgcacagtttttcttataaacacgatcactatagttaggctcacctaagttcagaacatttaatttatactgttaaacgtagaaatgcctataccatgtagtaaaataacctatgattgacttataaagatataacataaagaagaataatgtactagatatttttaaatgttttgtgctagctaacagaaactaaaaggttgagagtagttgcagcacaatttgtagctgattattatagaaaaagagtggttctccctccaatgtaatgcttatgtgctagtatatatattactagttttctatttagtcggtgatgcagtcgtgcatcatgcaaactcatctccaaccatctattatgtattttcttttgttccactttttataagagccatcagtttattttgacttttgagctagcttctccagaaaaatccaataatcttttttccctgatctaaatatggggcccctgcattttttctgatataaacaacatcctagttactgaaactgtcggtgcgtagctgatgtgctttcttcatgtacacttagcttaatcaggccactaattaattgactgaacacctttgactactatacaacacagtctctctctcacacacacactgtacttgcttcatccacaaacaagagatatattctataggtgtgcacagtcgtatatagaatcatataaaaatcatacgtgtagagatttgtctctcgaggaattattttaaatgacagtagcacaatgcaaattagtaggtctaaacagtacatgaatttggttaatgccagctgtttggagatgtatatataacctaattaaattttggctaatcatttacttattgtgagagggagcagtactgaaaaccagctcaaatatattgattgattggggctaggcaaaccaaccatatggggacctaactaatccaatcttaggttagcgtaagaagattataaaaaaaaataattgtgaaagggaaagaccaataggtatgactcgactgggaatcctgtagcatctacagagttaatagttttttaattaaaaaaatgtgtgcaactctcactcataagtggccccagcacattcttgatatgtttaagctagttatggcaacaaaatagctgcacttgccatcaccgttgattaatgtactgtccattggaaaaacactgattacatactactttaatacttcctctatctaaaatatatagcaaaccaaatttaaaattaacataatatagtactacgaatctaatcatattatataaaatccagtactaaattgctatattttagaatagatggtacattatattcattctgtcaaagaaaacttctgacataatatagatttgtagtgtaatactttaaagcattagacatgaatatcttcttaaaatttggattagatgtataaaaaccatatacgtagatttgttaaaaaaaatataccagtattttaaaatattatagaccgtgtcaatgtccaaaacaatatttttttaacatattgaacaatagttctaggatgtttggctaaaaacttattcggacttttttttttacagagcaagcacaacttctagcctctgcagtaacaaacaatgtgtgcatagcactggacgaaaacgacggtttaaaactttaaataatcactgtgctgcagcatcaatcaagtttgggttgaactaaacagttattacagctaaggtggtacacaggattaattagctgtttggcacggtattgtggttgaaaagctacggcatctgctggtcctaaaaccccacattaacccagtaatctcacgatcacgtgcaaccatagataaccaccactagtactagctatacacacaggctgcagctgatcgatcagatcacccaaatgaaaaaaaattcagaaataaattaattcagggaatatgtagctgctgctggtagtgtgtgctgcaaatggataattgatatggatatgtatgcgatgcaatggatggtccctgctgattagcaagagaaaaggttttgattaattagcagctggaaacgctttctaaaagcagagggtccagcttcaatgggtggatggatgggttggatggaggcttggatcctctgctcatgatgcctcggccgacagtggtttctctgtcggtttagatgttaacctctaggctttgttgctacaaagtattgacataatcatacctgtatttcgtttaagtgtacatagttcttctagttaatttatatatgtaaaatttttacatatttttatttaattagttactgaaaaaagattgatgtaccagtgttgacgttacgatattgatgttacagcattataaggtagacatttatattttagtacgaatctaataatatttatcataaaaacaattggatcatatgaatgacaattaaataagcactagctacttcgaaacataagatgtagacacaattagatcctacgaggttttagtttatattactcctacaagtttacattgctggaatagcacacaaaagaggtactggcagtgaccatagcatttatatatgcagcaataacaaattgtccctgacaaaatactttaatctatcctattaaaaaacaatcctagggatgcaggattgaatttacagagagagtatactagctgaacattttttttggtttacttgacgaagaatcaaggcatcccgacacactgatcgaggattgaactaccactgatttttgcctttttgcctccaattctaccagtactacgtacggaaacctaaagcctataattactttcgaaaatttcgtactcctactatactgaattttagattaaccgtacagtgtactacatactcgtagtttagtcagtacggttcgcgtagataactatcgatcgaaaagcaaattaatgcatctggacaaactcatcaacgatagtcacttacacgcggggccagataaattaaaattatacagctcagcttcatcacttgcttgatactacttcagctgaagccaaatttgttattaaaaaaaagctgaagacaaatttaagttttaaaacttaattttatatagttggttttaaggttctattatcatactaagaacacaaacatacaaaacattatctatcttcgtttttttttcggttatcacccgtagagtgaactataggtgctaagtgaataataataggatatatatacacgatattaacagaggcaattaatggttgtatttcaatacttactttcccgtctcaaagtatagccattttttaggtcggcacagttattaagaaagtactccctccattccataatataaggcacaaccattttttttagatgttccataatataaggcatacatgcatgcatgccattaactatgacaattctccattaaattactattttttaaaatccttcactctcatattctctaactctattggatgcatgtattacatttattaggatgatccaaactacaaggtgataataactatttcttggtctttgggttaagggtggttgtgccttatattttggaatggatggagtatgtgagaatgattggaggaaatatgtgattagttgaaaagagaaagtagatgaagaagaatggttgtgattggttgagaggacgaggtaggtgaagaaatagcttcatttgagataaggcactgtgctagaaatagctacgatattttatgacggaggtagtaccaagctttaatttggtggcgacaatcctacagtaaggttttgcactaccaacttattagagcagagttaaaaaaatgtagtatttagtttttctatataggattcggtagaaggtttgatatgatatattaccaaaatttcgtcactatcaaattttgacatgtaacaaaacccaatcaagatacactgtatgacatctagggagcatcatacacagtaccttgtcttctgcacaactattgtaccagattatactttagttcattggatccatagctttgctgttattgggtgtggcacccttgttaataaagatcattgtactgctccacttttgtctttagagcctttgctacctttgcttcgtccatgttttctccttagagcaagtataatagttggctttaagccgactaaatgctgaggtggaggagagagatgagaagcgggctgtaaacttacagccggcttgtacacaagaaccaagaaactatgtgagagacaagtgggccctatatataggtgggttaagagaaagctacaaagaatcttatagccaacaagtcggctgtattattaaccttgctcttataaaaatcttctggtttttgtgaatgtactactctagctaacaaagtctcaataatagtcagaacaatgcaagtacaatagattaagtaatcttaaatctttttctcagtgcacatgactcatgttttcacaacaaaaaagaacaaaaaaagaagcaaagtcagagaagtgggtttagatttttggaatcattgtatggtgtgccgtacttcagagcagaggtagttcttgccagcccaacggtcacttttccaacagacagaatgtgggccctgccatattttttatattttcttttttcatttctatatacttttagatgttctagtatttcatgattgtattgagaaaaggatgtctcaactacaagaaaattaatttcctcccatttgacaatctctgatgcatatatgccgttgcagggtaggtgtaggtatggatttggaaatgtgcttgtacaatagcatcaggacagggaaatggatgttggagacagattgttagggtttgtttttgtctatatgatggtggagtttgctgatccatccattatatctttttttaggccactctgtagggcatcttatgttatgcctgcatgatcagtgccacatactgcaaaagatttgtactttaattttctggtgtcattagcagataattaaaacttggtctgttgaagtggaggatgatgaaattcgaataatccatagttaatgtgcattgacaaaattttcagaagttattcataccaagggctcgtttggatcacttaaattttacaggattctcagaagatttagatcatgtttggcacaactccgttcctagatccgcgctagattttgacttttgtagttttacaatgatttaaaattctatattttatctaaaatcaggaagaagaaggtttatctaaatgttattaatgtaatcagtaatcccagatcttagatttctagaattagaagaaaaaacgtagcttaaaaagtttctatgagttcctctgaagtttctcaatcaaaggagacctaaaaccgtgtaatccttgatcttcttctacacacaatagtataatactccactacaaatcctacttgtgcagatatcacactttggacagaggactgaactgaattagacagtagttaaatttggcgacgcattgaaacgatactgtccgagttgttcagcaaatttatggctccagctagctctacatgccaattaagctcacctctagccattaatctcagtactcagcttctctgaaaacagagtgatcagctgtacattgcagtgcaaagaaaggaccctgcttgtttcatggccatgtggccgctgtgcttagctgcagcgactgcaggtacaagcaacctgaattccttgttggcccaagcacagctaaatctactgctcttcactgctactcgtacactcagagggtgtttagatccagaggtgtaaagttttgatgtgtcacatcgggtattatatagggtatcatatgaaatgttcgggcactaataaaaaactaattacagaatccgtcagtaaaccacgagacaaatttattaagcctaattaatccgttattagcaaaggtttactgtagcaccacattatcaaatcatggagcaattagacttaaaagattcgtctcgcaaattagtcacaatctgtgcaattaattattttttcaacttatatttaatacttcatatatatattcaaacgttcgatctgatagggtgaaaaattttgaggtgagatctaaatcagggccttaacacatgcatcttgtgcagggtagggattttttttagataaaggttgtgcagggtagggtttatgtgtactgttggttcagattgaatgctggtaagagagtcataattgattttcagagataacggttaggattatactgttagatatttcatccgtcccaaaataaatttatttttcatctatctcacacatatcaatacaaaaccataaatactaaaataccttcaatgtatcaaatcacaatgcggttatttctctttttatctactcctaatgtatttatcacctacttttacaaattctaatgctatgatagtttaaaataaacgtattttgaaacaaacagaaaaaaaaatgatattattatgagatggagggactagtcgattttgttggttaatgctagggctaggcaatgatccatgatgcgtacattgcattgatcatcctaccagttggaacagcaaggctatggacaatgattcacacttggctgtttgcataaaacggtcggaagaaaaaaggcagcaagacaagctctcctccatgtcccagttgcagtacaaggttttggtgtttgtcagtagtcaagggtcagacgcagggttcacgtctttgggtgtgtttagtttgggaaaagaaatttttttgtgtgtcacatcggatgtttgatcggatgttggaaggggttttcggaataccacaaaatttctaggactcgacgcgagactaaagtacattctaagagaaaaaaattaaatggttttcataagttcaaatttgaaacaataaatctaaccaaaacttgatcaaaatttgacgaaaatcgttaatgccgctgtttggagttgtttagccgccgcagtagtttttgttttcttagccgcattttttttgtttttttttcttttcctggcataggcttgtctggccgattaagttgtgtaacaaaaactctttttctttctaatatattgatgtgcaatctattttgcgtgttcacgaagaagaaaggtaaactctaatcagaccaaacaataagcacaactagataaattaactttaaaaggtgaaagaaaaaagaaaggctaagagcaactctaaaaatttatccatcttactctccaagataaaatttcataaacttgggaaaaaaacatccttcaacatacttatcatttaacttgccaagtcaaatggctggccaaatttctcacttggctagccaaatctagcgcgttgaaaccatttgtcaaacatggatcccaacacttgccaaaggggaggaaggaatgtgaggctaatgtatggttccctatcatagactcacgacagagaatgtagatggagagattgtcggagcacaaatgaaatattgagacgattttttttatcaacttataccaaatactcctacaaagatggaggcctgatttaagtaggctgttggagatgctctaaatcaaacaatacaagtcagcaatcaaacgcagttcaccattacacaccgcaatcaactactccatccgtcccaaaatataagagatttatgttagatgtggcacatcctagtacgatgaatctgaattggctcttagtccatatttgtagtactaagatgtggatgagcctgtttagattcgtggtcctgttcgagaacccaacagatgggagattaagttttggatttttatggcacgctttttaaactgttaaacggtacgtttcgtgcaaaaaaatttctatatgaaagttgttctaaaatatcaaattaatccattttttaagtttataataattaaaactcaattaatcacaagttattaccaccttattttacgtaaaacacttaatctttatctttattttcatcttcagttgattcaaacacagcttaaaaccactgaataacctagctctagctggtgctgctctcctgggccgattgccatacacacgccgcaaatgcgcagcacgtactactactacctgctcacaccgcgttgaccatgagctctgcgtgctcgagccctccatgcctctccatgtggcgcaatcgatgcgatacgaagccgcctgaaaaaaaaaaaaaaaaaagtggaacacggcgttttctctccatgatttctcgttgcctcttgcctatttcgccgatagatcgcacagacggatcatctcgatcgagtccgagtcgagtccaccccgtgatcatttacgcggcctcacgccctgcatttgccgccgctagtgcgatcgattccgacgcaaacgcagctggatggatgatgcatagggattcaagtggatcgaaccgtaaattcatttatagataaaattagtaggtaatttatagattaactaataagttatccactaatttagtctataagttagtttaaggtagtcctacttgtatcccagaaagccggacctccgatacggtaactcgtgggttatccacttatttgatcttttaagcgggttcatgggtcggttcacttatattgttaatgatgtgtcgggcacgggcgtgtcggcattatcaaaaaacgcagtcaactcaactcaattcaattccgtgtgtagttaagtgtgctcactgctcaccctgtcctaagttggattagtgtacaattagtgtatgcaactcttgagcctgaccttactctggagtctggaggaggactggagtaggatgcagagacactgtcccagcggttctgtcagggtcaggaccatccggatcatccagctttatctcatctccctgctggtaggattcgagcaaattaaatattcgatttctgaataactaacattttctgctacactttttgtataactaactcttttagttgatttttttcttataactgttgttctacataggctgaatttgttctacatgaagaaaaatatcaggattagtgtggttctatcagcttgatgtaaaagcttgctttatcttaagaaaaataagtatcaaaatggcttactgaatgcctgaatcttactgagggtttgtactttgtagtactagaacaacagatagatggtgatcctgaaagcatctttttgatttcatgaatagtggcagtgaaaattaaggcgattaacgcgtacattttgtttctctgtcaagactattattcatagattagttgtcctatcgctgcataatgatctctttcaggtaaagcaggtgcatgatacttttactaccccacacagttctttcacaaaagctgacagtgaaacacattaattggtcccctttcttttttatgcctcagaaggtgacatgttattgttgctttcatcgctgatcatctcacatagagatctagcattggttggttggtctgatatatactttgatagggtggtttctctcccttttccttcacatgcactttttttttctgaattttccctcttgttggaaagtgccatggatgtactttgtgataatatgatgcggcacctataacttaccagtaagatgttaaaatcaaggttagccaaagctaatctggtagcaagtgtgaagcatgaaccaccggccttggcctgcattgcaacagaaagaataaaatgaattggcagagcattttctttaaaaaatgtatatattctactttacacagaactgttaggctgttagctagcttgccttcaaggtaggaaaacactcatgctgtcatgcatcagaagcttgctgttggagccttgcatggttccaagcagaaagaaaaggagaggttggggatttctttgctgatatgctcatatgcagatgtacttgcgtgacctgaacttgtttattatcaatggttttcacttttcagctcatcctgtcagagaaacaatgcagaatgagatgggccagtaataactgtaataacttgccattggtgaaaacatctgttctactatattttcaatgcttccagttggaaaggtgcgtaggtagttgaactactgaagaagtctgatgagcagatttttttttcacaggctcaataggttagcatgtaaggccaagaaggttaaccaaaagaagatctgcagactgaagctaagtactgaataaagcaatgcttcataagctcaaattgatatagctttcaatgcaagtgaaactgtgtatgaatagaagtatagatagaaccactcacaagtcacaaccaagtcacaaactcacaatgtatagtgtacagttttcctctgaaagtgtacagtagtagtttgtggtgttaataaaggcagaggtgaggttgtgtatgagtctgagcttagaagacatgacaagagagaaagaaaagagcaggatttcttggatgccttggcacgtacagtgcttccaacaatgccaagatttttcttctcccatgttaagcattttgatccattaggacatggcttaaaatggcatgtgagatctcctcggactgaacgcaatatcaacctgatgaatcacctacccccgtttcagatagattattgatcgaatcattgctacagataagaataggttaaatattttgagaaataaacttaatagataatccctccgtattttaatgtatgacgccgttgacttttagatcaacatttgaccattcatcttatttaaattttttgtgtaaatataaaaatatttatgtcatgcttaaagaacatttgatgataaatcaaatcacaatacaataaataataattacataattttttttaataatacgaatggtcaaacgttggtcaaaaagtcaacagtgttatatattaaaatacggaggaagtagcttataataacaagtgataatgtgcagtggtagaaggtttctttgagaaaacatattttagagacacgtagcaaataatccgcagcaataatctggtaaccgactagctagcagaacaaacagcatacaattcacatgacatacctgaacattttttctttgtatgtgtatacagacatatctgaaactctgaactaccattcatgattcatccaatccacatcatccggtttgccttgttctgatctttgacataacaagcaaacgagtctctgaatcgaaatagaaccaaagactgaacaagacaatacatacagttgtgcacgctcgttgctatcgttgatccaagagatggcacgcggctggatccgacgacgggtggatcggacagaacgaccctgccgctgccgcattcatggccggttgccccggttaggtgccccgtcgccgtcgctggcgtctgccggccgtcaggcttcgtcggatgccgcgagcgggagggaagcgcgcgcgcgcgcgtgcagcggaaatcagagatccgggggaggacgaagaaacgaaggtttcctcgaactcgaagggttcgatcggagacgccgatggggtggtggtcttcttcatccggcgaactggcgggtcgccgtcgtcaccgccgccgttgtcgccggagggatcgaggaggagacagtaaggatggggccacctgtcagtgacgccgaactaccggagccttctttttttttttccttttttgcacgtctcgtttaccggaataccatttcggcccagtggcgtgtagaatttttttagcccatataagatcaccacggccaaggacagcgtcgcaagtggcccggtaacatcggatgggccagactgccatagtaatgtcggcccgctggtcagtgacaccgaacgggcatttaactttttatcacttttaagatgtgacaattaagaatttatcacccacactctatgatatgtaggtcctcgtgtgtctataacatatgggtctagtaacaaatcattaattgtcactttgtaaaagtggcaaatagttaaatatatcttgggagggggagggaagagggggaggagggagacgctgacaggtggtcccacgtggggctcatgttggcggctgttaagagccaaatttgtaccgccaatatctacataaaactcaaataatgaaacatctaacatagtgatatgattcatttctagcatattccacgagcgtccagaagttgggaggaattacagactaatgtgaaggagaattgaccttaagaaataccaacaccacactcatcacgtcagccaaaaccaaccactataatgctgatagactaaagttgacatggtattgtgag

SEQ ID NO: 44027 - DNA, 36826 bp, Oryza sativa
  unsure (1)..(36826): unsure at all n locations
ccctcgcttgccgctgctccgtcgccacgctcgcgctcctctactctgtccgcggcttgctcgcgctccactgctcggcccgccgccgcgctcgcgccttccgctgctccgttgccgcgctcgccctccgctgcgccgcccgcatccgtgctcgccgctccgctcgctgccttcgctccgccgccggacggccgcgccgcgtagcctcgcccacggcgatgacgacggcggcggccacggcgcgcggctgcttcgccatcagcctgaaggagaagagaagagagagaaaagaaaagaggagaaaaaagatgtgaagctgacatgtgttccccatgtgtttttttaatttttttttactgattaggatgccacgtcagtaaaaccggacaaaaaatactgccgagggacctctggtgaacggtttgagtgagtttaggggtacacatttctggttttgtggttaagggacctccaaaaatctcgctgttaagttgagggacctctggtgaacttattccttttttttaggatgggcccgttcggcctaacttgaggaattgggttggtgaggcccaattcggctggcccaccaatccctcgtcttcttctccacgcgacgccggtcaaagtttgacgctgcgacgaaccggagaaggattttcttccgatctcgcttccacctcgccgcctcgccggggaggaggagggtcgatggccgtggcggcgccggcgaaggcggcgcacgcgctggcggccgccgcggcggggatggtgctcctgtggtgcgtgcactttcgcggcggcctcgcgctcagctcccccaccaacaagggcctcatcttcaacgtaagaatcgctcgccccccaccttttcagctgatgggtcgtggatgttgccattgttgttggggagattctcctgtccttagctgtgctggatctttaactcaactgccgtgaacgattgcaacattgtggttagtactgttttactctaaactgcaggctagttgaccattctggttaatggcggcgtcatttgatttggttgcaagcctatagcactgtactgtgctagttcttgtgttatttgtctccaagaatgaacttgataatgctatgtgtacaagagagtagagacctgtattgtttggtgtttgcgctggtatttctactttgctgtgtatattgtgtagtccatgaagaaatgtaaatctccatttgaccacttgggcctgttctgaagatggattgctgggttaccgaaggtttagttttgtgtaaggatttgtgctgaaggtcatttttggaggttaaatccttattagaaattttaggataatgactgagtgactgacaaggcttatatttcggaggggataatatttgaagattgattgtaaaatggtctggtttacttttttaattgcgctctcagagtattacatatggcccatttgctaaaaaaattggttttctgatccctgttatgcaggttcatcctgtgcttatgctgatcgggttcatcattctaggaagtgaaggtcaggacaaaaaaaaactcattcttttttctcctttgatggttttgccatgatgagtattaaaacaatactcactatgctattatttttgcaaagttctcaccgatctattgcgatttgtttgcagccataatgggctacaaaatatggccatggggccatgacacaaataagatggtccatttgcttcttcatgctattgcacttttgctgggttcagttggaatatatgctgccttcaagtttcacaatgaaagtggaattgctaacctctacagcctgcactcctgggttggacttggaactatctgtttatatggtgtacaggtaatttgagcaaagcatttatcattctaatgttgtctgaattgagatttaaggtttggaactatgttagagctttttaaatttatttattgcatcggtagccatgcaagcatgattgccatagctatactactgaatgcctcaaaagagcttccactagattataatagcttggacaagttaactatctgaacccagattagctatttgcaacattccaaatgccactttaagtagtggttttgcctttgtgaagaaaagtgtaaaggaaaagtcatgtaatttgctatgttacatctgtctgtaaaggaaaagtgtctgtaggatattgttgaagcatcaaagcagagagaatcatgcttcattcgacatgatttaggccacaaaccaatagaggaatttaagaatatgtagcataaacctactatgataactcaagaaaatagatgccgatattcctgaattaatcttttccctcccttggcattaccgagtgacatcaaggtatcagctccttgttattaaatattgtgttaggtctcctgattgttgagaactttacaagatgatatcaactaatgaaacatatgtcaataatattttctttgaattcattgttctgaaacttgctcatagtccgtttgctattactcttttgtgtgaccctttccctatattcagaattacctgaaacctgattgtcctaaccccatgttgatattgcagtggatatttggcttcgtcaccttcttcttccccggcgcttcgccgtcgctccgacgcgccgcgctcccatggcacgtccgctcgggccttctcgtctacatattagcgttgctcgcggcggagctggggttcctggagaagctcaccttccttgaggccggagggctcggcagctacagctcggaggccctgcttgtgaacttcaccgccgtgctcgtcatactgctgggctcagccgtcgtgatgtatgttactgctccgatgcacaatgaacattctcatgggtattcagcagtgcgcaagccatgagccagatgagccattgatcgatccagcttcttcatcggctgtgtctgttgtataattgttttgctgaattattcccatagctgctgcctgctgcaaatgtggttcagatctatgggcatgtgatgtaactttgtaagtaactgacgatattaattacgagatgcgaaaattttgaactgtttgtttactgatgatataggagaggatgataataaagatgagattgagacaaagagatgaagcaaacagttctgtcattttcttttgtgtgtcgagttggtactggggaagcacaagaaacaaaaactaaaacctgaagctgtaatcttttccccagccaaggcaccctaataatggcttactactacctaattacaagcaaaaatctgctgccaataaaatccaatgcagtatgcacggaccattgccaatgttaattcttttaatctagacgcattttactgcgagggagggagggagaagaaaaatctctacgcggagaagtagctgaggatgacgtcatcctccctccccgacgccacggcgccgacgacatggccggggctccccttccccttctccgacccgtccgcccacgccgccgtccaccgcgtccgccggctatccccaccaccacctcccccacgcgccttgccgtcctccccgtcgccgccggccatccgcgccgccgccgccgcagccgccgcccgcttctctgcccgccgcttcgccacgtactcctccgagatgtacacgtccatcgacaaagcaaaatgccaggctaagcaagcaagctgtgaagccgtgtgctccctccaagagagcaggcaaaggttgtacacttgtacggcccggtgacgcgtgttgagcgtttgcaaggttggaggggagagcgaagcatgtggggggaggagtggggtgcggtgcgggtcgccggcggcatttatgggggaaggtgagggcggaggcggcgaagcggtgggcaccggccacagtttcgggggctggcgcccgcgaaaccacgtacgagcccgggcctttgtctcggattctgcgagccattcgctgccagtttctattgccgggatcctcctgagctttaaagctagaaagtgccatttccagtttatttttttaaaaaaaattatacgaccttcgttccattttaagtgcaaccataagtttttcggccaagtttgatcattcgtcttatttaaatttttttatataattagtatttttattattatgtgatgataaatataaataatacttcactcatgtttttaatttttttatttattttttatagataatatggacgattaaaattttacacagaaaatcatgcctgcatacggagggagtatatattaaattttgtttcttcgttgggactgcaccggctgccacctatgctgggggagagttacttttcgaatttgttaaacagttgataaaattcaaaaggaggatcgattagcttgataccatgagtatatgctacaacttgggagtggtatatttgttacttgtcttgcatcagttttcgcaatataaatctatttattattctaccactacatcgttcttttttttttactcatcgttttcacgtcgacgtagaatggtgcaaaatgtggctttaaaatgtataatgtataatgtggctttaaaatttacagtcaaatctcaatggttttattatcacgatcgacacaacatgactggtagaatggtatataagatggacagacggctaatcgcaatgactcgcggaataagattacatctagattagtcgatttaactttaggtattaagcctgtggcgcccttttacttttatctataggtccttaattaagatttggggtccttaattttcaaatcttttagccactttttaaatagtattaaatgtttgcccttattacatccctcattaattcttttccaattcagtttaaatgaaaggcaaccaagtcatttggattatttttagtattcttatgtgcacgtctaaaatgacttacaattgaaagaggggattatagattatattattaagagtagatgaaaaacagttgttgtattatctctagaggtttaaaatttattgcattaaaaaggagaaaaatgtgcatatttggatattatgatgggtctagattataaaagcttatgcagatttatcaatctatcaatctaatatatttttaagattgctaaaaagtaaaacatcaccttcgttgtagagacgtataagcaatgacggaggcttatctcctaaactcctactaaaatctatcaaaccttagtgaattttgaaaatacaaggtgtataagcaagttgagtcttactcttggagattttctgactccgcccctgcgtataagttactacattaattagagagaaaaaaatatatgctattagattgtgggggacgataaaattatgtgctttgtatcataagataagagttatatatgaaatccaatcctactttataatttactgtatgcaaaatatatttgtatgtataaaataagagctgagagttctatatatatatatatatcaaatcttgtttaactagaccgcacaaaaaaatcccctacttgcatttatgaaaaacaaagcaagggttatatacattaaattcaactctgcttataaatctggtttcacgtaaaattacatgagaaatatagtagttttaaggaaaaagtacgaattacccccccaactatcgcggtcgttcaaattacccccagaaccacaaaaccggatatttttcacccctaactatgcaaaccggacaaattacccccctcaacccaatccgcggtggttttggtctacgtgacgtacatgtgggaatcccgtcagcattttattgtggggcccacctgtcatatatatactccccctatctcatgtctctctccccccccccctctctcttgggccgtcgggctcagggcagtcggcgcacacggcgccgcgcgggggcgggtggtgggtggcggcggcaggtcgacgagctcggccggctccggtggcagttggcgcagacggcggcgctcgtggccggagctgggtcggcgcgccttgccacctgcctcttcgccacaatcccgtctcgccgccacctccggccatcatccgcgtctccgccacggccaccaaactagcttccagccaaccaagctagagagatcgaagcatggagaacgcggcttagaacctcgtaagcaacgttggtcagttgttgaccgaggaataccagcagctcagcggtgtcggcagcgaggtcgccgagctgcgcgacgacctggccaccatgaacgccctccaccgcgtgcagtccgaggccgacgacggcgccgtggaccacttcgtcctagagtggatgaagcagctccacgagctcacctacgactcggaggactgcatcgaccaataccgcttgtccagctacagcatatgaagaaaaaggccctctcgagccccctcctcctcctccgcatggcggtaacgtcacatacagctcgtagagaccacctacgtttgctgctccccggtctccttctccaggcgcaagagcgtcgtcatctttatggggaactgacaaaaggaaaggaattcgttagtgttagtatcagaccacgattgagaaaataaccaaatctcacaaaaaagaaatgcatgccgaacttaccaccacctgctcgccacgctcttcccgcaccgctgcctcgccggtgagattgccgccctccgcgtacgcgccgtcgccatcaacgagcgccacgcccgccacggtgtcaaccacgccgcgccgcgccgttcccagtccccgcctccttggtgatggtggtgtccacgtcgcccacgcagctgctccaccatgccaacaatggtggcgccgcgggaacagcctcctcctcctccgccgccgctgcctccctcttacgtctctcttgctcctcctccccgtcctcctcccgacgcgcgcctccatccgccgtcccccgtcctcctcccgacgcttccggccatggctcgcctctccgccatggccgcggcgcccgcctctcccccatcccctccacctccccgtgagtcgtgtgcgtgtcgaccgccagcccatccccgcgtcgctgcccatcgcccttccctgcaccgcgccatgcgtgccggccgccggcgtgcgcgccgctgccgctgaccgacgaagagagaaagagagatagaggaagagagaaagtagagtctaacacgactgccacgtgtacgccacgtagaccaaaactaccgcggattgggtcgaggggggtaattcgtccggtttacatagttgggggtgaagaatgtccggttttgaggttcagggggtaattcggacgaccacgataattcagggggtaattcgtactttttcctagttttaatagtagaagcagaaacaattggatttgtatcttttcctcactaatcctcagcatatagattgaattttgacttggcacatgtttatatctttccggcccacagtcagtcgtatggccttctcgtacaattacattaatcaagatttacttcatctgtccaagttgtttgacttaacagtgatacagacatacagtcttttgctagtactgctactgttctggagtcatatactcatatgtaggccgtgtttagttgcaaatttttttcttcaaaatttcaacgttttcattccatcaaaacttttctatacacaaatttttaacttttccgtcgtatcgttccaattttaaccaaaattccaattttgatgtgaactaaacacaaccgtaatctctctatatgagagtaaacttttcggaaactgttcatactgtcacagtggggtggggcctactgccagtactgtggacttctcgtgcagttacataattcaagctttgcttcatttgtcaagtaacactatggctgtgtttagattcaaagtttgggtccaaactttagtttttttccatcacatcaatatgtcatacacacacaactttttagtcacatcatttttaattttaaccaaaatttaaactttgcgctgaactaaacacagcctacgttttcactgaatacgacaataggcacaatcttgtactgctgctactgtactctaaaatcctatgtagagaaaattgacttttcactctctgtatcggagtaaacttttcagaaactgttcatagtcatactattctgaagttctctgtagagaaaatagattatgtacttttatgacagagtaaattaaacttttcagaaactgttcatagtacactataactatcatttgtactagatacgtctatcaacgcttgcttattagcttaccctgcacatccaaaattttaattttgtaaaactcaattttgaagttgattttagggtattttttttcatcgtagtatattttctagcatttgtttttaaactgctaatataacacacacattttttttacccttaaattatttttgtttgcttcgtcattttaaagaaccatttgacgaattttgtgaaggggaatttcagaaccataagaaaaaccatgggcttcttcagttacaacgcgcttggaggagcagctagcaacagcaccagcagaaaagccaaaaaaatcagtgtgaaatcctgcctaaaacccggtgtctaagcacctttgttaagctagctgtgccgcatgtgaccactgcttattcgccacgattaagcaacgaaaatggacgaaacgaatcgaatcaaggaaaagacccgagttgactgcctgattctggcacgtatcagcagtcatcagtacatcgagtcaaaatttcttctgttactcgcaatgatctcacatgcaattttattaagcacatgcagatactgatgatgcagctgatggttttgtgtcagcccaatgtctgagctttgctggtttaacagtttgggctcaagcagaaagcagatcatgatcaattagatcattaattatattctcacctgaatctgctttgggccatcctccccttgcaaaatgcagccagccatagattttctccacggtttgcacaggagaatggcgacacagcatcagagtattgcgagatctccaattgtctaatcagaattggtcatactgtcatcgaatcacttaagcaagcaagccactcccagctaacagttctagactgcctatagctaacaatgggctacctacctacgaatacatggccgttcttgacggctccaacttcatacaagtgcacaagaaaagtcagaaaagggtagagatttgtctccttcacacagacagaatcttcataaaagattaaagatcttagtactagactaattcactttattgacaaaatatttgttctggaaaggcagataatctgagacgtgcataaatattacttcctccgtttcaggttataagacattttgactttagtcaaagttaaactattttaaatttgattaaatttatagacaaatatagcaaatcaataattgaatatatttcataataaatttgttttgggtagaaaatgttactgttttttttctacaaatttggccaaagtcaaaacgtcttataacctagaacggagggagtagataagtttacactatatatagagtttacacgacatattttcccacttacatatgggttatctacctgtgaatacattgccgttcttgacagctgcaacttcgtactagtgctaaaaaagtcagaaaaggttagaagcttgtctcctccactcagaatcttcagaaaaagatactagtagactgattcactttattgacaaaatattggttctgaaaaaaaaaattatgtgacaggtgatcagagatcatggatgtatcagtatcaggagtcgcagtcattagtttcgtttttaagcctacaggaagaacatgtttaattcctgatcgtgtgtatgtgaattgtgaaacggtgacgtaattagccaaatagccaggcatgttttggatgatgaggatcgattttgtgaattgagtttggtcaggtactcttcctcctctctgtctactgcacaacaactccaatgaaattatcatgatgcaacagcaacccagattaacagaccaactagaaaactgaaaataacttgatacataatttgcagtgatgaaatcaagttgggttccattgcacactagcatcccgactgctcacctaacagaaggaaaaaaaaatcacatataaagagtttaagactgatgagccattgttgacatgccagacatgacagtaggaccaggcaatgagaaaccataacaaccgaactcactgtcaggctgtcaactcatatggaacaagagaataaccaaggatttaaccacataattaacttcagaaatgcatgtcgtttctgtctcaatttgttgattaaatgctgttggttattgctggtgttgaatgtggacaggttaatcatgtaaaaatcatgtataaggccatgtttagatttcaatttttttcttcaaacttctaacttttccgtcacatcgaactttcctagtacacataaactttcaacttttccgtcacatcatttcaatttctttaaacttccaattttaatgtggaactaaacacaacctaatataggttcataaaatgtgaggaattgaacctaactggatttaagcaagcgacgccttcgcccgtcgggtctgacgaaaccatcctcccagctcgaactcgctggccgatgtcgctctcgtggatgagcttctcggtgagaaaaaaggtgaaaccatttcgtgatctttaagttttcccgggaccttaactactcctagcttattaggcacaaaaggcacaaatcatctctcgcgttgcacaattatgctcgtaaattcaaacgggtgatgtcattcgatcaaatcctagataagatcgattaataaggaaggaaaaaaagagtatctttttctggtgatttgaagtgtaaaatcgtgtacggtgaaatcgattaattaggaaggaaaaaagattttttttgtgatgattttttgtgcaaaaatgggtacggtagcagggataaatgagaagaaaatgagaggtattggacagtcgacacatgtaatcctgaagatgaaggctgtaattgggttatgccagtagattgtttcagggattcaggccgtgtcacctgtgtgcattgtactggaagagaagtagctttcactgattcatcaaaatttaagtgcacacggcacggcacccatttgcttggtgacacaaaagcaggcgaaaagataggactaatgtggaaatttgcatttctcaagaaatactaggttatgagattgcaagattaaattcaatcttttttttacgaggtgtgaatgaaatggatacctaatcagaacaatcaaatcacacaatgaagatgaagtttccgttagcaagcttttcaagctaataaacgacgtgttttgtgcgaaaactttctatatgaaagttgcttcaaaatatcttaaatttataataattaaaactcaattaaacataccctaataactttcttgttttgcatgtccgtatttagtatgaatctttataagattcaaatgcagcctgtcaactaattcctcccatcactcaaaaacgaacacaggcctcccctatttcataagttttaaagtccaagaatctttagaaatctgcattttttttcagtggatatacgaacccctctgcacagccattggtatggtatcttgtttctctggccagaatctgcaccagcatacaacatacgaactaaatcttcataaaccaaaaaaacccatggatacagaaagcgatgcatggatagaattgtcagttggcacgccaaactgaccatagattcagctaaaaaaaacaacaaaggccagtcgaaaagaaaaagaatttccttgaatccttatcactgacaatccaatccgatttcacctggttgcttgcttctgctgccatgccatcttctcccaaccaacctgggctaatcagtcgccatccagccagctcctgttaaaaaacaaagaagaacaagaagtagaagcagttcgtgtgcttctctcatttgttccttgatatatttgctacgtcgtcagagaactcgtgcagatagcttctttggctgagttgttggagatggcggaggtggcgccgccggcgccggcgccggagccgaccaaggacatcgccgaggagagggccgccgtgccggcgccggaggagtcgaaggccatgaccgtcgtcgatggtaagtaaggtcaccatgaaaaccatgttttccattgacaaccttgcttattactagttttgttgctgtaataatccaccaagcagagaacatgtttttgttgctctgagctattccaggtgcaacttgtgaaatctcttgttaatttcttcagaaagaaacatgatgaacatatttcaccagagtgtataatatatgaagaaactaattagcaccaacatctctgcaactaccagttaatttgaatctgttaatatgaaccagatagcactatgaagtctgaatcttttcttcttgtttttgaatgctaccctctgaatgtttcatgtttacacaaggagatgtgacatatagtcaggaaaacttctaggacaaaattcatccaaaatatcaaaattgttcccttttttttttgccagatgctgagaaagctgcagcaacaggtggctcacacgaaagaggtaataatagtgattctccatcctctacaattgcctgagatcaagaagctgcacacagcctctcgaattctcgatctgatacacacacaaaccattcctctctcgtgttcatcagacgctctcctgacgacggtcgccacggagaagaggatatcgctgatcaaggcgtgggaggagaacgaaaaggccaaggccgacaacaagtcagtaatactaatagtagctcttctctcacttcttgccaaggctgagttattttcttcaactttgaaccgtgctcgcttttcattagcacgttttttaaactattaaataatgtgctttataaaaacattttatatagaaaataaattcaaactaggtcgaaagatataaaattcctgcattccaaatgagccctcggttaactgaaactttcgcgcacagggcggccaagaagttggccgacatcgcctcatgggagaactccaaggtggccgagatcgaggccgagattaagaagtaccaagtaagttcagctcagctaagttcatcaacaagcagaacaaggagagatcaattatgtgtgtgtgaatcattgagttgatcgatcggttcatatatatgcaggagtacctggagaggaagaaggcggagcaggtggagaagttgatgaacggcgtggcgaaggtgcacagggcggcggaggagaagcgagcggcgacggaggcgcggcgaggggaggaggtggtgaaggccgaggaggccgcagcaaagtaccgcgccaagggagagccgcccaagaagttgctcttcggttgaatctcttctcggtcatctccattgatcgtcgtcgtcgtcgtcgttgttgtaaatgtgtgtgcgacagtgtgagtgtaccggtgtcaagttcagatagctagtggttggatgtattttctcagttgtttgttttcgtttaatttcatgtacagggcagctattgcagtctcatgtgaaaaagggaacatttattatgtacagacatgatgttttggggtctttattcggattcggcggtgaaattgtaacatttttgtgcctgtggtacttggctagtactcatgtataagaggcttacccatttgacattattaaaatgttggtgctgttacgtattgtcgtgttttaatgagttattacttttaagtgaaatgattagctagagaggtccaatactagttgtgtttcacatgtttagctactactcctccatatttcaatgtatgacaccgttgactttttaaccaatgtttgaccattcgttttattcaaaatttttgtgcaaatataaaaatatttatgttatgcttaaaaacatttgatgataaatcaagtcacaataaaataaatgataattaaataaattttttaaataagacaaatggtcaaacgatagataaaaagtcaacagcgtcatacatcaaaatatagaggtagtattacggaacacacagacaagttatatgcacgcaaagacatcacaaacttgaggtgcttcttcttaagttacgaaataaagccctttcatattcgtttcctattggttttcaactcgtgttagggtgccaacatgaaaaagcgatcaaaattcaatatacgacctttaaatataactagataaatttaattataaaggtctagaaacaaactacttcctatacaatcagtacattttatcaactcactcaccatatattctctctgttttaaaatgtatcacaccgttaacttttcacataacgtttggctattcatcttatttaaaaatgtagcataaatatataaaagtataggttaagattatattttattttgagatgttcgagggtacttaacggtgtaggccccgtttagttccaaattttttttctcaaaaacatcacattgaatctttggacacatgcgtgaagcattaaatatagataaatgaaaaaactaattgcacagttagggggaaatcgcgagacgaatcttttgagcctaattagtccatgattagcctaagtgctacaataatccatatgtgctaacgacagattaattagactcaaaatattcgtctagtgcattccaggcgagttatgaaattattattttcactagcaaatatgcccgtgcgttgcaacgggtgaaaaaacgtaatgataatatacgtttttcatgcataaccatgtcgataacaatcagaaaattagaactacgaaactttattttctagcgcgttttcttttgtgcttttttctgacatttttccctcacgtgtttttttaaaccgtttttattttctcgcgcattttttccttttttaatatactgtagaaacttctctttttatagttagattagattagattagagataaagaagatatataaatggactaaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattctttcccctttttttttggatcggacagatttttttttgcccggtttatttcgcccgatcgattttttttaccgcgtcacatataattccttttactttggatttttttcgccctttttttaccgcgtcgacggagtcggattcgttttgattttttttctccctttactttggaattttttcgccctgttttcaccacgtcgacggagtcggattcgttttgatttttcccctttttggctttttttgataggacagatttgtttttttttcgccccgtttttttatcggacttttatcttttttttcgcctggtttttttattttttttaccgcgtcacatataattcctttttctttatcggaaagttttttttcgcctttttttaccgcgtcgatggagtcagattcttttcagctttttccttttcttttatcgtacaaatttttttttcgcccatttttttttctcctgtttttttcggatcagactatttttttcttttttcgcctggtcgatttttttaccacgatatatataattcctttttctttggaataggacagttttctttttatttttttaaactctttttaccgcgtcgatgtagtcggattcgtttcgatttttttcctttttttgctttcttttttgtcagacagatttgttttttttccacccggtttttttccgcccaggtttttttatcggacttttcttttttttttttgctccacgatacatataattcatttttctttggaataggacagttttctttttatttttttaaactctttttaccgcgtcgatgtagtcggattcgtttcggtattttttccttttttttttgtcggacatatttgttttttttccgcccggttttttttcgccaggtttttttatcggacttttctttttttttcgctcggtttttttctctcgttttttgacggacgacagaagcacctagagaagtgttttttttcttttctccaatccaatacagatcggatctcttccagggaaatcagattttttttctccagggaatcggactctttttttttcgctttttttattcattaaacggtttgtctctcggactttttttttccctttttaagggatcgggtgtttttttgccagggacgggtgtttttttcgcccggtttttttttttcactttttttttggatcggactttttttttcgtccggtttttttatcaaacaaacttggttttttctgcccggtttttttcacccggtttttttgacggacgatggaagcacctcttattttttaagtagtagtagatagtagagtagtagattcgtgtccgaaaaacccttctcacacaaaaatatccaatgtgacacccaaatttttttttcgggaacagtaagcgagtaacacgtgcgctcgtgcagggcgtgtaccagaaccaggaaggccaaagccaaacacaacccctcccattcaaaaatatcagcccctctctctcccgattccgacttcctcctgatccacctccaaagcccacgccacccgcaccgcaccacccaaagcggggggaaacccaaaccggcgaaaccctagatctctctccgctccgcctcgtcgctcccccaaaccctagatccccgccatgcaccaccccagggcgcgctacccgcccggctacacctccggcggcggcggcggaggcggaggcggaggaggaggcggccgtggtaatggcggcggcggatttggaggaggtggcggcggcggcggcgggaaccacggctactacggccggggtccgcagccgcagccgcagcagcagcactaccaccaccaggcgcagcagctgcatcagcatcagcagcagcagcagcacgcgcagaggaacagctcctcgcagcagcagcagtggctgcggcgggaccaggccacggcggcggctgcgtccggggaggtcgcggcgaggacggcggcgcagctggaagccgtcgactcgaggtatgtggattttttacgcggttttccggtaacgctgctttggtgcctgccagctgctagggtttgtgttttgttgttagaagaaagcagagcgtatactgcgtttgggagtgtaggatggcgagattgaggcgtacgagttgatcgcatggattggatgtaatttggggggtttggattgtgcgcatattattcagctattaacagtgttctgtttaagctatttatatggcaatagagggtttgtctctacttgtttgtaatattcatgtttcactagcttctgtgcttgcaggactcctgcttgcttgcccctgcattttttttcttttcagaacccagaaaacacgccatcttgccattttattgcattattaatttattcgggtgttttatatttccttgctgtggggtttgaaataggaaatgttgcatcgaagtcattcttgtggcatctttaataacttcattgatcattattttttttgggctctttcagctctgaagattggaaggcacaattgaatttgccagctccagatacacgttataggacagaggtgaaattctgctgtgtatttgtagtattgtttctactatacatcatcatttacttcgttggtttgagcaaatgttggatggaatatttgaatggtaaccatttgctagtgttatgtggtgctgatgctgtgttctgcaacatatgtttttatgcaggatgtcactgcaacgaaaggcaacgagtttgaggattactttttgaaacgtgaactactaatgggaatatatgagaaaggattcgaaaggccatcacctattcaggaagaaagcattccaatagctctgactggtagcgatattcttgcaagagctaaaaacggcactggcaagactgccgcattttgcattcccgcacttgaaaaaattgatccagagaaaaatgccatacaaggtgagctcttcactcttgtattcttatttataaggaaccataacattaatattttcttgattgctgctcccaacattttaaactgcactgttctttccggcattcatgttgatgcatctcaaattcagaaattcattaattatgggtagtatcttagttgtgtatgctagatccatatgaacttcaaaaattcagtgcactttttgtatactatacttagagggaattattggcatgcaaattgtctgacagtcttttgtacgagaacttatgattgtgtcttagcaaactatttgctctttagcattatctaccgtattgacagacaaaaattatgaacaatgcaacaggcattttcttagctgatcacttcttttgcctttttatggggtgctggtatttcagggtgtctattctcactgagctttctcttgagattcccttgtaaagctggctaccccagctattaatgtaagatttcaattggctatatgaaacttttaaaagggcaatgtttctgtggtgctagttttatacccaccttttatttaatttatcgtttcctactcttttggttccccagctattgccgttcccttcttttggtgaggaatcttttgtctttcatgtttacaaacaatacatactgtttatgactctgttggatctgtggattttatctgcagttgttatattggtaccaacacgggaactagctctgcagacctcacaagtttgtaaagagcttgggaagtatctgaatattcaagttatggttagtactggtggaaccagcttaaaggatgacattatgcgtttgtatcaacctgttcatttacttgttgggacacctggtcggatactagatctaactaggaagggcatctgtgtgctgaaggattgttcaatgctcgtaatggatgaggtatcatgagtagcactcaattagggtcatgcttttgttaatttatatatgtttcaatcacaactatgttataatttttcaatttttttatgatctgcaggcagacaaactgttagctccagagtttcagccttccatagagcaactcatccatttccttccagctaatcgtcaactattgatgttttcagcaacctttccagtaaccgttaaggatttcaaagagaaatacctacctaggccttatgttattaatctcatggatgaactaacactaaagggaattacacaatactatgctttcgtggaagaaagacagaaagttcactgtctgaatacacttttctcgaaggtacagctcaccagaaatcctattttttctgtcttgtccatctttaagcataaattgacataatttcccttctttgttttggtcagcttcaaataaaccagtccattatattctgtaactctgttaacagagttgagctactggctaagaaaatcaccgagcttggctattcatgcttctacattcatgcaaaaatgttgcaagaccatcgaaaccgagtgtttcatgattttcgcaatggtgcttgcagaaaccttgtgtgcacaggttctctaccttttgccttgaatattttctgctatttcagctagtgttctgtagcatatgctgtgttacaaaaatcttgttttacgttatcttctgatatccttatttgttgaataatgtattgtaccatcgttgtattttgacttctcaagcatgagatttgacctctgatttctgagtaaataattttcagaattctttggctagtttattagttacacgaaggcttttgctgcttttgcatgctcttacatcataaaataggctcagaagtagcttccggagcatggaatttactacacatgatacatgagctgccaaagcatgcccactgttctgtgctcataagactaggtaccccccaggctatgtctagactctagaatgctcgtagttcgaatgttccactaatagttaatgcactagaaaataacttgtttggcatgatgtctagagcattttttttcacttgaccttccatgtctacttttttttgtactactattgaaataatgtttggatctagatgtattgtaattgtttcaagccatgattcttgatgtgtgtggtaagtgtatctccttttgtgtgtgcacctatcaggttgacttcttttattacatataaacgattaattaatgtgacatgtctttgcagatctgtttacaagaggaattgacatccaagctgtgaatgttgtcattaattttgacttccctaagacttctgaaacatacttgcatagggtaagttgtttcctcccgttccaaaagaaaatattttcctataatctgtaatcatgtaaagctatcaatatatatatgggttgaatgcttgatcgttctaagctgaatgcttgaatgccaattctcattcagatttgctatacttatgggttttgcttgttcacaaataagaacttcaacacaaaaatcaaatctagggttgcatcttgcatgagtgatggtgatttaccattgtgcagtttgcttttgttactgtaagttggatcttcatgtacacttgtaggcaaggtatttagtatcgagatactaggtaggatcgttttttatttgtagtaccataggatcaggatactatcagattttagaaaatacatatttttatataaaatatgtaatatgttgtataaattaaagtatataatattgattttgataaatctaattggttttcatataaacttgagatatttattcacattattgatatccaccttttttaaaataatattttgtaggattgtagggatcattgaatcgggatactacataagatttcgtaggatcgtgtggaaatgaatagtaagatcgagatactatgaaatttaggatatttggtgggatcggtatcgtttcgacttggtaggatcgtagtatcataaggtggatatgaatcgggatattgacaaccttgcttgtaggtaatataacatttggaacatgtgtttgattatgtttacctgcatgatcttgattaacattaatattttattaatttggctcaatggttggttcactgtgccctttcattttgctgctttgtgtggtctgaactaataaacctggtggttttttatattttgttacttctaaaagctctgtattattttttccttaggttggtcgttcagggagatttggacaccttggtttggcggtgaacttaatcacttatgaggaccgtttcaacttgtaaggatgctttgccagagtagatcctgttgtttactcttgtaccaagattctgacctgttcatcttcctttataggtatcggattgagcaagaacttgggacagaaataaaaacgatacccccacaaatcgatctggcagtgtattgtcaatgatcaatgtaacattgtaacggtgtttttatcatttacttattgttaggcaagtacatcagatgtacatagcacctcatcaggtaagcagtgaatttcttagctgccactctttcaaacaacatgacatattgtttcaggtaataattgaagttcttttgtatacccagggttttatttggtgccttgatgacacatctaagcttatattccattagtgaggaagtgttttctgtcggcactgatactaatcatgttaactgtggacttgcatttttggctgcttgaagacgctgcttgaagacccagggctgcggccaaactgaacctttttcttgctccttgtatctgctcaatatttgctttatattcatttgctagcgacagttttggttgtgttatattaggatactgctgcttgagtctgttaccgtcactgtggttccttaattttcctttcctttttcccttttcttctcatgtttggattggactagtagaagtatttccctcactgtattcctcgtgtcaatttctattatccttggtgtagactgttaactttctttaatttaccctcgtttcgtaatatgtatccttgctatttgtgatgttttacacctacttctgtttgacccattacaagcttattacaagctgcaatatataatctgttacatagacattaactttgcctacttaccgaaaattcgagatatcacatgttccttttttcctagaactgagataaacgaaatattttgtgtttctattgtgatacatgtagacagggtttctcttacagcgggggtaagcggtagtgcttggtggattttgagcaaattaaaaaattccaaaaaaatggaaaaaaaatcatggatgtattaacgatagatggtgaagaagtttgttgaaagtgcaagtgtaatagaggatcaaatttgtgggcaaaaccgataatagtttagggtatggggaatggaaaaaagaacatagtgttgggggccttcctttgtattacggtactcttgaattatcatgctatgaagtccataatatagaaaaggtaagcttatgctgaatttttgtattttatatccacaagttaggtttgcaagtatcctatatatttttctaattatccccaacttctacacgcatttaagtgtttttccatttttttagcatttttttcattttcttttcacattttctgccatacatgtcaaggttatcatgctaatgtcgcggttaccgcggtaaaccgtgcacttaccacgaccaaactgtgaaaccgcacaaattttgaattcaaatttttgaagatggaattcacacggttaccgcggtaaccgccttaccgcgggaggtgataacccatcccaaacaataagttaaaccctgtatatagatcgaattcagtattgcatattcgagatatcaagtgatatatgtttttgtttacaaagaatttcatgatcatatgaatagatataaaatagatataatgtctctccatttgacttaaaaattgacttttccccgtatatcccgccattacagtatgtatatctgaataccattttggttagtgatgttaagtcctactagtccactaccagcatgagagctgatcagtcctctacacttgatccttcaatgatgacactttgatgaacataacaaccattcatataaatggcatttttgagggagtataacgaaagggaaaacaattttatgattggcccactgacttatgggttccatcctgagtcagccgccacattggttaaaaccgtcatcaatactgccatgggacctaatgtgaccctgttttgtaagatttggtatatatcatatctggtattctggttcatggatgattttgaaactcgacgacaagatgagggatctcaagtgaacttcttcctatcgataattgttgagcaactacttagcattgtgcgccacttcgtgcgttgtcgctttgtgttggtagagggcaacttctaggggtgaaaatgggcacgaaaattcccgattgactgtttccaatttttacctgacgagcaatgtggaaatggttttgtcgctttgtgttggtagagggcaacttctaggggtgaaaatgggcacgaaaattcccgattgactgtttccaatttttacctgacgagcaatgtggaaatggttactgacgaaaacaaaaatggaaatgatttttgctgcatacctaccactttcaactttttaattaccatatttctaaatacactaagtaatatttatagtctatttctttatttgaccagtagtttagatacccatcaacttctcaaccaaaatccctaacttgggatgaggttaaaaagagacaatttataatttatatagcataaccttgaatttattttatcgtattatataattatgcaaagttaaacgtatgatttattgtcagcttcctcgataccgacatgttttcgttcgtacagtctatttacgatatctcctgttttttttgtttccgacttcatcttttaagttttattttcgaaaaaaagatatgattatgaaaaaaaaactaatatacggaatcccattggaggcacaagggcactagataaaagaggggtaaacattacatatcttctatatacgtttctcctagatttgtttcccccaccgatccatttttctcccccaccgagtaacaacgcttcgtcttcctcctccctctcctcaactccttgaccattgtctccaacatcgacgacatcacctatcctcttttcccccttcctacactggatttagagcatgtgagagaatggagattggcgagggcatgggggttatagccaaagagggagccagctatgactgtgaggttgggggttgtcatgtgtgagcagaaggaaaggaaggtagtgaggctaagggggacgacatcctgggcatcaacaggaaggtggaggtggctggtctcgaagtagatggcgaccttggagttgatgaagtggatacttcaacaagatggtcttcgggtttcttcatgctccttgtcagcccatcacttctactactcgatgttgtgtacaagtacatcacagtcgatactttaggtaccaggagtcgattccaggacctgataccttgggtgtcatgcctggtacccaggtaccagacaagtactagggtatggtacctcaagtactacccataggtatgaggtgcatagtattatgtattaggtattgggtctgatacctatggtatcaggtatcggatcaaggcgtgagcaagaagagcacgctgtcatcgtctggctgaccggcaagtcacctatcgttgtctcatcttctcttctcccttcctctcattgacatctccctccttcctctgttgttgctgtgaccggtgggggcaaagagctaggggtatcgctgctttgtttttttacaacataggagtctgtaagtccgaacatggagaattttaaaagtgaaagattagatttataaagttatcctgttggatcagaatcccgtgctctagtaatcctctttttatgaaaatctccgaccgttttcattccatatacaaaccgcggccaccgttcaaacaatcaaaccagcccaacaaaacaaaattgaataggaccacacgcagtcactcacgctcgccgccagcacacacctccgtgaagccggcgccacggtgaggcactgacgccgtgggcccacgagtctcccgggcccacgcgtcatcctctccatcccctcgtcgtcgtccgctcgcctctgcccccgtgccgaccttaactgccgccgttgtcttctcctccacccaaaagctcgcgaatcaatccacgcttcagagagagagagagagagagagaggcaggtggcgccgccgctgtcccgctcgtctccggtggccggcaggcggccgcagatctcgtctgtccaggatccagtgtgtgcggccgcgggccgccattgtttgggaggaggaggaggatgggtagtagcacaagcgccttcgtcatcaggtggatcaacttcttcaccatggtcagtcgccttccactcctcgcttgctgctcagttgccttcggctcgctgcccctcctccgcttgctgtgttgagcttgagccgcctcacggtttctttcctctctgggctggcggctgatttgctgaaaatgagttcatattgctgccgcggcatttgtaggattcgttgtttggttgggttcctcggctgtttctgtttgtgaagcttagctttcctgcaccgaattcagcctgtttgattcaatgcaacacatggattttgagttttcggttctcctaaatgccaaattacaatattcttttattgcattttttgccttcacatttgctctgagtttcttgtcttcctaatttcttcttctttcatttagtggctactctcaattaatcaatttcacttcttttggatactagtagcactcagtttccagtttaatgttggcacatatccaggctccacaaaatactccacgaccatacggaaagaaacattgcatctttcagcatcaatgcattttatgacactcttaaattctcttcttggttggcagatactggcactactggtggtggggttcgggttctggatgagcacccacaacgacgaatgcaggcggtccttgacgatccctgtcatgggtcttggaggagtaattttcctcatgtaagaatccaagtgtgtccccatgatgttaatctgatgaaccatggtgatttgcgccgtcttaacccggctcagtgttgatgttgcagatcgctcgtggggtttcttggtgcttggaagaaaattgcttgcttgctatggacagtatccttttatttctgaagaaattgatgcatatgatttttttattttatttttcttgtacttttggagttagctgttaccttgacatgtgggtgtctagtatctggtaatgctgttcgtggttttggtggcaatcatggtgttcacagtgcttgcgtaagttcagtttgttaacacatttgatgcagaaggcctttttcagtccaacctggttacaatcatggagtacctttttatttaaaatttgctggtttgtacatcaattaggtgatagaattgaattctaccgcaccatttagggattaattatcaatggacttggtagcttcttctagtggttgcatttttataaccttatattggcatgcactctttgtctgaaaaaagatactggcatgtactgttgcaggtttattatcacaaataccggaactggccattctgtctctggggtgaggtatgtgacagttagtagtacttgcacaaagaattccaatcctaaattaactaacacttgcaatatctgaagaacacaaagaatcttacatgctgttttgtttaatcattctttgcaagcacacttaatggtgtcaaaaacagttttgctgcagcatgcttatgtcaccacacaagtcgtaaatcgtttctcatgtttatgcagatacaaagagtatcgtctgcaggattatagctcttggtttatcaaacaggcatgtcctatttttgtctcaggaaaattcagttgttcattttcctatcatgcagtagtacgttttatattctaaatattttgttcattttctcatactcagctgaatgacactgaaaaatggactcacctgagaagctgtcttgtgaaatcagatgattgtaatggcttgtcaagaagatacaaggtcccccctcttcctcacatattcttactagttactactgatgtgctcactataaagtcgaaagtttctccatttccatcaatttctgccatgtcaatcttacctgtactcttctactccctgcagactctgaaacaatacaagcttgcagatcttactcctatggagtctggttgctgccgtccaccggcagagtacgcattttaaacatctcacagtatattgcaaacttgcaactgttcatcatcaggattttgccataattatcaaatttctctgaacattgtcaggtgcgggtacccagctgtaaacgcttcctactttgatttgagctatcatccagtcagcacgaatgtcgactgcaaactgtacaaaaacgcacgctctgttctgtgctatgattgtgattcttgcaagtaagctccctggttgccaattcccagcttggaattttggaaacatcaaagccattttaagaaaccaatgcttatatgaattgtttgattctagagctggggttgctcaatacatgaaaacagagtggagggtggtagccatctttaacgtcatactgtttgtcatcttggtaagccacagcatcaaatacaacacatataatgtctcattttttcaccatataaatggtagattttccaatccatcttgtgttatttttgacattaattttttctcaaccttttcttttctcttggcttttgtttgcgactagtctttcgtctacttcgtcgcgtgctgtgcgcgccgaaacaccggagagagcgactccaaggttcctacaagatggcatgcatgattggcagatgaagcatcgtagagttagcttttgctattgcttgtagtggcattgttcagtcaagtctcgttggtgaaatggaatgcaagggcttttcctttctggtgtgggatgatgatgttctttgttgcagttggcttgtgaacattttaggaataagttcattttaggtcccttaactttacaccgaatccgattttcatccttcaacccaaaaaccagatacaatcggtccctgagctatcaaaaccggtgcaaacgaggtcccttggcggtttagaaggcggttttggctgacgtagcgccaacgtggctggtttgatttggtcttcgtcccacgtggcatttgacgtggccgttatgtggcaattctatcccagaaaaataataaaaacagtggccccacatgtcagctaaacacaaaaaaaataataatggtggggccctgggccccacctgtcagcttcgcctgccttctttcctctcccctctcttcaccagccgcacgccgtcgcggaggcgctccacctccggcgccggcgactccctcagtctggacacgtcggcgaccgccaccaagaacgcctcccaccacagcacgtcggcgaacagcggcgtgtacctgtcggcgaccagcactgtcacgcacaggcgacatgtcgtcgccgtcagcccgtcacgcaacttcgcggtcctggattgcgaacaggacgaggaagtgcttcgggaggtggagcgcaaccggaaccacgagcggcggtgggctgcccaggggctggcggggcggcgctgggcgctaaagatgatggagaggaggccgctcacgaggacgacagcccgcgtcattattcttgatactggccaattaattcttgattctttgtagatgcgatgattttagcttgagcaaaagcggtagagcttgaatgcttgatactgtactggttactcaacttcatcgcaagccatctcggtcgctgccgtcttgcttggcaccgctcgccgccaccctggtagcagtagcagcaaacaatatgcgagattcttcagggaaataccaagttctggcgctgataggcggcgccatggccgtaacggcagcagtggttgcgtccgtgatgacaagctacaggggtcgagcatggggatctcgatcttgtccgcctcctcctccttgcttgtgttgctctgcgcatcggccgagtcgccgctggagcctggagcagttggtcgtcgcggtggaggatgacgatggcgagggggacgggacgagcacgtcggtccaggtcatcttcttcttgctcttgcccccacccttcttctgctccggcgacacccgcttcttgaggtgcgtgctccacctcgccgttggcgtcctctcggcctcatcccgtcgccatctcccaggagctcgccgccactctccactgctccacccgccgcccctctctccgccagtcacccctcggcatcgcggtgccgtggccccttgcccctgctccggccaccgccgcttagctccactggcctgctccggccaccgcccgtccagctccgccccgcctgtcgcctccaccccgctcaaccagtcaaccttgctctgcccaggtgggagagagggaatcagctcctctgacttcagccctcacgacggcagagagcagtcgaggtcatccagccgtccacgttcgatcgaaccgtccgcccaaaaagcgcacggccgcgtcatgagtctgggccaaggccggcccaacaagccccgtccccgtttggccgccgccatcgcccagccgtgctcgtactcctcgtctggccgccgccatcgccgtcattcttgtcccccgcgccgccctcgctctcgccgtcgtgctcgtcctcctcgccgccctcgctctcaccgtcgggctgcggtactcagctgaggagatggggaccggaaggtgtgcacgatgcagcgcttggtcgcggccacggcgcaccggtgccacgagctcgatgtgcgcgtgccgagctcgagcaggccatgcgccgcgacaggcagcgcgcggcgaatggaggaggggagcgagtggaggaacatagcggcctcctcggcagtcagggagaggaggaactcctcctcgccgtctctcagcagcgagcgagtggaggaacacagcggcctcctcttcagctccttaatgctgcgtccaggagtgttgctttgttgtatgtcaaaccgaatggcattctggagatactgaatgtgcagttattagaatgatagattgttctttacacaggcagcagaccacttgttctgaaaaatggggttgcatgtgttctgtaatttgtatagaaagcaaaaaaactctgtaaattgtttgtagtgagaatggcttgtccaacaaaatgatgaaatggccatttgtaacttatcactgcaatgaaattatgttccaattctgggcatatggcctgttcaagagaaccaacagtttttgtcccccaaaatgcttgctatctgctgtccagtaccaagtgtatatgacatactaaactgtacacactaaccacaggcgtgtgcattcagttaataaaaaagactgaaggtgttcattgatccggcatagcgtcgtcctttcagaagagccttgccatcagaatcctcttccaagtgctcaacaccaatcatgtcatcccctgcgttcagcacctgttggcagtggtgaatgggggcatctgcacatgttcagtaacaaacaagggaggtacaaccaatggatgcataaatgctcaccttgcccaaaagatcaagctgttcatcaagcgtgccaaaagaacaatctcggcaggtgccgcagcccgcagagaccaaaagcctattcaccaaaaccaaactccattgctagaattcaacatcaagatcatcgacggttgctccctgaaaaattaaagaaaatttaaactctgtcgatgttaatactaattgatcatagcttcgaaatattaccgtcaatagttgagagaaggtgttgatggccatgtatggttcagacatttcttccatgggcaaagaggtactaggatatatattttgccctgctggattgtcatgtactgatgcttcttttccctttttcttgcctcccgtctttgcagtcttttgttccttcaaataaaagaaataaaactgagcatgttcccattgaacagtgaaagagaaacaaatatactttgaatactgaacatgttcacatacctttgaaccttttttctttctcttacctcccttgttacttccattctttgtggacttgtgcagcttatcaagccaattttttttgcgctttgaggtttttgtttccacctcctttttctttaggcgagctgtactcaccaagtcacttggaggagtaatatcagtgggacctagagctatggtatcagtaaatccattgatttcttcttcaacttgcttgctaaggatatcaagtgcgttgtttactaacaaggtagaccctggatggctggcagctcgaagtgccaaattgagaaatttgcgggtcatatctttgtagcgaagcatctcatttaatcttgggttctctataatacttcgtccatggttatcttgtactgtcccactatgtgctccacgtgtccatcgcttcagtacatattgtgatgggagagattttatattcatcaaatcaaggacttttaaagcatgtgcacacaatattccagttctactgaacatcccacagccgcatgtactagtttgctctaaaggatcaccaacaactttgtactccttctcaaaggtacaattttcatctagactgccaattgccacaagatagcaattgttgccttccaatgccgtggtgcatgctaccataggtacaattttcatctagactgccaattgccacaagatagcaattgttgccttccaatgccgtggtgcatgctaccatggatctttcatattcagcttgaaaagcttcgaatatgattggtgtgtatagcttgctagcttggattagcataggtgtcctcatttttattctgggtattttcttccttgattcaaattcagcatttagctcattttctcttttatcttccaccaccctttcaaaatgctgaagaaatcgaatgatatcaaaatcagatttgaaatgcctcttgagttcactatttacactctcacttaactgtgtacttctcatacctaatgtgaacacatccttcatgtaacattcagcccatttttctttcaccttgtatatactatccaaccaactttgcttgctcgcctttgccctatggtgcaaatgcttgttcaaatgtttcctcatcttcgtactcaaacatacatgcactaaaatctgcgagaatacttcgttcttcctcgttatcttcggcagtctgtttgggagaattactggattcttcatcctcgagttcagctacatgtttaacagcattctgcatgatatggaaagtgcacaaaccatgccatgattctaaaaacactttcttaattgcttttcccattgcagaatcctgatcagtatagattgttttaggttgcttgccattatgtgcttttaggaaggtctcaaataaccacttgaaggactcatatgtctcatcatacagtagaacagcaccaaaaaccattgtttccctaaactgattgaacccaacaaatacaccaaaaggcctactttccttgtttgttccaaaagtagtgtcaaaactgacaacatcaccaaaatatgcatagtcagtgagcattttagcatcaacccagaatatgtttgctatttgctcctcactatccatctgcaatgcatattgaaatgacgggttctcagcaattttatcttgaaaatgcatgagcatgcttcctgcttgaccatataccatctctcgttggcgtttgccccgtaaataattcttgtggtcacggagagtgcaattgagattaagtgagccaccaacttggatactagccaactgatgtgctgctttgggcccaatgcccgcatcgtcagctgtctcaatttcaaaaccttgtaactctgaaattttcctttgagacaccatcaagtgcgaggtttctggcaattgaaggatgtgattgtgttccaaaactagatcagccactttataattccctttctcctgatctagcacaacacccatgcgaacttgacaatcggttctcgtttcagctcttggacactttgttagatgatcccttttatcctcctttctatgaccctcatttgcacaaacatatctgcatgacctaacctttccatctgatttccttttgtttgagtacctttttctaacctcgaaacctttttgaccaccatagctaacccaaaacatccaagcctcatcaacagtattgaattccatgccaacttcaggtaacaaactaggtagcacacccactctacaggaacaaaaaaaaaatgatttggtggtcatcgaacaagtaaaatctacccgatcatggtgaaaaaagtaacaaccatagctttacagacctgttttcttccatctcaaatatgcagattttgctggaggcttctttgatgaattattccaacactgtctaatggaggaggtggaagacaatcaaataatttgctgaaaaaaaggaagagaagaggccagattacttcacctgtgcttgatcaacggtggaatccgtgctgaaaaaaaaaggaagagaagggttcagatgatcgcctggcgctgtggcctcgtttggcgccaaaaaggcgagcacggccgccaaaacgcatctgttcgcggtaaaaaggaataggagcgagacagacggcgctggaggacgaggcttgttgggccggccttggcccagactcacgacgcggccgtgcgctttttgggcggacggttcgatcaaacgtggacggctggatgacctcgactgctctctgctgtcgtgagggctgaagtcagaggagctgattccggagagagaagatagagagaagagggatgacatgtggggtcaaatgggtcccaccattcattattattttgcgtgtagctgatatgtgggccccatgatttttatttttttagattgaattgccacgtaagcgccacgccacgtggaatgaatacctagtcaacggagccacataggcgccacgtcagccaaaaccaagtacaatactgccgagggaccttctttacacggttttataagtatgtgttgtacccggttttgtactaaagggatgaatttcggactcagcgacaaattaagggacctagaatgaacttaatataacattttatgataaagaatgccatctcacttcagcaactgcaacctgtgggtttttatgctcattttgcaaatgcgctgctgggttaaacaatggcaatgcagggatagagtgatagatcaatatccaaaaaaaatatattagtagaatgtagtaaagcacgagatgtaaatttatgtagctcaactaatcttgaaattgagcaacgtttgatgacggaagctgtcaaaacagaacaaaaaaatggcgtggcgtgataacatagccatagacgtgggcatcggtatctgctgaattaccctccagtagcgcagctaaatgaaaatagcaacaaaaaaaataagtctgaacaaatatgtgactgatagttgttcaggtgctacatctggttcatgcaacgtcagatttttcacttcatcgagcttcacttatcgttcacgagggggctgtaaatagggtaccacatcttccgagccacaaagtcgactgtgtccgcctgtgcacacatgtaaaatgacacatttcagacgccaaactggcaaaaaattcaacttcagggatttgaaattatgtatgatgcagtacctcagtcatgctcttgaggtccctagcgtctacatcacaacgcccctcggccagatcttcatcaacagcggcacggacgactgcggcgccgacacgtgcggtgatgtgcctgatactgcatttttcatggtggtatgttgattagcaaaagtggaatggttggattatggtatcatgctgcctatcagtctgcaatggcgcaggttggatggaagagctaaccttgagattgatggaaagaggatgccttttcgaatttcatcgtctgtgatgtatgacgcaaggctgcgtcagaaatcactagattagatgcatagctcaagccgagtttagttccaaactttttcttcaaacttctaacttttccatcacatcgttctaatttcaaccaaacttccaattttggcgtgaacacacaccctcaatttaccaggaaaaaaaacaaatcatacaaaccatccaagatacattaattatagaaattgtgcaatttaaggtggagaaaacactactttgtcaaaaagtacggctgaagcgtgtaagctttttacgtcacactgtctaatatgctggacatcagtaattgtacttgttagtgcagttgagatcttaagaaatagagctacaagacaacaagcgaaaatatgatccgatcaaacaacagaataaaacttaccactcagctgctgattggagcatgccatctgtaatatgccgagcacctgaaagaagggctcctaaaccgatactgaattatacagaaacgtccatcagaataacatataaaaaaggaaaaaaaaacaagcatttcaaggtaagctataacagttgtcatacccaggaaacagatacatattgtttgcttgattagcgtacccttgtctaccattgcctgggacaaccacattataaaataagtggtcttatgcaaaagtgctagcaaaatgaaatgatatagagaatgttaaatagggcatacctaaagtgacattactgaaagggcttccactggcaaatactgcattgtctccaacatatttgaatacatcttcaggagtacattcggctgtaataagaaaaatataaatatcaggcatttatgtttgggtatcctagaagtaaatattaatgggtgaggtgaggaacctttagtagttgggttggacattgcaaaaattgcaggacgaggggaatcggattctttcatagccttgagaacctgcagaggtacaaagataaagttaagactccaatgttgaaatttataagagagaacatatgagtataccctaacagatgaaatccactaggatcatgatttagcacttcgcaacaagccggcttaatattattacatttgcaaaggagagaacttttgaaacctaacaacacaaatacatatttgatgctcttgtaaccatggtttactcacaaatcataatgaagcaaactaaaacagtatagaaatggcccattaatgtaaacctcacaaaatcctttataaggttggagaaaatattctaactcaatgtgctaccaatcactagcatnnnnnnnnnnnnnnnnnnnnnnnnnnnnnnnnnnnn

SEQ ID NO: 44028 - DNA, 1085 bp, Oryza sativa
tagcaaaatgaaatgatatagagaatgttaaatagggcatacctaaagtgacattactgaaagggcttccactggcaaatactgcattgtctccaacatatttgaatacatcttcaggagtacattcggctgtaataagaaaaatataaatatcaggcatttatgtttgggtatcctagaagtaaatattaatgggtgaggtgaggaacctttagtagttgggttggacattgcaaaaattgcaggacgaggggaatcggattctttcatagccttgagaacctgcagaggtacaaagataaagttaagactccaatgttgaaatttataagagagaacatatgagtataccctaacagatgaaatccactaggatcatgatttagcacttcgcaacaagccggcttaatattattacatttgcaaaggagagaacttttgaaacctaacaacacaaatacatatttgatgctcttgtaaccatggtttactcacaaatcataatgaagcaaactaaaacagtatagaaatggcccattaatgtaaacctcacaaaatcctttataaggttggagaaaatattctaactcaatgtgctaccaatcactagcatcagatttgaaagggtgtactggctattgctatattgaacatataaatattactggtactgtgaaatacatctagaagttgcggggaactaatatgggagccactttttttagatggattatttactgcactgaaaagtccctagtctgactagtcatatttataagtgaggaccattcttcaacttttttttggggtagaattatgaaatcaacatgttaggaattgttgattcttacctcctcattaaatatgcccccaactccagaaagtcctaaaagcacatgaggcttcactttcctgacctgatgatcagtataaagccgtattagttcaagcacaagcacagaagcactggaaaatcttctgttacaataaaatattttagctccagcagttgaggggaaaaaaacaatcccagaattatttttataccacttcaacaagagctagccccctcatggagatattgc

SEQ ID NO: 44029 - DNA, 817 bp, Oryza sativa
tgcgttgcgtgagcgtcacagctgcagcggctgcggtcgtctgcagctgcggggacctgccgacggcaacggttgctctgcgtgaaggggatcgatgttgggtgttgggttcttggatccatcgatttgtcagtggcttattgtacttgcttgagacctaagcctcccctcctctcctctttggagttactgcctccatcttgtactagcatcatccatttgtctagtaaaaagtttgtttctgaagtaaattatactgctcccaatacgcatttaattgaagtattctatctgttcaataaaaaaacaaatctagtatgagatataacatatactaatattacgaatcttaacaaaccttgtatccaaaatttatagttgtcacatcccgtactactagaaaatctatcttatttcagcacactactaatttatcctattactactagaagtggtgtttttttttgttgacggagtgagtagcatgaaatatcttctcgcaaattactaatgtgtgctaagagcaggtacaatagtagactataagccagctataaagaaagagagagaagagcagtgagctacatatctgtagccagctgcagcacggacttcaagacgtaatgtgtgtatggcaggtgggaccaggtattaatagtatagtaagcaactattgtatgaattggctattacgttgggtatagatgatttggagctagcagtgggttatactattaaacttgttctaagtgtggtcgatgttgatgtcaaatcgcaatggtgtgatcttgctgtcattgggtgagattaggggagg

SEQ ID NO: 44030 - DNA, 1047 bp, Oryza sativa
tgccgcggcacaggaggagcgtgagcgactagggtgcatcgtcagccggcacttcgagccacctatgcacggccattgcgacgcctgccgatgccgccgaacgaccgcgccgtgtagcctcgcccacggcgacgacgacggtggagagccgacgacgacgtcggccacggcgcgcggctgctccacccgtagcctccgctccgccgccgggctcgcccatcgtccgctccgcccacagcccgccaccgttctgctgccgcgctcggccatcgcggctgcacccgccgccagcctgaaggagaagagagaggagagaagagaaaagagaagagaaggagaagaaaagagaagaaaaaaaaaatatgtgtagctggcatgtgggccccacgtacctttttattttttttgctgactaggatgccacgtcagcaaaaccgggcaaaaaataccgccgagggacctccggtgaacggtttgattaagtttaggggtagacatttctggctttatggttaagggaactcaaaaaatctcgctgttaagttgagggacctccggtgaacttattccaaaataaaaaggctgaataagttcactttaggtccctctatttgatggtgaatccgaaattcgtccccttaccgaaacaccagaaatatcccatccctcaactcacaataccatgtcaactttagtctctcagcattatagtggctggttttggctgacgtgatgagtgtgctgttggtatttcttaacgtcaattctccttcacattagtctgtaattcctcccaacttctggacgctcgtggaatatgctagaaatgaatcatatcactatgttagatgtttcattatttgagttttatgtagatattggcggtacaaatttggctcttaacagccgccaacatgagccccacgtgggaccacctgtcagcgtctccctcctccccctcttccctccccctcccaagatatatttctctatttgccacttttacaaagtgacaattaatgatttgttactagacccatatgttat

SEQ ID NO: 44031 - DNA, 718 bp, Oryza sativa
tatagggcgaattcgagctcggtaccctccctttgtaatatgtggtttccattatataatcccataccaactggattagagctattacctattaaggggtctgaaccagtataatccctatttcttgtttgcttgatgtcgtattacatagatcttcgtaccagcgtaccccaataccctctatatccgatctacgagtatccatcgtcgacaatgtgtataaactttatatacgatgtgtacaaactttatatacgaagtgtgcaaactatgtatatgtacgtattaaaaaaccaaaaaaaacatcatatgtatacatatacgtatacaagtatacatactttatatatgtacgcgttaatcgccttaattttcactgccactattcatgaaatcaaaaagatgctttcaggatcaccatctatctgttgttctagtactacaaagtacaaaccctcagtaagattcaggcattcagtaagccattttgatacttatttttcttaagataaagcaagcttttacatcaagctgatagaaccacactaatcctgatatttttcttcatgtagaacaaattcagcctatgtagaacaacagttataagaaaaaaatcaactaaaagagttagttatacaaaaagagtagcagaaaatgttagttattcagaaatcgaatatctaatttgctcgaatcctaccagcagggagatgagata

SEQ ID NO: 44032 - DNA, 765 bp, Oryza sativa
tgcaccccaagcccagcctaaaaccattttgagggttttgaatagagggggaggtgtgaatccaattccacaataatccaaccattccatagtgtccaggtgatatgaatattcccaaagtctagagttgtaaaaccacctaatgttgcctaattaaccagcgaagcatctacctaaaatcatactagtggtaccatgagtagagtgtccactagttggggttttgtttattctagggtgaacaaggtaataataacaatagcaatactaataaggtcataacaaaggtaaataggcatggctaaataaaacattgataacgcgggaatttaaataaagcgataatgtaaaaatttaaatcaaaataattttgtaaactgggattcaatatgttccaggatgatgtgacttgtcttgctcgctttcccaaacgtcggcttcaacctccacgaagagcggatcttccgaagctgcggcgtctacacaaccaacggaaaagaaaaggcttttactctaataaactccatataacaagcaggaacaaagcacaaaattgggttcttgacttcttaaggaaaaattagagacttgaacggtccaattccgaattcaaatggccaagttatggccatttgaagtttatatgctctttaaatgaatatttgcaaatttcttcatttaaattttaattttaaaaagggtttattgcgccagccgagggggaggggcgcgcggaccgggtccacgggagtagggcccacgcgg

SEQ ID NO: 44033 - DNA, 1093 bp, Oryza sativa
ggttaggtgagcgccactgtgctcacctaacccatacgcggagcaaaaaacccacgaggggtcggggtgcctcggccctcggggccgaggggggtgcggcccgaccccctcggggggactaagaggagggcgaacgcatcaccctcgggcccgacgtccctcggggccacgtgtgcgattgtgtctgcctcaaacctctagtcatgatactcctgatcccatgtcaccgacagaccccatgtccgatagtcgatttatttgtgttgcaataacatctatttctttgttgattttattgggggtggattagagttctccctatgctgattttatttggatggatttgagtccgatttgactaattgaagttccccctcttccagtggcgtgttcgagttggcagtttggaatttggagatgaccaagatacgagctcgatcaggaggtgattcggtggaatacatgcaacgaaccaagatggacgataggatatgcgcgctacagcaatgaattaggcaaacgtcggacaaaaacgtattgtgacgatcgtagaattatgaatttttaaaaaattttaagtaggttagattagagtagatttacatcttttaaagagcctttatcctggtaagagtaggactcgcatttaatgcagctacattttttcatccattttagctggattccatgtcgacacggtctatgcccaacttatgactgattctgggcctaaaacaggtgtataataccgccccgtaattttttccatttgggctgaaaatgtgcgtttggatgggctgtgatcggattacaatccgtcggaaaaggcccattactaccagggaaaaaaactgcccaggagtctcgccttgccctctcgccgtccgtgccgccgccgccgccgcctgcatctccccttcctaatctgtgacgacggccggagacaccgtacgttctggctggctgcagaggagagatcagaggagagggatatggtccaaggcgacaacagcaacaacatcaattgccactggggacatatcctctcgtctctcgaccaatgcaaggcatggaagcagttatggccagggga

SEQ ID NO: 44034 - DNA, 11729 bp, Oryza sativa
ttcacaggtggtcatcccaacctgttactagtccagacaagattaaatatgcctcatcgcattttggagttctttgggatccaatgcttcacacagttaagaatctatatcctgcaaaacacttgtttttagcaaattgaagtagataagaacaatttctttgacaaccagatcagcggacggagaaaaaccatacaagaatgttatgtttaaatgtttccaaaaaaactaatcccagcaccattccaacaaaaaagcaatatcatgttgtatgcacatatgagaaatgccaacctcatcagagtgactttgcatatgctgcttcagatgagctggcttctggaaagaagcaccacactcttggcaggtgtggtcaccttcatgaacaaccttttccccatttgacttgtagatttccgatttgtccagttcttcctatagataaatttgaagtgagggcatcagatattcatataatgattcaaatggataagagcagaaggaattgacaaaagcacaaatatattgattgatggacctaaactccaatcagagaaccataacggtcaaataactcaatttaattaatacagtccacattgtctttaaaacataaggcataatatggcccatattcctaaaatatctaagtagttttataccttatgatgagcaaccatgtgagctcggatgagacattttttggacctaacaaccgtgcaaaattcacacttgtagcgccttatatccctgtgttgtgttgcttcaaccctcatgtctccatcaatatcatctccagagcacatctaatagtaggcaaatcagatagttagaaattcggcacacataaataagtcatttatatataaaaaaaagtaaacaagtaaaacattcagaggtagcgatgtagtcagcaagatagctgtaaaatgaggagaagtccataacatgaactgggacgcattgcagtctttactctttttttgacagagtgaccaaacaaaatacaggtatagcatatctgcaggtcgacatctaaaataaatctctacaattctgcattttcaatgaaataacatcagtgtgttacaactggctatcactaattggttaatcaaacaaatcaaaacaaaactatggtgccttgtcactaacaaaaagaaaaaaatatcagcatatcatcctcagttcggttagaggtcatcaaaggaaagaaaaaaaaaggacaatatgtgtttctagagcatgtgttctccatcagttaacactaatggagatggtatgggatccatcttgagatgcctagccatgatttccaaggtgacataaatttcccttctagcatcatgtgtcttgtcctctaccaaaaattcatggacgacaccatcaacttcaatccaactgcaacccggttttttgtatattttcctactcaacatctgcttcctcatatccaaagcttctttccatctgtttgataaggcatacatgttccaaagaagcacataaaccccatcatccccaggttctctctttataatttccattccagcaatctcagctaatctatcattgccatgagctaggcatgcactaagaagtgacctccaaataacaatatcaggctcgacatccatatgatctatcagagcttctgcttcttctagaagtccaccccgtcctaacagatcaaccatgcatccatagtgctcaagccggggatcaatatggtagacttcacgcattttatcaaataactctctgccttcttgtattaacccagcatggctgcatgctgacaaaactgagacgaatgtcacactgtttggaagtatcccagaccttagcatatcccaaaagagctcaacagctttcctcccattaccctggacagtgaaacttgaaatcatagttgtccatgtgaatgcgtccttcatctgaacttcttcaaatacagaaaatgcactagcaatgcttccactctttgcatacatatccatcagagcatttgtaacaattatattggtggtggcattagatttgcttccatatccatgaatggcacgtccaagatccaaagcaccaatatcagcacaagctgatagcacccctacaattgtaatatggttaggacggtggccctccaaaagcatcttaccaaatagctcaagagcttggataggctgcttgtcttgaacatgaccagtgatcagtgctgtccaagaaacagtgctcttcataggcatctgataaaagaatgacaaagctgaatccacaccaacacacttcatgtaaccatacagcatgctaccccaagtgacctcatcttttacaagcattctatcaaatacagtccgtgcaggctcaaacttgccacatcgacaatacatatcaaccaaagcattacaaacgaccaactcagagtccaatccacaccgaaaaatcaggccatgcaccacgctaccaatacgctgatcccctaatccaccagaggccgagagggcaccgacagcagcaaagccatcagggcggtggccagaagcaatggcgtgagagaacacggatatagctttccagtggtgatctaacttgagatgaagggacatgaggctggtgaaggagataatgtcagggtgggggatttcatcaaacaacctgcctgcgtcagccggtcggccaaactcggcataggaccggaagattttgcaggagatggactgctggttggggtggaggccgtgtgtgagggcctgggcgtggattctttggagctctcttatggttttgcactgggtgagaaggtggtggcaaacgcttctattcatcccccctctcctcaacgcaagaagctctcccgaacagcacaacctggaattagagctaaaattactaggaaaaaaagctacaattaactcatacgacatccacactgcttagactattaacaatttcgtgctgtttcaacgaacactgaccacaagcccagaatctaaacgcacagatcaggatcgatttggttaatactatctcatgcttttaactgctcaaatcgaaagcgaagaattaccaacgcgataaccaaatcgaagaaacatattcctaactcctaagtaggcatcggttttgggcatggtggttgtgtttgcaagcgaggattggatgcccaccttggaatctttgatgcgtttggactggaggagatcttggctgcgacgaggtgtgatttcccgcgcttctccgtgaggaggatggagcggcggcggcggcggcggggagtgaggactggggctcttggttcctcctcgccttcataagcggtcgcgccgaaaccctagagcctgggtgggtgggctttttcgcaggccgaaaatgggccgagcaatttttaagttgggcctgtactgatgggctgacattgctggcccactcgtgacgctcttctcctctggctcgatgacaggtggcccccacacgcggacacgcctcctccttgttgctttccgccggcgatgccattctcgccggagttcgcacgacggcgaggcggcggcgtgcgcacaggcagcggtgaggaaacctctatctccctatctatctatcgccgccgtgcgtttcggctcctgtttgttactgccattgttgatgtttacagtagcttggtggatctagctctagtagttagggatggaaagcaacaagggacactcaaaatgcagccttaaaatttcctctccggcgttgggtagtgttgggatccagcagtggcatggctatggtgcagtagaccttggtgatttgtgttgtacttgtcatagcttcctgtaggactagggttatcatggttgaatctgtagagaacccagaaatttacagggttgatagatgcaacctaccacctggggtgtgatgtggattgtagaaacttccaattacctcgccatttccaccagttatatcaagaacccaagtatcacggtgcctgtcaagttagacaatcttggtatattagaacatagtggttcagatatgtgatgccagcaccattggcattgtaaaaggctatgaagagggccaacacatcagcgatgatgatttacttattctttacctggttatgcatagtgactgctgttatttccttatgtgcggaaccatgattctgagccaccggggttctataatactgttgtctttgttggttcttctttttttttaagctatgtattttaagctccaaaagtttggagttagggccatgagttcttgtttcagtgagctctcttcatttgaactaaaataaatgtttaactcacttttatttcagacgataaactctatattttgcactaattcaagagttggggggcttggagctatgtaacaaaacttaattctttcaaccacacaagcaagttttcaaattgtcaaagttatttgcgaacttaaaaaaagcttgacatctagtagttgattagaataacggtagcctaatgcatacatagacccactacatagctatataattagctaattggttaactgaccaaatatatatgttaagctgtggtattggtggtggactgactacgccaaagcccctagcaactactgggaaacgggcttactatttctgataccaattgaattatgtaattaattttcaaataaatgaactatgctcgtaagttgctgcagttcaacacgctggggctagtaagctttggctgctagggtcactgcatatagaatactggtgaacacactaggtcggctggagggcatcgaggtcatctgaccccggtgatactactgtagatctgcccctcttgtactcgtagtgaaacaagctatttgtgttcatctattcaccacttgatgcttgcataggcaactatacatgtttggaactttgatgatggtgctctgctagcagatgaaaggcctcttgaacacattgaattgttgtagcctcggtgttcatatcttgaggaagaagaggctcagcatggcttgctgggatgttcaacgatgccgccatctcagacatgaatacgggattcatattaatgatgactggtagcgccttgccaccaccaactgcacggtgatcttctccgtctatgatggaattggttccccttcaaatgcatgctctgtcaatgaactctctatcagatcactcgctgactccaagctttttcccctttgcagttgtgcccttatcatctctcttgtagatcaccctggtaacgtgttcaagaaattgatctttagtctgaaattggacaagaatgatgaggtttgtagggatgaagaagctacatgtttggtgtgtgcgctattggtcaagaatcagaaccagtcacttttgtaacaggtaatttatggacattgcaaggtggatggtagagttttttcagtttcactctatttcttctttactactatttttagttccacaacactcatttccttttctttgcgtgagctcattgctctttatttggttcatggtactattaataaacatctgcatgtgcatgttatagattaaacactgaaaaaataaaacattgacaaaattaagaccagacaaataaactatatttggaaagaattggctggtaactgactgcctagctctctataaaaggcctccccaagtcccttcttccattgctgccagcattttgattctgtgtgtgtgtcttggttgcaaaaaccaagacatacacacagaatcaaataataacaaaggtttcctagcctcaaaggatacatatatatagtttccctacaatacaatggagcctgtcaatgatttccaggaaggcatttcaacagagcatgcctttgaggcagagcctgtgccatcattgtcggaaacaataacgccacgatcaatggtggtgagcttcatccttagtgtaactctcagcatcgtcgccatgaaggtcaccttgagctctggcttcattccgtcgttcagcatcccagccggcctcctcggtttttgtgtatcccgtgcgtcgatccgcattcttgactacttcgcagtggcacaactaccattcacacgccaagagaacaccatcatccagacctgtgtcgtcgcatgcacctcgatcacattcaccggtatatagacaatctgaaaatagtagttgatagaattgtgtgcactattttatgtttatctttactataaccgtacttccttacataggtggctttgggacatatattcttgcaatgggaaagaaagcagctgtaggggatgtcaatgcccaaaataacgttgaggagccaagctttgccaggatgatcaccttcctcttccttatcagctttgctggcatgttcatcatcatgcccttcaggaaggtcatgatcattaggcaccggttgacattccccagcggcacagcaacggcgcacctcatcaatagcttccatacacctcaaggtgtcaagcaagcaaggtatcatcaattaaactttacatggaaatgtttctgttggatcaagtactattcgaagccttagattacacaatcaaattgactatttgtgtttgcaggaagcaagtgacattattgtttaaatcgtttggaggaaccatcgcatggtcgctcttccagtggttcttcgcctctgggccgggctgtggcttcaaattcttccccacatttggcctcgaggcatataaacacgggtacgcaatcagacatgcatggatggaattcatcagctagcgtagtggttgattgggaaactaattttgttcccttttatcagattcttcttcgatttcaccatggccaatgtcggcattggcatgatgtgcccgtacatgatcgtgttctccgttttcattggcaccatcatctcgtgcggtgtaatttggccgtacatcgagtcaaaggagggcatctggtacccaagcaaccttgggcccaacagccttaacggcatcagaggttacaaggtgttcatcggcttgtccatgataatggctgactgcctcttcgtcttcctctgcatcatggtccggacaacatgtgccatgatcaagcggcgtcggcaggcaatgcaaggtggtggcggtaatgcgcagccattccagggtatcgacatcgccgatcagccggtgaagagcttcgatgatcgccgcagggcgcaggtgttcctccgggacgagataccggactcggtcaccattggctgctatgtcctcctgtcgatcatctccatcgccgccatccctcacctctacccacagatgaggtacagccatgttgcgctcatctacctcgccgcgcccgtcttcgccttctgcaacgcctacggcttcggcgtcaccgacatgaacctggctagcacctattgcaagatcgccatgttcgcgttcggctcgtgggtcggcatcaagagcggcggcgtggtcgccgccctggtcgccggcgggatcaccatgtcgatcctgggcaacgcggccgacgtcgcgcaggacctcaagacgggctacctgacgctgacgtcgccgcgcgccgtgttcatcagcgaggcgatcggcacggcgctgggatgcgtcgtcaaccccaccgtgttctgggtgttctacagggtgtacaagatgggcagcggcgacatgggcgacatgccctacgccaagctctaccgcggcttcgccatgctcagcgtcggcgacggcgagcaaggcctgcccaggcacagcatgctcctcttcaaggtcttcttcgtgctcgccctggcgctcagcgtgttccgggaggtggcgagccggaaggagtggcgcatccggcgctacatcccgagcaccatcggcatggccatcaccttcttcatgccgccgcgcgtgcccgtcggcatgtgcatcggcagcctggtggcgtacctgtgggagaagatggacgccggccgcgggcggatgctctcgccggcgctggcgtcggggctcatctgcggcgacggcgtcggctcgatcttgctgtccatgctgacactcatgggtgccagggcgcccatctgcatcaagttcttgtctcgaggtgacaatgtcaagttggacgccttcttggcaacactccatgacatgagatagctactagctagctatccatgtagggaaactagatcattttctcaggtgtcaaaacttttgtacatatgtatccacgtcataggggcttgagttaggagtcgtggcaaactgtataatcaagtttcagttcagtctataaacacagtttgatctcctctatcaacagttgcctcactgagtccatggttcaatatgagaatgcgtgcactgattttggcagaacccagaagtttgctttgataaactggagtccacatagattactagtactgtaactgttaaataaacctgataaaatgttaatttctagctacagtacaggaacattgcagagagtttcacaactgaccagtcagtcagacagacaacgaatatgcaagcacgcatgctacccatcttttttacatggacagacatcaaacgccttatttatacatttaattgtatcaagaaacaaatgaatgaatttaagggcatgtttagatcaatttgctgtggcagaattttttggcaaaagtttttgtggcaaaaattttggtattgaagttttgctagttggtgtttagatgcatgtgtcattttactagtaaagagagagagcacggctcccaacgcactatttagcaaaatttgctactctagactcccaaatgacaaatgccaaattaccaacttttgctaccagtatttagatccattttgaccaaaagtgcttctaaaacagaaaacttttgctattttggaggatctaaacagggcctaagaatcaaaggagggaaaacacttttaatcacttgagtggttgttcactcattcattgcatgtcaattcattagttataaaaaacttcaaaaatattgaaaaaatagattattagtatgattttttttctaatcaaactttattaagtttgaccaagtttatagaaaaaattagtagacatctaaaatattaaattagttttattaaatctaacattgaatatattttaacaatatatttgttttgtgttgaaaatagtactatattttttatatataacttgatcaaactcaaagaagtttgactagaaaaaaaatgacttataatgtaaaacggagagagtatgtaacatatcactccacaaattcaaattcgactatttatattgtaaaaaaaattaaaattgactttgaatatgctatttacatattaatctatcttgtcattcttttaaaaagattataacaatttatttgacatgcaataaacgagtgaagtcagtgtcccacttccatttgccattgcagttggtctcacaattgatcatgaatatgcaaagcacgcatgctatcaatcttttacatggacatatatccatccaaggccttaatttgtacatgtgaagtataacaaatgaatttaagaaccaatcagtaaagagagagagagagagtacatatgtatgctacaccagctgcttctcttctacacttacattacaaggctaatatatataaaccaatcgacaattaattaattaagtataatcactaaagaactaattaatcaacctacacgtacgcgtggcaagatcgatggaaggctagcttgagcttgaagtggatggatggatcatggcggcgtgggcagcgtcctgaggaagagctggaccttgtcgttggtggcggtggagaagacgcgcatgcacatgggcgggttgacgttggcgagcgagaggatggaggagggcagcgaccagatgccgtcgccgcagatgaggccggaggcgacggcgggggcgaaggtgtgggcgcggacggggtcgctgcgggaccagaggaagaggacgaggctgccgacgcacatgtcgatggtgaagaaggagccgaggaagaaagggacggccatgccgagggcgctggggatgaagtcctggatccaccacccgcgctgcttggccacctccttgagggcgcagatggcgatggcgaggaggaagaaggcgaggcagaagcggaggcagtagcgggggagctggtcccacccgttcacgcccaggagggcgatcccccggtagatcttggcgtacggcgccgggaacccttcctccatcccgatgttgttcgccttgtagaacatccagaacaccatcgggcttattatgcatcccatccccgtccccagcacctaatcatcatcacacaccttaaacttaaaacaagtattggttggtgcatgcaacttaatgtacaggatacgataaaattcgttcgttgcaacgcatgatagtacttacataaaacttattatgatacaacttaaaattgattagtacatgcagcacaatatattgtacatgatacaataaagttcgtatttgacaatgcatgatacacacttacatgaaaattatttgctacagctaggtgcaattacacctaaatgtgtacacatgcggtttaaatgtttatataaaaaggtcatagaatttgacaagatatattatgatagtataagacaccacaaaaacatacatgtcttgattcggtctacacataaaaaacaaaaataacaaaatttacctgcattgtataagtactattcattatctgatttcgttagttgtaaattaaatttagtcttgcatgtttatttatacacttacattattgcacttgatattactattcttttaagaaaatctatagtaattttaagtcgcaaacaaataacgggtgccatataggagtagaattaaaattttgtccggtagtacttacctggctgacgaacatggagcggggtgaggtgagcgtgaggtatccggtcttgaagtcctggacgaggtcggaggcggtggagacgatgcccatcatgaggccgcaggcggcgaggcccgcgacgacgccgccgtccttggcgccgatgttcgcgccgaagatgaagatggcgagcttgccgtagctgctggagagggaccaatcggtgaggcccgtgccgtaggcgttgcagaaggcgaagagcggcgccaccacgtacgcccacaccacgtgcttgggccgcagctgccggaagatgtgcgggatggcgaccaccgagatggcggcgaggagcacgtacgccgccgcggcgatcgtcgtcgggatctggtccttgaggaacacctgcgtccgcctccggtcgtcgaagctgagcacctgccgctccgtccccgtggcgccggcgaacggcgtctcctgcggctgcttgctggcgccgccgcggcgcttcaggtagaggtcgtaggcggtgcggagcacgatggagaagaagttgaagagcccgtctccgacgatcatggcgatggagatgaacacctggtacccgttcagcccatggaggctgctcttgggtaaccccgcgtcgtaccagctccccttcttgctctcgatgtacggccacatgatcccccacgacaccacggagccgatgagcagcgagaagttgataatgtaggggcagatcatgccgacgccgacgtaggtcgccgagaaatcgaagtagaatcggcggctgtacgccaccatcccgaacgtcgggaacgagctgaacccgcacccggggccggcggcgtagaaccact

SEQ ID NO: 44035 - DNA, 5556 bp, Oryza sativa
tagctgataatcatgatcttgcggagcggcacgatggagaagaggccgacgaagctgacgaggaagaggaaggcgatgaggcggcccagcgacggctcctcgacgttgatgctggtcttggcctccgcctcgtcgaagccctcggcgatcttcttgctcatgccgaggatgtaggtgccgaatccgccggagaaggcgatgctggagcaggagatgacgcaggtctggacgacggtgttctcctgccgggtgaacggcttggggaacacgccgcaccgctcgagcgcgctggtccacgtcttcatgaggaagaaggcgaggagccccgcggagacgttgagggaggggacgatgcccgaggtgaggttgagcttcatgacgatgaagctgaggaacgtgcccagcaccgcgctcaccaccagcgacctcaccgtgatctgctccgaccacgccggcagcgccttcccctcgaacgccttctccgtcgacaccgatatcacctcccgcgtcacctccgcctccccttccccagccgccgccgccatcatcttgattgattgattggttggttggttgattgattgagtcctcgacgacgatggcggcggcggcggcggcgagggctagcttcttccctgggtcgatctctgtccggccccggagacccggagatgggggagatgacgcaaacttgtgtgattagtggctgtgagtaattaaagtgtctacttttttgaaaaaattgttaattactcaactatactagagtaatgccaaaaaatgattgattaaaatggccatcagtagtaatgatgttttgttattctgttgtttcttcttctttcattcattttttccttttttaaaaaaaataacttggaattttttcttgcggtcatgatgtggggtgagtagtggacggttgtcatgcaacatgcaatctcgtgccatttgcagacggctaatttgggccagctaattttggcagtgtgatactttggaattagagttactctgattttcaatcaagtactagagttaaaaaaatagaataaaatatttaatatcaattggtgtcgtggtatagtaggttattacgtcagtctaaggtctcttttcttcaacttcaaacttcaacttcttgttttccgttaacacgttttttaaaactgttaaattttttgtgctacggcgattgaaagaatgtcaaccaaagtagaggaaagatcaagatggacgtttctaaatcggtcgataaaattagtaataagaagtctttaaaaagtgcgcattcatcatagaaaacgaggatgtaatagggttgctgatgaacttactcaacttgctaaacggaccgcatattgcgcggtttggcgtgaccatgcttcgtcttgtgtgatgcaggctctgaagtaagattgtaatattattacataatcaataaagcactcatttccctcaaaaaaattgtttgtgttttggcaaaagaaatctatatataaattgtttaaaaaattcaagtaaatctatttttcaagtttataattattaatatttaattaattacgtgctaatgaactttctcattttacgtagctaaaaacctcactccaagttgagagaaagaacgcagcctaatgcacttaaggtctcctgttcgagtctgggtaacaccatttttactgatgttcttttattttgtttttctttgccaaatcttaaattagcaaagtccactaaatttagtttgcatttcttttcatttttttaacagccaaacattttttcctattttttcttgtagcgaagtccactaaatttaatctacatttttttcttttattttttaacagccaaatccactagattttaatatgcttcgtcatggaccacgaaattaaattagtaaagtccactaaatttaatttgtattttttttctttttttttaacagccaaatatgctccatcatggaccactaaatttaatgttcagtcctatgtacagtaccatccattgttttcgttttttaaggctctaatccattgctttctttcttgttcactctgaacgagactggccaaagaaatcaattgagcagtggctagtggtgtactggtggtcattgtcatttgtttttcaccttaacaaaagatgaactacaaaaagcttttctacaaatccacatgtatcactgctctctcgtcccataaaaaactaatttaaaataagaaatgacatttttcagttaataaatctagatacgaacatattcagatgaaatacttgtaaataaaaaggaaaaaaaaggaaggaatttgaaaggaatcatattgcggtgatagaggagagacaaaagtgcacagctaagctgttttagtttagtagtgcagcagttgcagatctcccctcatctccagcttctcctcgtcgccggagctcgagatggccggcggtgacctgcgccagcgccgggcggtggcggcggctgacggggagggggacggcaagatggggtcagggggagaggaggcggaggtgaaggggaaggggcaggggaggaaggaggcgctggggtggctggagtgggggcgggggtggatgggaatcgtgggggagttcctcttccagcgcatcgccgccagcaacctctccaacccgctcgagcttcccccgctcgacggcgtctccttcgtcgtcaccggcgccaccagcggcatcggcctcgagatcgccaggtccaatctcttatcccttctacttcttctacttctactgctgctcttgccttgcccttagagatgatgggtggttcaattcgggcatgcgaagattctctggatggatgccatcaactcaagatttatcgatagcctttttggtttctgaattccaaataattcgtagtgttctcgacaatatagtgtgtgtaatgtgggcacccactggtacgaggtttagctcttcttttcttctcctgactttaaatgtcatgtcagtttatccaagcctcgctggttggtttgtagtaggcagatacggtagagttagtgaagttcttatttttactatttgatgaatcgttttgggatggcaatactatggtgaaaatagatttatatgtgctaacctgaaatttttggggcttttaactatttgccacttttagatttggcaagtaactatttgccacccctatatcaatgacatgtgggtcctggcaaaaagttaattgccacatctaaatgtggcaaatggttaaatatctcgaaatttttcgaaacaaaataataggggtactctcatacatgttacagtaatgaattggtccttgactgcacttcatcttgttacttcacaagtaaaactgtcaaaaatattcatctggcttcatcaatttggggagcatctttgataggtttccaatcaagaaacatgaaatctatcaagctaatttgccagatatcactttttattcagcgatatttcttattgggaagctgagtcatattattggttcctatataattgtatatgtgaattttgtaaagacttttgtttggttcaatagatttggtgttacatcttctaatgtagaaaagtattacaaatttgaaaatgcctaatcttcttataaatttcacatctctggaactaatacaagtgtatatttgcccttgtgctctggaacaaaatactaggggtactcatacatgttactgaattggtccttgactgcagttcatcttgttacttcataagtaaaactgtcaaaagtcttcatttggcttcctctatttggagagtgccttgataggattccaatcaataaacatgaaatctatcaggctaatttgccagacctcactttttagtcaacggcatttcttatcggagctgagtcatatcgttggttcttatgtaattgtatctgtaaaatttgtaaagacttatgttcggttcaatagatttggtgttgcatcttctaatgtcgaaaagtattacaaatttgaaaacgtgtaaacttcttataaatctcacatctttccctataactaatataagtgtatatttgcccttgtggtcaattcagacaacttgcactggcaggaggtcatgttgtgatggctgttaggagaaccaaattggcgcaggagctcattcagaaatggcagaatgataattcagagataggaaagccccttaatgctgaggtaatcatgaagacactatctacaggctgtacacaattgttgtctcatggcattttactagtttgtcttgtttaacacacataaatttgaatttctggccttatatgctcaaatcgaattccaactttcaagtaaatactatagtgtgtccttcacatctagcttttctaatcaattggaagatatctgttgcgaatgcatatcttaattggtaaagacaaagacatgtttctccaacatttatgtggtttagctgcagatcatttgacaattttttaatatattactctttaaggtgatggagcttgacctactctctctagattcagttgtaaaatttgccgatgcctggaatgctcgtatggcacccctacacgtattgatcaacaacgctggcattttctctataggaggtctgtatgcttcgacgataatctgtttcttttgtttttggtctatcaaatcaatccaacttgcattttactcggtaaagaattcaaattgtaccagacataactaactctttcattttctgtagaaccccagcgtttctcaaaggatgggtatgaagaacacatgcaagtgaaccatcttgcaccggctttattggcagtgttgcttctaccttcccttcttcgtggttctcctagcagaattgtaaacgttaattcagttgtgagtctctactcttacctgtgctgtgactgcctacttaggaattgttggaaagtgaccacggtttccttatcatgtataaaattggttattaatcctaacctcaatattttgaaaaacttgtctgaattcattattttaatgacaattaagaatcatttctgtgtaaaatttacaaatacctccagatacacttctgccatctaacaagcttgtctgcaatttcagatgcacacagtaggttttgtagatgctgaagatatgaacttgacatctggaaaacggaaatttacaagtttgatgggatactcaaatagcaagttagcacaggtatcacagaggtgttagattgctaattagcagttgttccctttgcaacgttaatttccttattgtactttgtattgttttcattctgctttattgcaagggaacaatcagtatctaaactgtccatgcacttttttcatgctatgtaggtctgatttattcttgtttcacttgcagataaaatttagcagcatgcttcacaggaggattccggcagaggctgaaattaatgttatttgtgcctctcctgggattgttcatacaaatgttgtgagttccgtttccccctgtccaatgtttgccctgtgaaacatgctatttcataggaattaaagaa

SEQ ID NO: 44036 - DNA, 1552 bp, Oryza sativa
tttttctttttttcccctcaaatttcaatttttatgggccacatgtactagtgggccggctaccagcccacgtgccactacagtagccgtgccggcccggcacggcccagcaccttcttgggccgtgcttgggccgtggccttggcacgtgggccggcacggcacggcccgctataggagccgtgcctaacgggccgtgccctagtgggccgtgccgtcggcgtgccgtgtcgtgctgggccgggccgcccgtttggcctgctatagctctgaatatattggcaaacttattctcatttccttctgttagtttattatttgtatgttgatctaataatgcccataaatggtgcaggcaagggatctccccaagcttgttgtagctgcatatcatttgattccgtacttcatattcgatgctcaagaaggtgatgtacaggacctttcagacgttgctatctatcaattgacaactctccaccttctgacatgcacaatatcttgttactgatctaatgcaggttcaagaagtacactgttcgcagcttctgatccccaagttccagattactgcgagatgctcaagtctgaagactggcctgtttgtgcttgcatctcatatgactgtaatccaatgaatgcatctgaagaatcacataacctcgagacgtcgcagctagtatgggagaagacattagagatgattggcctcccaccagatgccgtggacaagttcatcgaaggggaatcggttcagtgtcgttatggacaacagaaggcagaataggctatttcgtagacagcaaatatgtgataatttcgaatgttcgatccatttcatcatgcgattagtttgccagtggttttgttccagtactttgtaatagtacatctgtcatacccttttttttgtttcatatggttggtaaatctaactgcgtcaaatagaagtatgacaaaacaaagttcgttacaatttatctttgccccttgttaaatggcaaaacgtttgtagagttttgagttgtaaaagcatagtcccttcattctttggggataatcaagatatttattattgtttgggggaattaaccgaaacattttcagtttgtagcctgttctgctgtgcctcaaaacgctgcacttacataggtgtggcaacgctgtcctgaataccaaaactgacgatacaagaaggatggataaattttcaacatcacaagcaaatactaccatatatcagctctgaatttgaggataatgtaatgaactaatttagaacatactatattgctatgcatgtgctcacatgcgaaactcttgctagaaacagaacaagtactgccaagccaatgctaaaataatagcacagtcacaacttccacacttgaacaaactcatgcgagggacatgagagtttgtggagcattcaccaggcaagagggttacgatccagattaattacaggcatcgcccctcaataggacgagttaaaaacagaactccaataaaagaacagtttaccacgtaatggacagcgggctgcaggaat

SEQ ID NO: 44037 - DNA, 2198 bp, Oryza sativa
attcctgcagcccgtatgcatgtgtgagtgcattcatcttttctacatggagggatggcgaagaggcacgttgttaattcccacacctgtcattcagtctatccctccgaattttctcacggcaagctttggactttggaccagatgatgatgattcatctctacctctgcacaaaatcagaaccattacaaatgaaaatcaaatatggtcccagcaataaaatgaataatatgtctaaatactgtgttaaatttgttcatggtaataccgtaatggttgaaaagttataactatcagtaacagttcaaggtatgtaagcaaagatacttagaaaatcataagaaagtaagattcagaaactagtgacagaccttttccctaaaacagattggtcaaggcaacaagtatctccactgacatcatcaatcccaagtctgcaataattacaaagtaagcgccaagtgaataacagttgatgggaacaaaaattattcaagcaaggtatagctgctcaggtaggcaacaaaagattctgccatacatatttccattagcaagtgcttcaaagctaacattttacattcagaatcatacttgtgtagatatttcagagagcaaagaacaatgtaacatatcctatggcaagtagttggcaactaggtgtttatcacgcaggcgcccacttttccaataagggcgcaatcaaattgctaattgatttcaataagctcgattggaatggtaccaacagcaccagaactactagtacacgctattgtaatttacggtttttgccctccaatcgatgggtactgtagcagcatttgctgaacccgcctataaatcagctagcaatcacaattcttcgttcatatactactataacctaatcgatcaatcaatcaaccaactagacggtgtacatgtgaaaatccccctctttttctcaagaaaaaaaatactcctaagtagtatcaaacatcaccgcaatttttttaagcaacaaacctgcagcgacaaggacagcaaacactacaaaacgcatgcaacaaaccccaattcgagctcaatttactcctcaaaaagaaacagaagcggatcaagcgtaccctccatcgcagggcagcgtcggcacaccgtcgcagaagacgccgaggtcgccgtcctcgccgccgccgccgatgaggaactcgtcaacggggtctccgcctccgtccatcgcccgcggcgggtgcgggagatcgggcctagggttcggggattctcgctcctcctccgcgagcgagaggtcggggaagaattggggatttggggatgagacttttgcagattgcaccctggatataactgtaatgtctaacgagtcctcgcttagtagtttttagctgtggtggagaggggtgatgttgtgattttatacttttttggaggggttgggtgtaaaagtgagaataggttggtggctgaggaagatgctgggaaaaaaggggagataagatgatgagcgtgtatagcacaggatgtggtcctgttcatcatgtttttttgtgttttttttatttttggatttgtgtttcatgtgatcaacttgatcagtgtcatctactggctactgcatctgttctcgatttgtttactctgattaggtttagaaaagtttgtttcatgtcaattagcctaacataaagagagtggtgtgactcgtgatttaataatataaacatagagttgactagttgagtatgcgttttgtagagttgttagcacaattcttttttgtgtgagtgtgtagaccatatacctcaagttttttttttaaaataaaacaaatgctcccaagctcgtcgtttgctctataactgataagatgtgaaaaaagattgaagtatggaaaaaattatgagtaaaatttttatatatgtataaacttagtcatttaaaagtcgatgcaaaagataactataaaactaaaactaagtttcaaaatttaaattttactcgcggctgataatcctcaagcaaatgatggcagtgttatacttcaaatttcaaggttggtgtacctggagcaatgttactgaagagaagatccaatccaagtacaaatccagccacagatgctcagcccactgggctcctttcgtatgcctgagcccatgatcccctctggtgtttcaagcctggccttataaccaat

SEQ ID NO: 44038 - DNA, 19466 bp, Oryza sativa
gtaaaaagaagatagatcagcaccttcctccttcagaaaaaagcttcaagatgttttctccacttgaggcctgtctactacatacacacactagacagatggatgctgctccacttaaggcctggcattcattcatttcattcatgcatggcattcagattcagtcattcagggccatcagaagcaacagcaagtgctgcaatttcttttctacctctcctttatgccccttccacaaagcaatggatggattccatttccattccattccattcctttttatcaccaccaacaacaaaaatagtgcatgggtttgcaaacacctggaaatgtgccatcctctagtttattgttttttgccatttgtatatatttgtgtgctagctagctagctgatccaccactacggcctcattgcatctctgatcactaccagaaggaaaaaaggtattgaaattggacattatagtgtggttcaatattatgtgtcaaactaggagtgctctgtgggaagcttaggcttcaagtgtggctatcagtaggtgctagacactctagtcacttattgggggtaaaatgatgattcttggaaggtgattaattgacatttgtgcgaactagctagctgtcatgtctgtcaatggattttatgcatcctatcttttctgaaaataagagactgtcaacttcaaggctaacaaagtggcatgtttgctcatctagtagattaacaaactggatattgctgaagacataattcgcattatctttcttgtgataggcagagaattcgttggtcctcaagtttttgtattattacatactagttacatgcccgtactttgcaacgggattgggtgatagaaatatgattaaatttccttctatgccgggttttcacgatgcattatgttttgaggtctttttggagtgtttttttaagggaaaggaatggttttttagaggaaggaagttttttttttggaggggaggaaggaggacgacgaagtagttaagagatatgggtatacattatatgtgtaaaatcctagagttacatttgtgtacaaatgtaagttcttttttttcgccgggaataagttctttttttttgtaaaatgtatcaactagaagtaaaaaatatatataggtgtggaaaggagactatatatgaagtggcaaagaagatttccaacaccctttgatatctctgcctctcaacatgtggattccaccatcctccacaccaacatattttatacctgaacaaaatagttgacatgctgtgagccgttccttccgatccaatgctcatcatgagattaaagaaagttaattccagatgcaaagcaaaaggcagcaccataacatctcctaatatgcccaaaaaggaagaattagagatatattagcacactaaaaaaacatccatttgatttgcctcagctctaccctggcaatagtagtgttgtctctctgaccataaaaatcatgctgttagtttatcatatcctcaaggaacatctttcggtgtcttgcactctggcatttgtcatttgatgatgctgactttgcaaatgcacatctattactagaatactagaaaggtgagtggaaaaattgtgttagtggaaaagaaagctggtgttgatgtgtgtaattgaaaatacagtgcttaattaaagattgcaactatatgcaaccatcttgtgaccaaatggtaagtaacaggccactttgcatctgatcaggtggtcagctgcaaagtatgccttttcttcagagtagtcatgaagcatgccttttggtcttgtgatccaagagaacactgaaatcagagtttttctttaaattgacttatactagcagctggtaaagaaagccattggagtatacccgaaggctgttcatttgatttagcattttttgcttttatataattagcaaagttgatcttgaaattttacattttggaacaatccgtcgcagattcgtcgcaaaaaggggcctgcccaatggtcaccaagtattgtatgagcctgaaaaacctacatgagttagtatggtttacattgtaatgttgcaatttactgttgatcatggataaatagctcattcaggtaatcatatatcacaagtaatgcgtgtcaatccagccaagttaagacgttgaaatccttttttattttaatgttggaatgattgcagtaatccaacaactgttctttttgttatcaacaaccttatttttttatcatgaatgcactcggttgcttcctcctgaaattctctttaagcagagtcagaagcattacgtaatctgtgactgattatattttaatcaagtaaatgatagtaataataattattttcatgggtgaaggtacttgtggtgaaactgttctaagggctcaatcactatgtgaacattacatcatttattctttcatatagggacatgattaaccaataatccaggatatatagtccacagcaaaatgcaacaaataaattacccccattagtttgctaatttttttaagcagacaagataactacctagtatattaattaacaaacaaggggatttatttatagtacataaactgaaccccattaaattcattgtagtacatttgtacctatatatatgtttccttgctgttcagaggtcaaccatatcctaaactaatctcgggttgttacctgaaccagaagtgcttggcttaaatctcacataagtactcgtaggtttggatgacaaatcaaggtactagtagaccaaagagacttctgactttgcagatagatgcgtgtatgaacagacaaaggaagctgataatcctatgtaggagtaatctttaagccatcagtgtcggctgttttctgcaaaagacagagaaaactgatttcttaggaatgcacaggacgtagacttgaattatttgccagtagatttttgctgttttttatgctacttgtcttttcttttttccttcacttgaacagagtgttatgacagggagagcactgttataatgctctgtttacttttgacagtgaaagagtttgataactccgagctaggttcgatcactgatcaatatgtgttaacttctttattttgttgaaaaatagagtttgtcaccggttacccttacccatggcatgatccactcccattccttcgaccattattaagacaaattttacagtagtgcctactagtattagaattaatcgctgtgtatctgcctgtctagaagttagtaatgaattgaaatccaacctcatctgttgtatctgcacttctcagttattacttattacgtattaccgtctctgaaatgtgtaactctcgtctctgtttaaatcaagcagagacaaatattcctttttagcaaggcgaactgatttttttttgttatttcacttaatctgttgcaacacactgtattttgctagcactaagaaatgtacagagtaactccactgacggattaagcgataaaaaattcagtaattctacatgtattcctgttttatctagaacatttgactagactgattctaaaacagctgaataaaggaagaaattgccacgaagaacaagttacaaacaacttgccactagtatgttttgctactaattaacaactttattgatttcttcttgacaccggaacgtacgggagattgggcgacttactaccatctgatcatcttatgttgacctgtgctaatccctccagtgcaatcgccaaatggaggccatccatttcacagattaattatagctgttaattaatctctgctactgacactagtgtcatccactcacatccgctgacttattccctaaatcaccgcctgctaaaaggtctcctctcctccatctctattgcccactaaactaagctccatcatgatgtactataacattagcaggaaaatgacatgaaacaaaatgtatatccttgttgtgcttcctaatggatccaagaaaataagccaaacttactaacaaaataacttaatccctggtttcataattcttgatattttgaataagattaagatcaagacaataagaactttgactatcaacaaattttaaattatttaatttaaaaacactaaaacacgatgtatagattattctcgaaaagaaatttaacaaaatcaaacatttttacttattttttatgtgttataatagaaaatcatagttaaagatatattttagaaaccatgtagatatccaaaacctgaagaactatggaaatggagagagtactctgatacagagactacgtctgaacgcaacaatttcacatgaaacaaagagttagatttactccatcatcttaaaatataaaaagaaatagtttggtccctcttcctagttcatttggtctatagagttacatgacctagaaaatgaaaagacacgtcagtaagcaaacaggctttgaaaacaattaacctggagaaataggagtttaggacagctcatgaagctagtatcaaacttaaccaaagagtcaaaccccagacatgctagtagtcagttagttaaccaaccttctccctcctctcttccacttcgtgcaagcatgaagcttagcaagctcaagctggatcggatcatctgatgtgaattctctctcacaccaattcaccatggatggatgcccatgaccatccttagctccaggaagaagaagaagaagtgaacagtagctatagccatgggaagcagaggaggagctttacctgttgctgtactggtgctgttgctactgctggtgctcaagaacggcgccgcccagtcgcggtgcagctccggcgacctcgccgcgctgcgtggcttctcggccggtctcgacggcggcgtcgacgggtggccggcgggggtcggcaacgcgtcgtcgtcgtcgacatcggacggtggcgactgctgcgcgtggcgcggcgtggcgtgcgacgaggcgggggaggtcgtcggcgtggtcctgcccaacgcgacgctccggggagtggtggccgagtcgctcgccggcctcgccgcgctccgggtgttgaacctgtcgagtaacgcgctccgtggcgcgctcccggcggggctcctccggctgcgggcgctccaggtgctcgacgtcagcgtcaacgcgctggagggggcggtggcggcggcggccgtcgtcgacctcccggcgatgcgcgagttcaatgtctcgtacaacgcgttcaacggcagccaccccgtgctcgccggcgccggcaggctcacgtcgtacgacgtctccgggaacagcttcgccggccacgtcgacgccgccgccctgtgcggcgcgtcgccggggttgcggacactacggctctcgatgaacggcttctccggcgatttccccgtggggttcgggcaatgccggtcgctcgtggagctctcgctcgacggcaacgccatcgccggggctctccccgacgacgtgttcggcctgacgtcgctgcaggtcctcagcctccacaccaactcgctctccggccacctgccgcccagcctgcgcaacctcagcagcctcgtccgcctcgacgtctccttcaacaacttcaccggcgacctccccgatgtgttcgacgcggtccccggtctccaggagctctcggcgccgtccaacctgctcaccggcgtactccccgccacgctgtcgcgatgctcccgcctccgcatcctcaacctgcggaacaactcgctcgccggagacatcggcctcgacttccgcgccctccagagcctcgtgtacctcgacctcggcgtcaaccgcttcacggggccaatcccggcgagcctcccggagtgcagggccatgacggcgctaaacctcggccggaacaacctcaccggcgagataccggcgacgttcgccgcgttcacgtcgctgtccttcctctccctcaccgggaacagcttctccaacgtctcgtcggcgctgcggactctgcagggtttacccaacctgacgagcctggtgctcactaagaacttccacggcggcgaggcgatgccgaccgacatcgccgggttcgccggcatcgaggtgctcgtcatcgccaacggcgagctgcatggcgccataccggcgtggctcgcaggcctcagcaagctcaaggtgctcgacctgtcgtggaaccacctcgccggcccgatcccgccatggctcggcgagctcgaccgcctcttctacctcgacgtatcgaacaactccctccacggcgagatacctctcaagctggcgtggatgccggcgctcatggccggcggcgatggcagcgacgaggcgcacgtgcagaacttccccttcttcatacgccccaactcgtcggcgagggggaggcagtacaaccaggtgagccggttcccgccgtcgctggtgctggcgcggaacaacctcaccggcggcgtcccggcggcgctcggggcgttgaccagggtgcacgtcgttgacctgagctggaacgcgctgtcggggccgatcccgccggagctgtcgggcatgtcgagcgtcgagtcgctcgacgtgtcgcacaacgcgctctccggcgccatcccgccgtcgctggcgcggctcagcttcctctcccacttcgacgtcgcgtacaacaacctctccggcgaggtccccgtcggcgggcagttctccacgttctcccgcgccgacttcgacggcaaccccttgctctgcggcatccacgcggcgcggtgcgcgccgcaggccgtggacggcggcggcggcggcgggcgcaaggaccggagcgccaatgccggcgtcgtggcggcgataatcgtcggcacggtgctgctgctcgcggtggccgcggtcgcgacgtggcgggcgtggtcgaggtggcaggaggacaacgccagggtggcggccgacgacgagagcggcagcctcgagtcggcggcgaggtcaacgctggtgctcctcttcgccaacgacgacgacaatggcaatggcgacgacggcgagaggacgatgacgctggacgacgtgctgaaggcgacgggcaacttcgacgagacccgcatcgtggggtgcggcgggttcgggatggtgtaccgcgcgactctcgccgacgggcgggaggtggcggtgaagcggctctccggcgacttctggcagatggagcgcgagttccgcgccgaggtggagaccctctcccgcgtccgccaccgcaacctcgtcacgctgcagggctactgccgcgtcggcaaggaccgcctcctcatctacccctacatggagaacggcagcctcgaccactggctgcacgagcgcgccgatgtcgagggcggcggcgcgctgccatggccggcgcggctgagcatcgcgcgcggcgcggcgcgcgggctggcgcacctgcacgcgacgtcggagccgcgcgtcctccaccgcgacatcaagtcgagcaacatcctcctcgacgcccgcctggagccgcgcctcgccgacttcggcctcgcgcggctggtgcgcgcgcacgacgacacgcacgtcaccaccgacctcgtcggcacgctgggctacatcccgccggagtacggccactcgtcggtggccacctaccgcggcgacgtctacagcctcggcgtcgtgctgctcgagctggtgaccgggcggcggcccgtcgacatggcgaggcccgccggcggcggccgcgacgtgacgtcgtgggcgctccgcatgcggcgggaggcgcggggcgacgaggtggtcgacgccagcgtcggcgagaggcggcaccgcgacgaggcctgcagggtgctcgacgtcgcgtgcgcctgcgtcagcgacaaccccaagtcacggccgacggcgcagcagctggtggagtggctggacgccatcgccgccgccgccgccgactgacacgaagcagcacggcgttagtatatgaacaaaaaaaaaagaaaaaaaaaagacgagctgatgattccagtgttctgcattgctgaaagttttgcagtaaacagagtagattattgtgcagtcgcaaaggcacggtacagtaaacacatggtaattactactagtaattgacagtgtaacagtatacatgtatagtgagtggtgtgttgttagtttacacttgtgacttgtgtgtgtgtgtgaataatagcatctgcagttctgcactgcaagctcaaagttgggctgtgcagcgttcgagtgaatcagaactgctaatttttaaccatgtacttcttcttcatttcgaggatctgatctgggattactgctgatttggcagtaacaacatgaaacaagaatgcacgtatcatgtcaccatctgttgctgactaggagtaattttctctgttttgtttcgggttggtgatatggtcagttagctaccttgtctgtactgaatttgcaagtagatataccgtgctgatgttctatctagagcactattggttggcccaataagccaaagtaaaaaaaaatcaatatttgaattttggagttgatcttaatatattttcaatgtaattctttttagcattagtttttaagttgatatgaacaaatatataaaagttttacgtataaaatattttttattctccaataaactgttttgacttattagaaaatatggacatgacgaatgagattctcagtttttagtgaactttgactggcttgtttgggaaagagggacttattccaaatccctgtcacatcgaatgtttggacactaatttagagtattaaacatacacaaattacaaaatccatttcataaccttagactaattcgcaagacaaaacttttgagtctaattacgccatgatttgacaatgtgatgctacaataaacttttcataattataaattaattaggcttaaaaaattcgtctagcagattagctctcatttataaaattagtttttttattagtctatatttaatactttaaattagcttacatccattggatgtgtactaaaaagattctcgacggcacattggcatggcgctgaatcttcatggcagtggatgccatgcagctgaatccatgttattactgcggttaagtttctgtcctggatggctgcattgcagatatggattaacacgtgcgagattagcagtaaactaacatcggaatcgacaggagtattcctattcctatcttgttaatctgctagattttagtactatactctgatgctttaatttcactacgtagtatagtactcccttcatccttgaatgtttgacaccattaacttttttaaatatatttaattattcgtcttgttaaaaaaatataagtaattattaattcttttcctatcatttgattcattgttaaatatacttttatgtatatatatatagttttagggcctgttcactatgatgccaaaaaaaaccttagcaaattttgacattgttaaaattttggcaacttgccaaaactttggaaggatttcttatatagttatcaaaatttggcatcaaactaaacgtggctacttttttagcaactttaccaaaatttggtaaggttgaaaatgacatcaaagtgaacaggcccttacatatttcataaaatttttagaataagtcaaacggccaaacatgtttagaaaagtcagggtgtgaaacatttagagaactagggagtagtgcactagtactccactatcaggttttgtctgaacatcatcaattcctcatccattgccatggcggcatggcgccgctgccgctgcccccaggctttgatgatccatggtccacatgagcaagaacaaaacaacactcattctgctcttaattaatgtgcaaacagtttgctctgctctaattaatcacagaatcccgagccgacgtgcactccccaacagtaattaccatttacccatgctcatgccggacccgagcaccgggcccacctgtcatcgacgccatgccctttctgagcccaccccactcacatgctggggggctcgggagtcgggaggaggaggaagaaggacacggcatgattgggacgtgggccccacctgcagcgactgttagtccaacgtggcactattcatacgcacccctcggatcgcggcaggggaggtgggacccaccggtacaacctggcatggaggtctacccacaccccaccgacatgtgggccctgagtgaggggggccggggtgtacagtggcgtggggtagaactgagatgggtgagaatgtgatttttaacatacgtgactcggcgcaaggaccaatggggtactcgagggtgagaaaaaaaagagagagagaaagtgccgttgccggtgaggtaatcccacatcatcctcccgcggatttaccattttgtccagttttccgatgggtggacctacatgtcggtgacacagatatcagtggcatagaacgtaattgtttgtaaatggagggggtaaaggggtaatttggtgtccgtcaaagtgcagtcaaagcgcacacactcccgagcttagcttagcttttaactgctcgtctcatcactctccacctctctccctctctctctcttcctcgcgctcccacgccacgcagcagccgcagatctccacccgcctccggcgagcccgccgccgccgccgccgccatggagtacgagcgcatcgagaagccgttccccacccaggtacgtgagtggccaccctccgccggcgccgccgctgcccccatttttgcctctccgggcggggcgtgttgccactgctcggtacctgtttggagtaatgcgtggtcggctgctgtgctgttcttttggatttagggcggtgggttctcgccgaagcggctgcgcgcgatgttgctgggggtggagaagcggcggaaggggcaggaggaggaggaggagggggacgccggggaggtggacgacgagtacggcgcggtgcccaagtcctctgtcagatccgacgccgactccgatgcgcgcagtgagtactcttgcccccccgctgcccaaccattctgacttttgcattttggggttctggtggcttcgttggtaatgcttcaatcttgggagggtttggtcgcctgcattgcacgatttggaccagctgctctaatatggagatgaccaatcctcttctgttcaagtgggttaatgacatgagaaaaagggagatatatctgtatttggcttgctggcaatggttggtgaattgtggttctatagacattgaaatgttttcctttttgtcttttgtcatcatgggggaatttgaagggcaccgaagtccaacctccttctaagtcttgtaccttcgcattgaataatttcaggtagaaagtgcgatggtattgtttttagtgggcagctgaactgaaagtgacagaccatgattgctttgaatcttcagatgatttcagtgtcctcaaactgtgactgatttattttctttgatgtaggaggaggtagcatgtgcgaagaatacaaggatgtagatgtggtgagcaccatctcagaatcttcatcctcgttggagacagggagtgggcaccgatcgcgtgacacccactccatgggttcacgagtaagggtgcctgaggaggactcctgtgactctgagagtgtggcttcaaactttgagttccataaggagcgaggggcctctgctcggtctgtgacggcggcaatcgttcctccattctcaaagcctgcaccatcaaagtgggacgatgcccagaaatggatcgccagcccgacaacaaaccgtcctggtagggctggtggagtgccacagaggaagatggaaaaaactagctttggtggcgggaggctgccggctacgaaggttgtgttggaggccacagaggagatagatactaagagggttgatccaagccaagagaaaagggaaattgggtggcaaaaagcggtgaattgggccccacctgatccatatccagaagttgagacttgtgcaaagtctgcacttgctgaagaaattacagtagctgattcagctggtaaggagtgctgcagtctttatgtcatcatgcctcaggttcttcggtttttctactttccataaagtagtttgtggtacaatatatagtgttattaatccttccactaagagtctgattgatcttctgttgccattagttgagtggagcattatgccatggagggctccgcacattatgaatcactaactcaccatcaccgctgtctcattcacaatggcaatactctgcatttgacaatgtgcagagctttatttccctttcaacagtttagttacaacagttgcatagatgaatttatacagtttgcatgtttgttcctttagatagctgatagtcaacaggagaaccactaatgcaggcaagatttccttttccaaaactttatgtaacacggtttcatcagttttccatgatccactctgttaatacgtcctgcgtgtaaagtatttatccttatttttaaaagtgaacagtaatatttgcatcattttctaatgttccttcaaagaaatggcacaaattttgccttttctaattagaaaatgaacaaaatcatatatggctaaaattttgaatttgtggctttgggcagttacttttagtcgccatgattcatctgccacgcttcagagcgcgacaacatgcatacctcccccaccaacagtccgatcagtgtcaatgagagacatgggtacagaaatgacccctattgcgagccaggagccatcccgaacaggaacaccggtgagagcaacgagtccagattgttctcgcccaactactccacgaaaaacaataggccccaatgcaatcggtgctgttattggccatggtgaatgtagcaacgtggaattaagtgaacaagaattgcaaatgaagactaggagggagataatgctcctcggcactcagcttggtaaaaccaacattgctgcatgggcaagcaacaaggaagaggaaaaagatgcatcactttcgcttaaaggagtgcccatggaccaatctacacagaaggtaacagaaattcgtgcagcagcgtgggaggaggcagagaaggctaaatatttagcaaggttcttcactaaactctatttctcttgttgcaaaaaaaaaggattgtctttgtatgtttttgctaaattgtcccattgatcggtgagtcactctattgcattccagatttaaacgagaagagattaagatccaagcatgggaagatcatcagagagcaaaaatcgaagctgaaatgagaaaaattgaggtaagctttctgtcatccaatagaagcattgtaataatgcattgtagtatcatcttaactgagatgtttttgattctattttgactttatttccatgtttacatgcacattaaataatatgggatttgttcttctgattatgggcttatggctgttggctgatgatcttgtggacttttggtactgttaagaatgcacatcatgccattgacataggaagctaaatatattactgctgttgggagtttagtagctgatcaccttttacagtgttatctgaattcactgtccttccctcttacaattatgtttcaatctgcttatcacagatttgttccacacacagccaataagtatcatatggttacggttgtgaggctgtactgtttattaagatattatattgccttaagagaagagtagtagaacaatgccttcgtctcagactaaaacatagcttgggattatacctagcatcacttgatcaatttttcctgtcacatcggcatgatgcttggtgttttaccataaacttccatcaatttggatattgcatagcaatttaagtatcaattcttctttttttttttgaaacaacctgcaccagtgggacgtttcaagtatcaattcttccattcagatgcatcatactttgttaagagtgaacaatccgatttgctttacttgtccatctctgtacaagtacaattgttcttgtacgatcaatttgggaaactacactgcccgtggctaatggatgtttccatggcttctgtttctccaggtcgacgtggaaaggatgcgagcccgtgcgcaggacaagctgatgagccagctcgcatcggcgagacacactgccgacgagaagcgggccgcggcggagctgaaacggagccgtgcggctgcaaagacggcggagcaggcagaccacatcaggagaaccggcaggatgccgtcctccattggctgctggaactggtgctcgtagtagcgtagctaagctcaagcaactgaagcaagcaaaaagctctcctcactatgtctcgcaagacttgaagcgccatcatctgtttttaccgtgatcttgtagaatattgtcttttgattggtttcagtagatataagtcagaagaagacgagtcacttgtaagtaactatggagcagtatataagatgcaagcttcttgcctttttctgtgctgtgtgcttgttatcttgtacttggatgtcaatctgtcacagtgagctacaagcagctccaccatgctgaggaggtgttgaggctcaattcggattcccggatcaccagtgcagtacagagtatatgtgtgccgatgttcatcactgatgtgagatagaagaacaaagtttttacggaaattcttacccctttagtcctttttactcgtagcgattacagtggaatcatgtttggtcttcacatgtcaataaaactacacaaaaattagtacaccattcaattgttgcaaatacgtggtaaggtaacctctttttaaaccaaacagaacaaagaaaatctggctgggttgtttcctggacaattttttcttcatcctgtgcaacggtttcaatcaataacatactggtaaaatcctttttttaaaatcacacatgaataactgatagtaaaatggaaacatcactcccagagatcatacataacagaaagacaaacataagataaaaggagtgattatatgaatcagtactccaattcacctcctttttcttttcaaaagtcactagatagatattgacttaatctcggttttcatgatctcactacattcctcctgaaggtgatacactgatacacagcagaactttggatcgatttgatatcgaacaaacctcaacgagcattcaaatcaaatgagccctaattatgattcaccttctctcaagaagataacacagatattaattagacagttcaccagcaaatctgataagctacagtcctactactcgaacttcttgataagggagaggtcgttgagcatcttgtcgatcttctcgctgccggggtcgccgacgaacctgccgccggagcggagggaggggacgagggcggaggcctcgtcgctggtgtcggggcagaggttgccgagggtgcagagctcgaactcggcgaggccgtagcggctcagcgtctccctcacctgcctcaccgcgtccgggttcttgtaccggctgaaccgcttcacgtactgcagcgatttctcgaacacctgcgacacctgcgacgacgggtccccgtccgacatgtgctggatctgctcgtacttgtgctccaggattatcgccacctcgcagttcatcaggcacttggccttcaagaactctgcaacccatcaaaccctaggtatcaaatcaaatcaaaccgatacctctactcgattccgattcggacggactcaccttccccgatcttgagctccgccgcgttctcctcctcctcgccggacatctcggcgcgctctctctcccctctcggtggctcacctcaacctcggcggctatggcgttggcgatgcggctgcgggcggagtctggactcgggaggggaaaagaaaccaaggcggcgagaggcgcctcttaacgggctggactcacgatccgattcgctaacaggctaggcccattaacgcattgggccggctcgatctgcacgagcgtgttcctttcggggtgatctggaccgtccatccgtttactactcgacggcggcggcgagtggtcggcgacaaggacggcgggcgtgtcgtcttccccggcgacggcggggatatgaaggggctcgattcccgaggagatcagcatcgggggtgtagctcatatggtagagcgctcgcttcgcatgcgagaggcacggggttcgattccccgcacctccacctcacttctctcttttttttaatttatttttggtggatttatccggtgcggtggtgcgggctccacgtggcagtgaggcaggtggtggcctcgaggcgcccgcgtggattgcagtggcgctgctcgtcacttcgtctcctcctctccaccactcgtcgtcgtcggcggcgtggccatggcgacacccgcgccgctctccggcctccgcccgcgcgctcccgctcccgctcccgcggcgcgcagtcgcctgtgcggccagtcgccgccggtcgtggccccgcggctcggggcgttcccgcggcggcgtggtggggcggcacggtgctcgccgcgcgccgaggccggggacgtggaggcgcttagggcgggggtgtcggtgtacaagccgcggtcctacgacgtgctcgtctccgacgccgcccgctccctcgcctgcgccatggacgagggcaagacccgcctcgagatcgagttcccgtacgcccgcgacctattcattccctttcctccatagattcgcgccaccatctcgcctaatcttttacttagttggttattaataatgcttgcattatctcatcctccttgtctcatttttttttttggtggtggtgcttgtgaaaaggcctctgccgagcaacatctcttcttacaaggtatactttgcatttctatctcaagctcgtctcataactcacactcattgttctagtttcttgctttgttatgagtgaattctgtaacaatgcaaagactaatcttgatgtatattatatagactgctctagtttcagtttgaatgctgctgctacctctgtataatgttgtttcaaagcagaatctctctttttccttggcttcaagttaaaaagggtttagcttttgttgccacatacgtgtgatgaacgcttgtttctaaccatcctaccctgctttgcttcgttttcaagggttcctcggacgagttcatcgacgccaacatccagcttgctcttgctgttgccagaaaacttaaggaactcaaggggactagatcttgtattgtaagttcaagtttcatgccttgtcctgctccagaatcattctggcatttgtgggcatatgcaaatcttttctcataaattatcttctagttgattccaggtgtttcctgacctaccagaaaagcgcagggcatcccagttgttcgggactgctctagactcggtaaataatgcctcatgaaacaaaatatcttaagaggatgcaaaaaattgttttttcccctcatgacggtaggagcttatttggttacatttctctgttttctttttccacctcttgtagattgagactgcaactatcagttccctggatgaggtatctaccggacctgttaataccttcttcagatcaatgagagataccctggattttgactttgctgacgatgttgaaggtgaattgaccaatagctttgtctagtatggtaggagtactacattaaactattaagaaaacagaatttatatttatatgactccaagaggctgtcacgtccaagctagatgaatcctttatcgctagcattttatcagaattttcttatgtctgacctcacttcaatgttcaagccttctctatagaggagataccttggagaaccattagcctgtgatacatgataaataaaattgatttggtaaaaacatctttgtaaatttcctaaaaatgtacaagtatctcttttcgtacaaatggcaaagtctttaagttgctacttggcacagttcaaaattttaaaatagagtggaaggacatggttgatcagtgggtaattattcatatataagcattatggataattattcggtggtatattattgtgtcagattttcagcagatatttcaagtaacaaccatcagtaaaagttgaacattatcaatatgagacagatttcttataagcatccttggaaaagaaaatcataactacctggctactgtgggtacagatcgatggaaatctgatgaaccaccatcgctatatatcttcatcaattgcagcacacgtgacctttcaactatagagaagtatgtggtatgtctaaaatgatgctttgtttcttgccaacatgtatgcaaatgtactttttggaatgcttggtttgcattgttgtgttttggccatcatttggccagttaggtatttattattctactgttaataaacgatcatgttctgagcttgatggatatcactatgaatagaaactgaagaaagaaagttgaggaaggcatgcacagctgcaaataagccttatatgattgccacacgatttactattctactatctctatcccataatataaggcgtgcacacattccaagattcaactttaaaaacatttgaccaacaattattataatataaattaaattttatttgttaaaattaatatcattggattgacatttaaatttactttaagatgattataattttgttgcaataaaccttataatatatgagaaattttaagtcaaagattacttttgaagactgcaccaagtttgaccatgccttatattatgggatggagggagtatatcaagtgcctgatatctaagaaaatgcaaggaattttgaatcaacaccacaacctacagagtttctctttcattttccattcacttgtatattgtagttctttttccctggaacaagaatgaaaattttcaaccttcgatggtggaaaatgtagaatattctttgtagtttgtcacacgtaacgtaaggaaatagcatgcaacacaaggttttgaggaataatgcattaattgtttgtttagcagttgtgttagtttgtgcatttgtttgattcattacccatcactttgctattgttcaggaacaatttgcctcatctgtcccagcccttctctttaatcttgaactagataccttgcggtatgtgtcttatatcccacctgatggcttgttccttctaaactctattgatcgccttaggataacttatgatctttatcctccagctctgacttggggcttctgggattcccaccaaaagatttgcattacagatttctttctcagtttaccccagtattttatatcaggcagcgtgactactctaaggtatccatttgttttacttttacaaacttaaccattccttttgtgtatctgaaccatctatgattagtatttctccctatactttgtag

SEQ ID NO: 44039 - DNA, 8650 bp, Oryza sativa
tgatttgagtaaattatttttgtgttcagggccctggcaggtcatgcttaagcaagccgatggttcttatgcatgtgttgcagagagtgcagctcggttcactttgggacaggtcatacaaaattttgcttgcatgaattagttatgtcattttggagttgtggtgtatgatgttccgtgtttttcattcaggctaaggaagaactgttaagagttcttggtttgcaagaagaacaaggaagctcactagaatttctcagaagaggatacaaggtttgcatctttgtctcactttaattgtaaaatgcaaaaatgattagcataatcagcttcatatcatcatgctgatttcaaatgattcgttcgatgtacttctatccctgccacctcatgtgcaaactccaaattcaatatgaaagtttaaacttcattatcgtagcaggctagcagcctgtctcaaaataaaactttaagctctattatggttgcacctccaaagtaccttttgcaaatctgcatttcgtcaagagctagcattgttttaccatctaaagagttaacctgtaataatgcagaatgctacttggtgggaagagaatgttgatcaggagaaatcgtcagcatggcgaacttgaggttgaggccctgctgctgccttgtctgggtgctgatctgattggcggcgagtgcagacaggaacagaagaaaaaaatggttgtctgaaattgcagagcccaggcgacaaggatgcaaattgcctgtgctgcaattgtacattttgtgattgtaacatgttactgtgtgagtaacaggcattagagttttgagaggattttcctttctttttcgatgattatatatgtgttggactctgcttctttgaagcatgaagcaacttcacattttaaatggaaattcgtgttcatccaattgtactttctccccctccctaaaaagcaatatgaatggaaattatccttacaaaaaattgtttcggccactctggagattattctttttcatgctaaaatatgattatgattatttttattttttatcaagacaacattttttttcctttgtgatgttctcaaacacgataagccgtaggaaaataaacaaagcaataagaatagttcattaataaaagtgaatgctggaaaatagaactatcataaaaaaatcccctaaaattaccttgaaaataaagttttaaaattcgaattttgactttaactggtaagctaatatggtaaatatggtaaggttatgctcgttaagtattttagctttaaaaacttgaaaaattgattaatatgatctttttacaacgaaaaattcgcaaaaatgcactatttaatattttgggaaatttatgcgtcaaaaatgaggaattagaagttcgaatctagtaataagtattggcaataactctcagaactccagaagcttctattagtagggacctgtataaagatgcgtgagagctcaaggtcccatctgcaaaaacaccaccgcgacgaacgagcgaagaagtgggaacaagacttcaagagagagaggagagagatcgcggccggggacggagacgatggagacgcgacgagcaacctacagatccgccgcgctcctactcctcgccgccatcctcgcctccgccgcctccgcctcctccatcggcgacaagtgcgccgcctgcaaggccgttgccgtcagttcccgtattcttttctttctttttttttttgcccctctcgtcagttcatacgcgcacaattcactcatcctttggagcaccttgaagcaatttagttcgtattaaaatcgttttataccaggatgggaagaaattagcattccatattttccactccttgtgaaggagatcgaggcgtactgtcctagatctccaaacatttcctcggacattgtagaatttccaaagcgcatcgtttcactgatatggagtgcgcattgtagagatctgatgtatctgttgatcttgtttgcaggcagagctagagattggaatttcaagtgtgagtgaactctttttctgtctgcttttatttaactattctgtcataatttaaaatgctgatttggagtttatgtgtattggaaaatagctctgcaagtttcaaaatgattcaatatatttctttctgtaaaacagcagttcccataaacataatagcataggttcttctactgtccttgttattgtcactattggcaaattattaacttccaagagttctctaatgcaggagaaaccaagaaatcacttggacttgcgcaaccgcttaaattcaaaaggtcagcgtgaagggaaggtcattgattacaggtatgctaaccagcatgatcccttctctgctcaatcatcaggggcaacattcctatgtgttacaacattgttatcatttcatgtttcaacctatttgaatcctaattgtttggaaaccctttgccgcatcctttgttctatttacttgagggagagcgacgtcgtgtctgtcgtcccctatctctcattcgcacgagatttttctcaagggtgagcgtcacgagcgcatgtgagcgccaggagcacgtgtgagagggaggaaaacgggaaaatctggtgttagtttaacagaagtgcccacttttagttttgggatattttaggctttctcttggagagatcaattttttcgctacctattttcacttcaataagccaaaaaagaaatctttgggggaagattatacataatctcctagtgatgttcttagggactctttgaaatacagggttccaataatctaggtgattttagtgccacattttccggaatttgggttatcccaggatcggatcctatatcccttattaacactcccgataatctgggtgattttagtgccacattttccggaatttgggttatcccaggatccgatcctatatccctaattaacactcccggcgattctacccaactaggattaaaaaaacgcgaatattagggaaggacctaatatcaaataattagaaggggtgaggcttcgaacccaggtcgtctattccaccaccttgtggagctagtcggaagactacttgagtgtttctcaaaagagggatgcaacaaaggactttctaggaggtcacctatcctagtactctaggattacttatgattcttgaaaatccaactaattaacattctttgaactaaatacaccctataagtgtacatatataaataaaaaacaaatctataaattaaatgttgtgtcgtttaaattccaattatatcttgaaccacatgaaaaactcacgttacctcttgggtcacttgatgacatgcaaaaagaacaaattttaagacaataaggcctggtttagttcctaactttttctttaaatttttaacttttccatcacatcaaagctttcctacacatacaaatttccaatttttccgtttcatcgttccaatttcaatcaaactttcaattttgtcgtgaactaaacacatcctaattggaaataaatgatgtgaaacccaatgcgtatttcttagtatttattgggaaaagaaaatacttcctccgtcctctaatataagggattttgatattttgtttttaccattcatcttattaaaaatttgttcaaatataaaaaaatgaaaagttgtacttaaaatactttggttaataaagtaagtcacaaataaaataattaatatttttttaaaaaaattattaagacgaatagttaaaccgtacgaatagttaagaggacagagcctacttttgtcaacgagttggagttcgacgtggagcagcaatgaatagccacaaagtacggtagcttttcccatccacgtcacacttcacgctgtcacgtcgcgatctgctctctcttcccactgcagtgctgccgcgtgagcgtgaccgcgtcgtcgtccacggcgagctcgacaccatggccgccgccacggagcagccgcagcagatcaccgagatcgagcacgcccacctccccgtgcgtgggctcagacatctgcttctatttttcaattgcagtatgggcataagctcatgataatctgccatatttacatatgcatacatgttttttggggagaaatttgtattgatcattgttacttaacactaaatgtagagtctctttgtcattttaagtttcatttggtttcacacatacttgcttaatagatgtacaaaacttaccatatattttgtattggtatgtctttaactctgtttatgtggtgcagagtaagtgagcttcgagttgttgagcttctggatggcctatgtgataagatgcaagattataccctgcagaaggtagaaattccatccaattgttttagcattttttttactgcatactatgtccgcatttttgaattttgagactgaccttttcagttcactttttatattaagttgtaatataggtatctgaacttgttgatctggtgctattgtatatgatgcctgcatctgtccaagcattttagccatctaacaaattttgctgtatgcagttggaatcaggagaaaaaggatgggtgaaagtagcagattggaacagttttaaaactggtaatcttggacatttttatcactcgtaaccgcaaaataaatctggagccctgatctgtacattcttgtactcaatatgttaattcgcttatcctgtttaatagcactcttacacgaccatctcaggcaatggtgcaagcacttgatttagactgtacatccggagactatagcctgctttgttattttgagcattgttaatatgctcaccatgataatacaatatacaaacaagttttgcatacattattgagacggtattcatcccatacgtggaaatgaactcaatggaatatatttatgctaaatgagaagcaaacaacaggtgctgtggtttttgcaatgaacttatcacaatagaatcactgaaatagtatccaaaattgctagctacctgtgtttctgtattgcatttgtctcagtgaaagtaataaaacagtatttccaaatactaactgtggactactcacttcattgttcttttgtagaaaagaaggccgcagcacgagcacactccaaaaatttatcctcattctgtggaaggtatgacaaacaatatctatttcctccctaacccttcttgattttttatttgttttttggatttaaaagttgttttattgcatatctgacctcttattacaattttttaatagcacttcttgttgcaaacactttggaacggtgtagtttctggcaggtgtcattttccatagataaaagggcctctattctcacaaataaatttcattatgttgaacttaaattagattatttatttttaggtgcatcgtacacaaacataatttcataaaaaaaatgagtacatatctgtccacataggccttttctggttactaatattttttttccttactggctaatgttttttttattgttgacctgatttatccaggatgaataaactcttaataatctatatgctttgaaagtgagaagttattgcttgtctaaaaataaccttttacacctttacttcttttggtttctaatttagactgttgtgtactgaggggatgaactgacaaagttcactcatggtgcaggttactggaggaaactgaggatgaggtaggctgcttctcttggatgacatttatacattactttttttatactagcaaatatcgtctgaattttcccgtttcttgacagctgtgttttgttatgaactatacagatctatcataatttagttaaaaatagggcctcatctagagctttttttggttgcagctttctgagtggataaaaacgagctccgcagaatcaggaaatgtcagcagagcactttgtgaagatattagcaaacactgtcagtctacaaggtatgtgctatgaatatgaatcgaacattttgtcatcatgaaataagagattgctgtactcgcagaattttctttgcagacctctagttcactaacaatcctttccctctgtttccagtgctaccatcgagatcgacgacgaactataacaccaaagcattctggtgccatctttatctcacaaagcaaagcaggcgaagacctggaaagcgtagaggaacaaactcaaatagtttctgatttcatatgttgtatcactgcaattcatgtccttaaaatgggagaattgcaattcgttccatatagtgtctgtctatctggactaatctgttgagaacattcgaacatgagacaaattttgcatactaaaattacggttgaaagcaacacagttaactgattcagggggacttttgcaaaacgcctatttctgatgcaatcatggtttgcaataacgattggttttttgcgaaaatcacttggttttcgtgaagttgctggggataggtttgtaaaaactgagttttttttagccaattattttattatgggcttgaccgaaagtcattggtttttatcgggtttcattcggtttgcggcacaccgacagaagtataactagatcttgttctgttttcagatatagtttacacgaaggtttcccagtgtttaagaaatcattcaagttctgcactgaagaatttccacattccaaatgggctccatgaaccaaaattgtttttcattggaggtgtagtgtataactacgacgcattcctttcgcatgtacccatgcatactatcttgtgaaatgctcgttgaatcaccaaattatcctccattaattaaaaacccaaacgatctcgtagtaattcctattaaattcatgtaatattccaacagagcccatagtaattttgagtgcaaatgcagcaatactttgttatgtactaccaataaaaattccaacttgcaaaaaaggaaaaaaaaacagagaaaagttacaactttgaaatccgagaccaagagcacgcggaagttgactttgaaattcatcaatttgagtcctccgatttttccgaggggcaatatgcaaatcgcacaaaaaaaatgaaatttatcaactcgatttcccctcatttattgactgctactagtagtaccactatagaaaaagatcaggtcagaattattattacagtaaataaaaaagaaaataaatgcaaagatagaagagaatagtagtagtatagtgagtctcgtcgcagtgagagagagagaggagtcgagtagatagatagatagatcggcgtgggagaagacgacatcgccggcgacgagaccagatcgatcgccgaggtatcgcctccctccccgaccgagcagggtcgccgccgttcgttcctcttgctgcttccgccgcatccatcctggtgagcacatcctcccgccaccgccgccgatccccatccatcgcgcgagcgagtcagggtcgccgtcgttcgcccttctgcttccgccgcatccgttttgcgttagcccacgcacttttttttcctcagatttgcgttaaccctagctctagctgctcctgttctagaaatttgccttggccataatactaatagcagtttgtttgttcccaaaaaggcccatgtcccatgttagatccgccgccactgtgctactgatcttctccgaattgtataatttaacgcatatgctcttttgtatctcagcggggactaaaccttgaagcatctgggctgttgtttcaccattgtagtggattccacttcggaactgaacttttctagttgtttccgtgacaatgaaaactcacgagagagctgctaatttggcccttgcaggtatacatttgtattcggctgagtcatcacagcattggttctgtttattaccattttctagtcctttgaacaaactgggtatttgctgagctgcagttctatgtattctaacattgtacgcaggtttgagcttggcaccccttgtggttaaagtagagccaaatgtgaacgtcatattgacagcatgtcttgctgtctatgtgggctgttaccgttctgtcaagccgactccaccctctgtaagcaatatgcttcagtttgttttgttatctaccgagccatctgctgggtgctaatgtgataggttgttcacaaaattttctgcatatggctagaataacttgattcctgcatttgttcttatgtaggagacaatgtccaaggagcatgctatgcggtttcctttggtgggaagtgctatgcttctctctctgttccttctattcaagtttctctcgaaagacttggtcaatgctgttctcactgcctactttttcatccttggcattgccgctctctggtaagtccaaactctccttggaagagctttttcattcatgtaactacttaatactgtatctgtgcaattaagattgttcatgtgcttattttttttctgatgcagtgcaacattgctgccttccataaaacgattccttccaaaagaatggaatgataatgccatcgtttggtgtgctccatttttccactgtatgtctgtaggacccaaacctcttcttttttttttttttgctcaactcattggttcaattgtgtatcatatgccagattgttgcatct

SEQ ID NO: 44040 - DNA, 2008 bp, Oryza sativa
tttctttctgcattcaggtatgcttttgtgttattgtgagatataaggttaatatgcattattgaaataactatggttcaagagcttcacaaatatgttctgttttcctcccaaactttacttggagagaaacctacttgattctctttatcttacagggaattgagatgctatcacttggatcattcaaaactggtgctattctcttggtatgggctgtttgtactgaactgaaacttatattttctggcagaaatcttattactttttttcaccattcttccattaaagccattacttagtagagcatgtcaatacaatttgaattatctgacactgtagaatttatgtttgtctttcatttgcctatgaaattaaaatcctgttatatttgtagaaactattgcactgcttgctgtactttgtaaatcactattaagttgtaacgcttatgtatcacgggatttcctttttgattcaggctggcctctttttctatgatattttctgggttttcttcactcctgttatggtcagtgttgcaaaatcatttgatgcaccgataaaggttagtgttctttataagtgattttgactcttgttttgatacaaaatgtctttttctttttacaaaaaaaggctaatctggttatccccttttttctgcatagcttctatttccaacaggagatgctgcacgcccattctctatgcttgggcttggtgacattgtgatacctggttagtaatgaaatctttagaatgtttagtgctattttttttctggtctatgatttctgattggataccgatgactgatgaatgccatatgagagtgacaacttgtttgaagtcatgatccatagcaagttgttagaactggattatttgataaaaaaatatccaatttaaaaattgtatatgtttaccatatcatttgagtacctttttctgtggttctaaatgtagatatagttagggttctttttgctgatacaaggagtgtaggttcaagtcttgcagaaaataattttaacttaaactactttgttatccagatgagtgcaacaagattagcttcaaagttcgaactacttggttgttgtataatgagggtatatgttgatattacttggttatagttgactttgaagccctggcaatgattcgtcatttttattccagtgataatttatgttagttgggaggtgtgtgtgcatgccttttttgaatgatgcgttgaactcattgttatctttagtagcactgaagtgggagtaacatttgatgctagtcgccacagataattcatcttctcttagcattctctgcaattcttcatccttcatgattgaagatcatgaaattctcacatatttctgcaagcagcaactcttctattaacaaataatactcacttctacttttgtttccaggtatatttgttgcgctagcactgcggtttgatgtctcaagaggaattaagaaccgctacttcaatagtgcatttttgggttatacggtgggtttgaccgtgacgataattgtgatgaactggtttcaagccgcacaggtgagtcatgttacttgggattcttgccatcatgtttcctccactcattttcaaggcacatcataagagtgagtttagttcgtagattatttaaacaaaatgaattgttatacatacattaattaaacaaaggtaattgtggtggtgaatttgcaaccatgtaacctccacacattttttacgaatcatccccaatatttcatcaggaacatgcttgaggaccttttttttttcatttttgtctgtagcaaattcatgcattttgtgagtagcacaaagaaaactataaacctataaaccttatgaagggaaaaataaaaaaaaaagaaaacaagaaaattacatcaggatccaactgttactcttgttactccaattataaaaaggagaaagttgcatctgatttgtgtcatctctgaaatattaacgcactct

SEQ ID NO: 44041 - DNA, 1707 bp, Oryza sativa
ctcggtgaggcatccctcccctcttttccctttcctctcctcctagtgccgcgccgccgcttcaagtcgcgcgccgtcgccttcggccgccgccaccgcctcccatgccgccggtcgccgccgtcgtcggccgcgtgccgtcaccgctagccctggccggccggtcggctttgatgccgagccgagcccggcggccgcctccatcgccgcccgtccgatcggccccgagggcgatctgggccgtcggttccgtggaccggcggtggaccacccgcgtggtcctggtccacggtgaaccgccctcccccttgagtcgctgaccggtgggccccgcgtgccggcgccccttcctccctctcccgagccgctgaccggtgggccccgcatgtcggcgccgctttcccccgtgctgacgtcagccctggaaaatattgcgcaataaattatttaaggattttgttatagtaataaacacagtgaatcttctaaaattcataactaattcatccgagctccgtttcagcccattcaagtctcagtaaatcaagaaaaatgtgtagaatccattaaaaatggttttgttccctgtttcagtagtcttatagcctgtttgcaatgtttgctttgtatgtcgctagattccggttcctccgacgctccggtgtacttcgaaatagtcgccgaggttcctccagcagcagagcaaggcaagtcatgcttgtcacttgaacatgttgatcctatattgcaaatgctctattgttttctttcaaatactgcattgttttataatgtttctaggggatgtttacctattgtcatagccatgctattgttgtaccttgtccctttgtcagcttggggttataacatgattagagtttggactagggattgcttagccatgcttagttcaactagttcaatggggaagatcttattaatgtttagactgttggttctaatggttttgttggattagtgccaccgctttggtgctggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgcagctttcctctagccgacgcatccaggcaagggtgggcgtgaaggagtttggatgggccctgctacggcctatacggcttccgagattcacctaggcacgagaggggcctgcccgctgccttgcgaggagtgggggtgaaacatgaggtgtggtgtgcttggttagagggggttatgcgaaaggtcctgtcatggcctctctccggtatgtcgtggtggcatgtcggcgcacgaaaacgtgtcgtggggctgtgtcttgtgggtacagttgtacacctctgatcagagtaaaactattggaatagtcgtgcccgcggttatgggcggtcaaccagattcaccgtgattagtctcaccctagtgtaatcttttgaatttggatagtttgggtggatggttgggcctgttgcaacgtgggatggcgttggtcagtggatagtcaatactaattaattattacaactgtgtaaatcattcaacttctgtttataaatgctcgttatatgcaaatgaaccactatagctcttcttttagtattccctgcatcataccccta

SEQ ID NO: 44042 - DNA, 12759 bp, Oryza sativa
tgtcagaatcaggtgatgttttttctgaatattttaacttggacgacgtggacatatatgggatgtacattttctatccaactgtagtttatatgtttccacgtaggttgcagtttccactagacattctctcttttaaatctgctctccatagtgtaagatttgttgaatccatgcaaaaatgatgtgatggcaagtgcttttttctttttgacaaggtcgtacctgaagcaactgttttgtttaaattatccctacttgtgcaaaaataactactccctctgtccaaaaagaatcaaccactatcatgagcatgtttttgtttggaagtagtatcttgttggatggtcaaaagaagagtcacattttctgaaggcgtaatgacaaattgggactgtatccgtcaacacatgtctgcttaaacttgcgtcttgtactactgtccgatggacattgtcaacctcaatttattcagtcgaatgagtttcttgggtgaaatttcttccaattaaaaaatgttaccacatctgtaccagaatataactttttcagacatttctagctcatatttttatacgaaggttagtataatttgacccatttgatagtaataaagttataagtgtgatatttcaaaatttctcctagtataagataaaagggaaactattttaaactcttgaggggacatcccctcgttatttgcatgtcacctaaatagttatgatttttttaaaaaaaatcaacaagattgattaatatgtgataaatcgctccacaaacatgcaatgtcaaaattaacttctacaggttgcaacgaaaaacaaatttgactgcgaatatacattaactagccacaatttaattttttttccgttgcaacttgtagaagttaaattttaacttacatatttgtgaagtgatttttcatatattaatctatcttgttgattttttatatttttttctcgtaaccatttaggtgacatgcaaacaacaagaggatatccatcgagaatttagaatccactaccaataaattagtgatatgcttaataggattaaaaaaggaggcaacaacaacaaagccatactacatcacctgcaggaggaggaggaagatggttgtaaccttctatcaatgttgtattgtgtagtcaaggttgtcaatagctagattttggataagttgtgttaatctttcaatttcatgggaaaggtgttaacagtgaaatttggtaatcggcaaagacgtcatcggcttagaatcattatcggctgcagcatctcggaatcagccgatgggagttatcaagtcgccaatagtcggattcctgctatattcggttaaggaaatcaatctattaaaggaagcttatccctaagtgaccgagtttaaagaggatgcggcgtggcaagttatctattaattagaaatagtttgttagtttccttttatctttaggaaagtgtgtttagtgtccaataaggactttatgttttccttttatctttaggttagtttctttcttgtccgacaaggacttgtatcaacccacgggtataaatatgtacacccggggcctatgtaatctatcctcacgatcaatacaattcgtcgcattgccaccccttttaccttttctactttattttattgtccggcgggacttggcacctgacgcggggctgcatcgatgttcgatctccagcgaaggggtaagtccaatgttccgtcggcccaagcaattgtctcatctatatcggcgtcgttcaaggctgcatcagtacattcgacctcttggattgctctggtttcgatgatatatttgcctacctatttatcatatgtctctgttaatctagtcttagcatatcaatttagctctatcggttgcttctcgttttagggtttctgccggtatcggctaaatcgtgttgctagattagattagcttagacatctaccactctgaaaacttagtcaacggcttgattgtctagatattatgtttcttttcatacttagtgctgcatcagttgagtttgatctactaagtcgtgtttagaaccataatctctagcctgctttttgactgccaataagggtttcatcggggtttgagccgatgagttatctggacgttgcatcggctcataatgattgtatatacatataagttggatttagccgatgacaacagaggtttcactgtttaatataatcttgtggatttcatgacatcggacctccagccgatatatgctttaaccttcggatcgatgcttatttatcatatcaatgctagccgattggtttatactggactatattattgttatattttattatcagtagccgattgcctatataacattatttactaaagtgttagaatctacattggacatatagccgattgctctaaaccctatcgctatcggctggtatcagcatcggctattattggcgattagctataactactccatcggcttgttagccgatcggctgctttgatctactatttgcatatctggttaggtgctggatcaaattgactggaaccccacatctcatcaagatgtgtacctgcacaggagctaaacagatctcccaggtcagtgcgcgattttttcgtcaacaaaaaggcatctttgccctaatcttaataaaaaccaattttctaatggtattcgtctaatctgtcagttcaatagcaagtataatgggtttcaaccgtttttgatggagatatgcaattacacattgggcctgttgagattgttgcaattttaagacataacattgttcggtaaaattgacaaatatattattgcattgaaaattttggcaacaacacataatcctaatttaccaaattgacaatattactaacttgattttaacagtaatctgaacaaccctttatttgtgatggcaaatccacgaaaccggttcaaactaatgccaaactaggagtatctaattgggccgattaaaaaagtaggtccacatgtcagctgccggggaggccacgcccagtaaacgggtcccgaccagccgcgagcggggagccacgccacccaaccaatcccaccacttcacgccgtgggacgatctccgccgtcggatcgatcccacggacggccgcaactcccccagcacagagaccaccgcgattggttggggcatccacgtgtcgtgctcggactggtccaggtcagactcatgacgtcccggccaacgcgacgggggcgcaactagatctcggcccgttcaagtcatctccccttataaatcgcccacgaacccataaaactcaaactcacttgaaggttttcggatcgcaacccaaactcgcacaagggagaagagaagagaagcttcgagagagaggtggaggaggagacgagcgcgtggtggtggtggtgttggcggcgatggatcgggttcgcggatgcgcgttcctgctcggcgtcctgctcgcaggtgcgatctccccgttcctcgtttggatctgtgcttgcgcgcgcttagatttgtctatttgatgttgtgctggagttcgatctaagatgggctgtgaatgttcgttccactggatcacggatccgggagtagtttttttttttctcaacgagatggtccggtaaatggttttagagtgacactgatggatcgtatggatcgtggtagttagttaggagatatttgatatttgttttttttgtactacttcacaaattgaggtgcgattaaacttagatgccaccaataggtgaaggcggcgagtctggcgactccaagaaatatgtgatctggggtttatttatgatttatcctagtagtgctcagtgattttgttggaattcgtttgttagatactggtttaattgcagtgatgccatgatctgtcctgtgcattggtagcggtagagtttttaccttcacaattatgctgaatatgctagtagtaaaatatttctagggcaacactgaatagtttagaggcgcaaaatgtgctagaatggcatgaatgaaacgggctgcctagattttcaccttagaaacttacttggtctcataattcatgttactgttttaaaatcacatgaattatatgcctgtgtatatgtgtgccaatacacgataaatggtgaattgatagaacatgtagcttacatactgccactgctcctctgtttgcaggatccctgtttgcattttctgttgcgaaggaggagaccaagaagctcggtaccgtgatcggtattgatcttggtacaacctactcgtgtgtcggtgtgtacaagaatggtcatgtcgagattatcgccaatgaccagggtaaccgtatcacaccctcatgggttgcattcaccgatagcgagaggctcatcggtgaggctgccaagaaccaggcagctgtgaacccagagaggaccatcttcgatgtcaaacgtctcattggaagaaagtaatggcactttaccctatgctcgctcttatttcctgttgttgatcactgctgctgatctgacctgtataattattcttgcaggtttgaagacaaggaagttcagagggacatgaaacttgtcccctacaagattgtgaacaaggacggtaagccctacattcaggtcaagatcaaggatggagagaacaaggtcttcagccctgaggaggtcagtgctatgatccttggaaagatgaaggagactgctgaggcataccttggcaagaagatcaacgatgctgtcgtgactgttcctggttagtaatgacaagacattcatgtgcttagttaactcaagcggtgattctgtggaagccattgctcacttctgctctttcatgttttcagcgtacttcaatgacgcgcagaggcaggcaaccaaggatgccggtgtcattgctggcctgaatgttgctaggatcatcaatgagccaactgctgctgctattgcgtacggtttggacaagaagggtggtgagaagaacatccttgtctttgaccttggtggtgggacattcgatgtcagtatcttgaccattgacaacggtgtgtttgaggtgttggccaccaatggtgacactcatcttggaggtatgactgcttttatttgcccttaggtactaaatatctgcttctgtacaacatcacagttgtagagtactgtagtttgattcaatgattttcatgcaacacatcatggtaaattggttatcttatacctgcacattctcattagacttttcagtaaaggcacgctgtcttttagaagattggcactattcatttgcttttaaactaatgacatgccttttgtagttagttggtcgtcttgattatctggatagtgcactgtgattcatatttgactgaactgtctcatctcttcaggtgaggactttgaccagagaatcatggagtacttcatcaagttgatcaagaagaagtacagcaaggacatcagcaaggacaaccgtgctcttggaaagctgaggagggaagctgagcgtgccaagagggccctcagcaaccagcaccaggtccgtgttgagattgagtccctctttgacgggaccgatttctcggagccgctgacccgtgccagatttgaggagttgaacaatgatctgttccgcaagaccatgggacctgtcaagaaggctatggacgatgctggccttgagaagagccagattcatgagattgttcttgtcggtggtagcaccaggattcccaaggttcagcagctcctcagagactacttcgagggcaaggagcccaacaagggtgtcaaccctgatgaggctgttgcctatggtgctgcggttcagggaagcattctcagcggcgagggcggtgacgaaaccaaaggttcgaccttgatcacatacatagtcctttgggttggtaacaactgcgatcatctgtcttgcatatacttatcgtgctttgattttggtacgcagatatccttctcctggatgtggcaccccttaccctcggtatcgagactgtcggtggagtcatgaccaagttgatccccaggaacaccgtcatcccaccaagaagtcccaggtgttcaccacctaccaggatcagcagacaaccgtctccatccaggtaacagacataagcaaactttcttctttgagtcctgacattacatcctggtcagaaaatttcagctcagaccacctaacgcctctgaatctcgccttgtggtgtaggtctttgagggtgagcgcagcatgaccaaggactgccgtcttctcggcaagttcgacctatctggcattccagcagcaccaaggtttgctcatgtccagaaaaaaatgttagcttactcaaatggataaatgaatccagcgcctgatatctgttggttaaacttgcaggggcaccccccagattgacgtgaccttcgaggtggacgccaacggcatcctgaacgtgaaggctgaggacaagggcaccggcaagtcggagaagatcacgatcacgaacgagaaggggcgcctgagccaggaggagatcgaccggatggtgcgcgaggcggaggagtttgcggaggaggacaagaaggtgaaggagcggatcgacgcccgcaaccagctcgagacctacgtgtacaacatgaagaacaccgtcggcgacaaggacaagctggcggacaagttggagagcgagaagaaggagaaggtgaaggaggccctcaaggaggccctcgagtggctggacgagaaccagaccgccgagaaggaggagtactaggagaagctcaaggaggtagaggccgtttgcaaccccatcatctccgctgtctaccagaggaccggtggcgccccgggtggcggcgccgacggcgagggcggcgtcgacgacgagcatgacgagctgtagatgatgatgatgatgatctgattcgattgattcaaaggagacagccaatttttgtaagagatggccggttacttttagtggggtgacttactactaccttgggttggggtttaggggtagcaagaggggagagttttatttgcagaacaccagaaaagagactaaatctctcctcttgttacttgtgttgctctcttagtttgttactctgtcgagtgtagaacagctcttccttttgctacttccttctgatttccatgtgaactgtgaagaagaagaagaaacataagtaaattttaattactatgtctcctgtcctgtggcctgcttactgttactcgtagttctaaatactgcctgcaaccataatcttgtagtagctagcttctgcttcgataaccataaaagtcatagggacctaatccatatattagtgtagaggacgataattaggtcttactttttagtttttatcatcagcaactttccagttactgaaccgaggaggcttccaagaaccacatcaactgcatctattttgcccgatcaaacatggggattccttgcctgtcgagtgtgaagcagatcattgcaacttgcacttgtgtttaggtgatcatcgtatcaattaattttcaggctcaccaaatattacttaaaggccgagcttccttataaaaaataaaagtcagcgagatgattttcattggcgataacgcggggtcggagaagaaaactccgaccctctttgagttgcctacgcagtatatagttggttgcatttaggatttaacaacacgtacatatgagcgtatgtagcttgccattgcaattgcagccctctcttctcggcattgcatctgaaacatccatcggtaaggtgcttatttgaacttggccggtctgaagttgtcaagactgaacttgcacgtgaactttttccagtttagatgggccgggccaaatttactttaggcttagttttctctcaaaacaaaaattagtcagtgggaagatatcaaagaaaaaataatgggattcaaaggaggttggagaataaaactccgaactcctttggatatctgattacttccatttaatcagcatgtagatctctcgatcgattctgtacttgaagcttcctgcacgcatccatgaccgtcgtgtatggataggagttcggagaagaaaactccgaccccctttgatctccgatcaaagttgtacggtcaagattagatggatgaacacattggtgtagacgcaatttcacgttactgttttagttggaacttgcagtcaatcgatcgatcagtcagcagcaagcatgcatccatgcatgatcttgaggtacataggggtgtttgggaactagggactaaatttagtccctctcacaaaagtataagtctctatggtagagatttatatttttgtgagagggactaaagtttagtcccactttagcccctccaaccaaacaccatcgtatactgaacatagcaaagtcaattaaagttgcagagtatatctggttgtgtgctctaaaggaaaatggagattccatgcctctcgagtgtgaagcagatcattgcaacttgctattgtgttaggacacagcagaatatctattaggcacaaaggtgtctcaaagtttccggctttgatcgagccactagttcatattgctgcttttgtgcctgaatttaaacgggcctaatttaccttcctttcaaaaaagaaagaaaaaaagccagtgggaagatcacaaattgaaaaattgggggatgcaagagggttcggagaagaaaactccgacccctcttttgggttgcctacgaagcgtatgattattgaattagttccatttagcaacacgttcgtacgcatcatatgtaatctgtgattgcaaccgtttttctgcattacacgattgcctatcaatgcagaaaaagatagtttgaaaaacgaaccgttgatcaggcgcagatttgaactgtaagaaaatgggttggtctgaatttctgaactctggagatatgccatatcgatcagtatgcatggatatggaagctgttgcatgcatacatgcatcgatcttgtgcatatttatttgggcttcgttttttttttctaaaaaaaagtagtggacagttagaagataattttttaaaaaaggaagggggggttcagaccccccttgggcatgctaattcaatctctctatcaattgtgtggttcctactcctgcatgagaagttcagagaggggtggtgtacttcagtgaaaaatggggtagcaagtctgaagtatgtatctgtaccgtctattgatctgattcattctgaacttgaagcctccttcatagcggtgcatacatgctcgtcagtgaatcgtcaggtaggtaaatatattcaccgaaataaacataggcattttggatttcattttattatacatacatgtcacgcatttggaattttatcgggccgaacttactctactgagaggagaaattactgataaaaaaaattggagacccaaggtgttcggagaataaaactccgaaccctcttggaaatctttgtatcttcagttcttcacctacaaaccgagccgtatggatgcatgctgccgattgcaataatcagaacacatcccacatgtatgcacacttccgattgcagacaacatttgcagaaaaaacaagtatgaatatgtatcatctctgtatgcgcagattgaaatgggtcagtctgaagttgtgaactctgaacatgtgtagtatatttttcagatttcagcaaaccccaaacaatacagaacgatacaagatacttattattctgatatatgcgatgctatttatgatcaatctgactagctatgtatattcttgtctcacttaatcgggtgaataataatccacctgggaaaaccgtggaaattcttccacaacccttttttttttttgagaaaattcaatccatagcacaggaaagaaagcggtaccaaaaaatagcacaaaaagtttccgctttcgatctatagcataggccaccgatttttcttcgccttgtaacacttccgtcaaattttgaagtaacggcgttagatcggagtggacaaaattttcgtcggacacatttgcccttcgttccccacgttacccaccaggtcttctcttccgctccctcatggacagtggcgcgcggcgcccgccactgccgagcgagctgcgcgtgcgctcttcaatgatgtgggtgcgtggctcgccgtcgccaccgacgatgaggtggatcccgtctggcactcggcgctgctgatcgagggcaagcctcccacgccggcggccgcttgacgacgatgacgtgggcggccgtagcttcgacgtggatggatgtggcccgtggtggccatactcggcaccgcaaaacagcctctccctcgccacggcgcagcgccgcgccggcttgccactgcttctacgtgacgacgacgacgatgagagcgacggggacgacaatgacggggacgatgacctgccgcttatgcaggcaggttgcagcgcgcgctggcggacgttgggatgattcgcgagcggacgggcgggaagcgcggctccgtcagctcaccgagcatcggcgacacgggcgcggcaacatcgctgagggagaagagcactagctcggggaagaagggtagatgagttttttttcatatcaactcacatgtttggatgacaaatgtgacgggagtgctatgaatcgcaagaaaattggtgccctgtgcttttagtcgaagtggaaaatttgttgtgctattttttttaccgggttttttatgtgctatggatcaaattttttcttttttttttacagactatgaagcaggacttcaagctactgtgagagcacaaggatatgccgtagcatctattgcccattctgaactctgaacctttgagccaccgcttgctttcatggagctcctcaccccgtcaatggcggatgcatggccgccatccagagaaaagcggagacggctttccggtggccggagtggcgccgtcggcgggtggatccacgtgttagcgtatattcgttacagtaatactccccgtcccattataagtgcagccataagtttccgtacctaacgtttgaccattcgtcttatttgaaaaatttataaaaaattttaaaagttaagtcataaatacataaagtactatttatattttatcatctaatctttactattataaaaattaaagatgtttttgccggtattttggtatgtcatccgtatttgagtcggtttttaagttcgttcgcttttcaaaatatagatctgtatttgagtcggattttaaatttttttgcttttagaaatataaaaggagtcgtataagaaatatcttttaaaaaaactcgcatgctaacttgagatgaaagtcagactcctaattgcagttcatgattttctaaaaaaatatccaagcgaattccgaaagtgaatttcatcttaactaaaccgtataacaataataaaattaaaatagcattcacccgttgcaacgcacgagcattttttctagcaacaataaaaatactattaatcataaaaatattttaaataagacggatggtcaaagttagacactaaaacccacatctgcgcttattataggatggagctactctctccatcccataaaaaccaacttagtactggatgtgacatattctagtagtacaaatttagacgtaccttttatccagattcactgtaataggatgtggtatattctattttagattcgtttgtttaggacggagggagtagtacgttatagcggtggggatccaagggggatcggagagtaaaactctgactcgctttgatctccgtgagacgttcgatcgaagttgtacggtgcagattagatgggtgaatacattggtgctgtcgtgggccccgctcttggcaccgcgcttctgggctcccactgtagatgggcctccctagagaaggccatatgaactgtaacgaacagaaagtatacactacagtgctatcactatgcaaagcacgagaatgattctttatcctgttcatttcttgattgcccatcaattctcataatgttacattgttccaatacagtgaactggaagtatatgaaacaatttaaggctgtgagttatcaaaaaaagaaaaaaaaagaaaaaggcagtaatggatgactcaacaacttatacatgactaattaataaagaattggagatgatcagatcgacatgacacccagatctctcagtacataatatgcatatatagtataaactagataagtaccttttctattatatttctaccatatcaatataatttttgggtggttagtttgcaaattgcaatcaagagtactacctgatgtctttttggatcatgttattacgcacccagccgggagagagaaaagcttgctttagtttttgcagtgtgagattgattggctttgttgattgagatatttggtcatttcccactagccatccccaattatttcctgatcaaagcgtacttgatcatcaagaacccttctgttagtgcaaagtatcaggatgagctgggcaaccaaatttggctagtctactgtgttctgatttgaggatgtctgaatctccaactttttcctgaaggaagggattaattaccaaaagtgagggtcatttagttgatgagcagctcatgatgcaggattagcatcagcttagtgtaatttccacacgcaaatgcaatgcaatgccgctctcttggtggggctgcagga

SEQ ID NO: 44043 - DNA, 13554 bp, Oryza sativa
gcatgaacctccagaagatccaacacctcgtccaggcggatcaacaactcttccagacgaacgaacacccccaaagaacggacaagagaaatgcaactgcagaaatttcatctcatttcttgatcacaaggagccaccaaagaagaagcggtccttgagtttgacgccgacaacgccattgagcaactttactgcccttgaaatagaaggacctgtgaggacagtcaggaatggtagtgtcgttgacatatagaactagtgtgtgtaaaaagctgagatgttatatattttggatctgagatatgccatctttcggtcaatctcctcaattttagttgagagaaaatataatcagaggctgcataagatgctatctgtagatttcaagcaaatccggtgatgggaaaaattcatttgaggccagtttggcaactgaaaaactgtatagaaagttattcttgtccttgatggtattttgaatggaggaaatatatacgtctgtttgattaattttttcatgaactttctcttgtcatgcttgatgtgtaccttgtccctgaatctatgtgagcagtcaagtcttcaacttttctgtctaaaccatatgaaatcgcaggtgtctcgattttgaaatgctaaaggaatctgttgtgcacttgtgattgcttgaggtgtactgcacataagagaactataaagcactggatgcagaagtcctttgctgctgggaaaagctcccatttttttgaactgaatttgcaggctatatgtttcaaaaaagaaaaaaaaaggaatttgcaggctcataatacataatccattctagttaaatgtatcagaataaaacaggtcactaacaagttttgtagttgcaacttagcacttattattagtttgagtaattagctgcaatacattatgacatataagaaaatcaagttaacaacgaaataataacaattggaaaaatataaaaaaaaggggggagatggcttttttatttttttttttgaatggaaatggaatattctgaatttctgaattattctcggtagacaggtagcatctttatggatatgatatgcgcgccatttcggctcttctcctccgtccccttcctccgctggattcctccatggcttcctcttccctcccttctagaaccttctaccgccactcgcttccctcctccgcacctccacctccttcgagaggggcctgcgccgccgcatgctgctgcctccgcgcggccgtctcccggcggcgggcagccgcgcagctgctctccgccgccggattcttgatcgccgtctcgccgccttcgctagccgcgcggaggggccgcatggtcgtgtcgctggaggactacgtcacttcacgtacgctcttggtttttttttggtttctgattttgccatcagatttgggataaagcgtgtatttcttgtcaagaacaaaagaaaaggaagaaaaaggcagtaaccacatctaacttgtgctgcaaaagaatcttggatatccaagaaatttcagcttttctagataatctggtggcatgattttatactgtaaatgcagcgtgcttttagatcaatagcattcctgaattctcactgtaaacatcaataacatctgaatttagtttttttccccgagtggtttggttgatttcaaaatgtttgggcacagctgatggcctgaagtactatgatcttgttgaagggaagggtccaactgctgaaaagggctcaactgtgcaggtaatttctcccacctgcacacaattccccattctttcattcctaactgaagtgaaactaatggctatattctcttctcaaggtccattttgattgcatataccgtggcatcaccgctgtgtcaagccgcgaagccaaactactggcagggaaccggagtattgcgcaggttatgaggcaaatcactcctgaagtttgaatgctagtacttttgctctaggacaataagaactaacatgtctgcatctcttcttctagtagccttatgagttcagtgtcggatcgctgcccgggaaagagcgaaagcgggaatttgtagacagtgccaatgggttatactcagcacaggcgtcaccgaaacctcctgccgcaatgtacacaataactgaagggatgaaagtggggggaaaggtatgtacaaggcaaatagccaaagggttgtactcagtggcaggctaagaatgtagcctttgtatctttactttattattgacttggtcatctgttgttctgtattctggtaatgcagaggagagtaattgtccctccagagctcggatatgggaaaaaggggatgaatgagataccggtaacatttcagaatattgaaacagtttctcatgtagtttgatttagtatttaagcacatccaggtactgaagtggtgtagtttgaatccatgcttgtttgcagcctgatgctccttttgaactcgatatagagcttttggaagttgtccctcctgcagagaaatgaccatttttgtttgcaatggatggggaactttcatgaggtattaataggaagtttcacaggttttagtgacaaacgttaatggaattataacattttgttttcttgctgattgttgaacagatatgtaaccaaatatgttcatatgatattttgccgggacatgacttgtttgcccactcacaaggagaaaatagaacaagaagcaaagtcaagtaggtaaaagacatgtactaattttgttattccttatgccgaagcaatattggatcaaaaatattctccacaatgtcgtggagcttgattgattatatggaatggtgatatgatctctctttgtgaactctgcatcctttcgctcaaaggtcctcggggccattgatatcctgaaatgagagaatacattttgtttgagatatatgtttatatttcaaataaaatagtgtttcagtggatgaatagaatgctaaaatttagctcctcatgtaagattgtattgctgtgaattatctacaaattatcctgactgataaatagttatatgtttttctatggccatcccagataaacagtcatatgtgccaaagttagatcatacgatatctgtttttaaactgcaaatttctacatcaatgatattgtgcttcttgggagaaaaagtaccttgttctcgatcactgctccatctgggatttccagtttgacaccaggttgggctgtgatggtcaccttgccctttaaaagataaagagaaaaatatgatttcattgtttaaacactgatcaatgagaagtgaagctgtactctgaattaagattgtgtaaacacagcatataaaaggttgcatacagatatgcagtatttcaaaaatacatgaaaaatagtccaaatattttctgtaagaactataactacaagaaagactataattttaagcaactttggcaaaagtaccttcaatgtgatgctagagccaaaccaaacatcaccggaaaccttcaaggtgtcaagctcaacaatgctggggattgacttgaagcgaccaaggaaacacccgacctgccattacgcgaagaaggatcagttaatttcatttgaactcatgaactaaattaaagcttttgcatgaggaaataatgttggaaggaactataccttcttgaactctggacccagttcaattgagggattcgatgggtttgttctggccgggttgcgtgtaacaaagccatcaaccaaggtatatagatcagactgcaagggtgaaacagttaagttagaatgagtgttaccctaaaaagtttactcagagtgtcatacagacctgtactagctgcaaatctgatgttgccttcactggtaggaaccgggaccttggaacattgataccaattgcgtgatcaaagaactggtacacaaaaatatgacttatcatctttgtatgttaggaaaaagaatgatgatggttatgtagtaatttgttagtaccctgattgctgcaccagctgctgtttccactttaagaactttaactccatccacttcctgaaattatatgttgcacatgtcagttgtttgtttaattcttctcaaatcattggacagtaatagtgcattgttaccttagggtttggaatgatctccatctttagtgcatcagcctcaacaaggcgcttgatagccttcaagttcacccatctaccaaaaccggcagcaacattagataacattgggacaatctcatctaaaatggaataaagactatatatgaatccacttacagattgttcgtgttgaagatcttgaatttctcgatggatttgaattcatgcacctatgtttcagaaaagtgtgaaagcaacctcagataagttctataatatatttagtctaatttgatgtcacaacttaattacattacttacatgtgcatcaggaacttgtgcaatctccaggagctggaaagcaaaaatattatcgtcaccaaaacagcagttacataatggttgaaaattatcctccaaagaaactcaagtctagcacagcaacttgtttatatgttcagtactccaagtaattaaattgcatcattgcggttggtaaaacaaggaagaaccaaagtttacctgaaccttgtcttcatatgagatcagtgtgccacctttaacatcagccagagttttcggggtaacctaaaaatggattttaaaactttactaaccaactatatgtgtagtatcttactcattcgataccacgcaatcacatacctccatgcaatattcattctgtttgtggatcaaatggttcagtatctctgttcaatagttaagtacattcccaaaaagctctcctttcttaaccagaaagtctgtaaagctaatatggtgaattaatggaataactaagaactatatatataaggatactcatgtccactatagcacccaagttatctgagtttgcaatgaacacatactcctttccctgcaaaggataaaaagggtgatattacatgcatgcatgaaaactttgtatgaaatgtgggagctgatagtattcctagatgacaatcacaaacctgtgaaagtaacaaatcaagcttgccactgttcatcagggatgggaagatatcaccatggccaggagggtacctgaaaaaatgtgtaatgcaaaggttgtaaaaaattcaaattattcgcctagttcatcttgctgatgtagcgatctatgaagaatggcttaccagccatccttgcaggtcttccccttggaaggccatggcaagaactcatcggctaccacacgaggatactggctctgcattggatcaaatttgttttggtgtcagtagcattttgtaaaacttggcgaaaacaaggaaattcagcagacatgcctgattgaaagtatggacttcaatgttcgaattggtgtatttctcaacaatctgcaggaaaagcgtgccggttagtactctgaaatttgttcagtcagaaaaggttttgtcaggtaagaagagattgccttcaaggtgtcttcatgggtgttgaatgagttcatcagaagcagtgggacattgctgccatacttcttgttgagggactgcaaaagaaagccatgtcaccgaatgccataatgcagtttgcagcaagatgaatcaacaatggatgaatcttgcgtgaagtttttaggaacccacctcgatctggatcacaatcaagtcgaggaatgtgaatccgttgcgcacttcgatgaccgatctgcgaggccatgagcaacattaattctatgttacattgacatgatgatgatgatgaacaatgtcttcctaataatgtccaaattgagaagagattgatgagaagaaaacacatactttggtccggtgcatcccatggtggtgccgaggccgccgttgagcttgagcacggcgagcttgttgagcagcttcttggtctcctccaagtcctccggcggcgccgccagggtgtcgtacggcaccaccacctcgtccgtcggcgtgtggatctttgcccattccacatgctcctcctcgccactttttttttcattaattttggatcatatcgattcagtaatcagttcatcgtcagatgcatacagttaagtagcagcttgatcagaaatggtcatccatggaggataggatgtgtttacctgaggtagcgggcgacgaggctgatgaacccggacttctcgttgtcactgcacgcatgcaatgatttgattcaaaacccaaaatcgatcagcagatcaaacttgagcgatcagatgaggaattaattcagaattaagagactaatataattacctgatctgcgagaggccggcgacggcttcacgcagcttggcgagcttctcgtccgccatttttgtgttcttgccgctgcttcacgctgatctgatgagacagatgaatcggatcggatcggagaaagctcgatcttgttggtttttataaataaacgagaggaaacgagaggagagctcgcatcgcatgaagaggaaacgaaagcaatggcggacaatgcgcgcgacgcggcgaaaacgcgggagcacccaacgtttttacactttcctcttttgtttgttaccttccatttccctcctttttttttttggacacaggtttcccgggcttttcttagagttatttatttattattactgctatttttaacgaggtatatgcttttgtggtgaagcagcacttctcttctgttcaagcatatcaacatttttcagaattttcttcatttcaaaacattgagcattcattcattcattcattcatcatctaattccaatccaatatcttacaccaattgatcagcacgtcaaaacgtattaagatttcagcatctgtacaaagaattaatattaatgtctaggagtcatccaagatgagaaccaagaccagatttttcctggaatgcgctctccctattgtgtttctaacatttcatctaccatccttaggctctcgttttcttgtaccgacatacacacaaatatggaggtaacattcagggttcttcaggttgttggcaacccaaaggaaaggtatgtccatgtcgacctcaatgccttgcacccttactagcttcactattttacccttgttggccacattcgcctcttgcgggctcgacgaagcagacgactctaacttctcacaacttcttggggtgacatcagaatcatcattaggggctgaatctggtgcctgaggagcagtttcggaatcgtcgggtatacgtgatgccttcgagctgaagaactcaggtagcaaagttttcaacgcatgttccagggtgatgtagcttctacctgcaccaaagaaatgtatcaggaaagcactgctgatactgcaccgtaaaacattctgaatcatagcaccacaatatcaagcataatggtgtaagcattattttttgggggataaccacaaccctttagtgaaaccaaatatttcatagcatctggatctctatccctacaccacacgtttcacaggaatgaggggaaatgaaatgtacaacaatagggcactactactgtctcgaaattataaaagagcgccactacttccaggttggtgaacgaaccctttgaagcatgcaaaaacggtatgcaaaccactcatgaaggacaagtaaacgcttgaccaaatttgttctactgtcatccaaaagatataaatgttaattacaatgctacataccttcctccctccgtacttcgaatggtcggttaatataggatatgctttcccaatcaccaacaggtagtgcatcttctaaatcataaaggtcttcttgaacactgcgcacatataatcgaacaggaaccctgcctaaccagagaataactgataagagccaggatggtagctgattcattgtaacatgttgaaatcacttattatgtgactacaagcacacagaaaatttaaaatgtgaaaactatgcaccaactagctactgtataaaaaacttgtgcatatggagtgtatgtgaatgctcaattaatagtaaaggtagacatattcaatgcagaaaagcatacatggtttgccagatccaggagattcaggctcatcagaaccttgttgaccctctactgaggaagttcgtactaagcaatcctcttcgaatggtccaagcttaagcctggtggagatattcatatacccatctaagttacctaatatcaaaataacacaattctggttaaatgatgaagatacagtattcagagaatgcaccacactcaaatagtaggcaatattagtcagagtgcttgatatgtactaatttacaaacaaccatttcataatgaacttattaagcatggctagtattcaagtgttctttctgaagagcacacctttcattactgattgccacaaagcaccttgatcagcctgagacatattcatcacattcttactgttgccagtgatgatgaaggcagcctgcacaagaaaaaagattactctcgtgatcacactccacttccttgctgcaggaacaaaggattgggtaatggcagatctcataaacaaacctctttcagggaattcatgtagctccactttacactatcttcgccatcacagagagttaaaatttcagaaggatatcccctaaaatgaacctacaattttatgatagaaaagcatcatacaagtcaagcaaggaaataaacaaataaataaatgggaaaatttaaacaactctagacttactgttagattccatggtctttctggatctgcacatagaaggtcgtaaagaactccaatgggtatatacctatagtgcaaaggtaaatcggggagttgggaatttgagagggtagttttgaagataatgttagagccaataaattcatattcataaatattcgacacacttcaacaatatgccactgactttgtcgatatccataatatgccgttgccttttccttaacctctacaatttaccatcgccgtctatagtctgttagtttgcattggagaaaaaacaagtgtgcccttagtgaagattggcagcactgagaccatgtcgtgcaaggtaccgagagttataataactgtttatttatgcaacatgattataaataattacgagcacatattttaagtattttaattatgagcaaatatctccaaggctacaggacaggagggggcagatctttgattgggtgccgatgactgttgaggagcggttgaggattgcactgacgacagaaccagcactccagcagggccagggccaccatgtccccttgcaagcgatggcggcgctgacgacggcggcggcaccagcaacagctctccggcaggggcgttgtgtccccttgtttgcgacggcagcgctaatgacgatggcagcaccaccagcagccctccaacagggacgccatctcccgttagatgtgacgacggctttgacgacaatggtcggaccgccgctgtggatggcggttgggccagcgctacggatggtgacgctggtgacggaggtcgtgccggcgctagggatggcggtgctggcgaggacatgtgagcggcggtaggcggagatgcggcgtggcgccgacgcgccgtggcggcactgggaagggtggcaatgcggcgttgggagatgcgatgctaggaagaaagggccctaggccatgcggattagatgattcaaaggatattttggtcattactaaaaaaattaacagtgcaaacagcgtgtagcttgacggcgatggtaaattgtagaggttaaggaaaaggcgatggcatattatggatatcgacaaagtcagtggcatattgttgaagtgtgtccaactcagtggtactgagtagattctctccataaatattggtaggagataacgtatgttaccattttaagggcagccctttgtattcaaaccaaacagtgtcaataccaggcgggagtgtgctgctaaaatgagcctttataattggtaccaacagtggaagatacccgattcttggccccaaagtctgttattgatgaaacagaactccataagtaaagccgataaggtaatgaagtatcataacataacgtaaattaattattaaaaaagatcactcacataaagggaaagatgagcaatgaacccaccttaacatatatggtgtgtacaaactcaaaagtataacttgcatttgttgcacttggtaaaaacaagggagaacaatgactatatatcatgcagcaactcttttctttacacataatatgtgaacaaaacaagcaagtcatcaattcaccaatcaagtccactgagtcaaaaaaggcaccccctaatattgtacatagacctacaaattcaggaatcctaattaaaactgcaatcaacaacctaagtgctagaacgattgtaatccaaacaggcagcctagtaatccagagaatctgagtactcgggatccaacaactcgtggcaaagatccaagatttggatgggagacctccaattgaagagcatagccacaggccgagaaggagaagacgatgatgggaaaagcatgaggctttaccaggaagggcggaggtggggggagggtggtgacgtcggcgtcgtggaggtggacctggagcggcacggcgccgccccagacccgccgcgccgcctccgccgaccacccggcctagtcgtcgcgctgcgccgccattgccgccggaggagagatctgccgccgccgccgcctaatctttgatggtttttgcttgtcgcaggcagcaaacgactcggatttgatttccccttcttcctctcttcggcaccggtgctgtggctgcatccaccgtccgattctaccttgagattcgtgccaaatccgtgtgtagaaaatctgatttctgattgaactctgtatatatatatatatatatatatatatatatatataaagtgttgtaatttgtgtatggaaaggattacagaacacacacaagaaaaaatccatttaaagcatcagctcaatcaggattaaaacccaacaacgtttctttcatagctctaaactccaaagagaggagaggactggaaagtgtgaagcttcactctactgagcaattgcagtttcatcaacgtcaagtgtgcaagtacaaaatttcttcagtaagtatttaagtgtacttaacagttaactccaccatctcctatcttggttttccataagaagaaaagaattacaggcaacaagagtagctacctagctttttaatgctcctgttctaaatacagcatgccattcatcgtgtttgttcccacacaacatttacagtgcagttgccacaatggtccaagcttcagcatgtcatcaaccatttgcctgcttgaagtgatgcaagatccgtgcagccaagatgtcgacccaagtgtccggcacgccaggaaggcaccaatgcatgcagtcctgcccccatacagccaccgcgtccttctttccgagccagattgccggatgcgcatcggcacggaactcgctcatgtaggtcaggttgagcagctggatgtctgtgccaatcagggcctcctgaatcgccgaattcactagccttgcttctttgttcactcctccaaacctgggatcgaaccacaagtcgagctgcacaagattttgttacagccgcgtcatgattcagaactttaaaatgcatttctgaagcaaaaacagtctgaactcagagcgttacctcgtgttcttgtagaagccgatcagacacgcagctgccattgtgatcccattcacctccatagaagtgcctgggtgactgtgagcgccacagtttcagtgttttacttgggacctccctttcaatgtaagaggccatacttttgaggactactttcaatccatcgtagatgccaagtggcggctcaattggtttccctcctcggtagaaaacaaggggggtctcttttgggaatttatccaggccccacctgataagggacaagcatcaagcattataacaggaatggtgcacgcatggctcctaaccaacctaggaacaaattagaatttacaaagaattttatggagacgcacaagaattttatccaaagaaatttacaaagcaagatgcacaagcatgatctactatgcttagaattttatggagaagcacgcatccaggagatggcatccttggaggaaatttacaatataaaaccaaaagaacattttaaggctgtgcaagaaaggtatgacgagcccacctcccaagtgatgtccagaataaaaagtatgcaatgcttagagtcagagtatcataaggaactatgaacaatttccaaccctactttaagaaaaaggtagcgatgaaacttccactctactttgctagtagtaaacaagacgaatacaacagcaaagcatgcaataagaacttaatgctaaggaaacaattaactcaccaatgtccagtgttgaaaatgagcacatcatagaacctggtgacatttacccattcatcagcaggaatgtcaacatccactctgtaagttccctttattccatccttgtgaagctctttggaattctctacaggctgccaccttcgtatcattagttaccaccatgtgagctttatggttttatcatatgaagcaaagaaagcacaacctcatgcagtataaatgtcaaaatgccatagtcttaagttcaacaattgtagattttaagttcttgaaggaaacagccaaaacacaagaagaacggcatcagaaactgtcaatacatatctaccatatggttatatagttaacagcacaaagtaggataacatataacatatgtttgaacattatcagaacaaattttacacaacaaatagatcataatgcttgggtatttaaatacggtaaatcgtaatttcttcatcacattctatggatctccctgcttactcacccacagtcttatctctaaatcactattagtgcaatgtggataatctcatatttttcagtctggcctcctcacctcaaacctattaatctatgaaagaaagataaccaacgacataagtattgacagcattcagcagacaacatcagatacaatcacagtatgacagtaaccacaccactgcagagtgcagagcacagatactagccatgtcaatgataccaaaatcaagcacaggacatccaaacaaacaagatggaactgatccatattacaacaaaggaatatatgtgacatccatttttctcctgagaatacatccacttcctagttagcatagtggtgtgaaatcactgaattaccaagatcttcctgcaattgcctttttggtatggtataaaaaaaatcatctctatctcatgcatccaattcataagcatacaaagaaaacttaaatctctatagagtatagaccgcatcacattcaatggagaaaattgcatatctaccaatctaccatcacttacagtcttatctctaaaacatcagtactgatgc

SEQ ID NO: 44044 - DNA, 7100 bp, Oryza sativa
ccgtatcctcgagatactttttgttggaccggagcaaatctcctctaaatatgtttgggaaaattcagacattcattcaggaattcagctactctgtacagaaactacagatacaatcacgaccatgaaccaaaaaatatgcatacccctcggtctaaaaaaaactcaattctaactacaaacttcgtagctagatttttttttggacagtgtaatagaggataacaagccaacaacaaaacaaatatattcataatgtaatgttctgttactacaggttaaaggcaattacgcagagcctaattttacagttcaatttctgtgcaatgtccatgctagtcagatgccaacagcaagatcagtttctttctttcagagctgagaatgctcaacccccatctcagacaagcgcgaaagcagcctcctctccagcttcacgccggccaactccgcctccctgatcagcctccggcacctgcccatcctcccctccgccgcgtagcctccgatcaggccgccgtacatgtcgccggtcgggacgaacccggcgtccttcatcctcgccaagtaccggacgcccctctcgtggtcgcgcaacgccacgcacagcttcaccagcacccggtacgccggcaggtcgaggaggccgccggcgtgccgctccatctcccacgccagggacagcgcctcccggtgccgcccgtcgcggcaccggctgtggatcaccgccgtgtacatcaccaccgtgggcctcccgccggtgtccctgaaccagccgaacaggctctccacggcggcgtaccgccggagcttcacgcacaccttcatcacggccgtgcagtcctgctgccgaacgtgcagctccggcctctcgccgagctcgtccagcagcgccgcggcgagcccgtagccctcaggcgtacggacggcctccagcatcagcttcacgtggacgctcgggctcagtgtcctcttgttgatcgtggcgaactcgaggagttttcgggcaaggcctactttacctgccctgatgaacccactgaccatggcttcaagaacagcacggctcgctgaagggacgcactgctctagcgcatcctccatcttcagctggtcgaagcgtgccaagacctcaattgtcgaagcgagaatccggtcgtcggggaagagtggcacgacagtctgcctctgagcccagcaaagtgtctgcaatgccctctctgggagccccatgtgcccaagctcccgaatggtcattgacaaggatcctttccggaggaaccgaacccaccgatcgagcacaatggacacgtcagactccggtggcagcgctgcaatctcccgggcaatcccaatgaggacctccgggttcttgcacacctggtcactgaatgaagagcgtgaagaaagtgcagcccttgctgccagcctgatatgctgctttggtgcaggagcattgggcagtcgtgtcttgtgaggcagtggcagcgggagaggtcgctgcctcaccgggtttggcggctttggtggcttctggcgcatcggccggtcaaagagtgccgagatggcatcaagctcatctttgctccactctacagcctcttcctcatcatcgtcctcatcctcagaagcagaagaattctcatggtatgtctgctcattgcggtccattacctccaactccatgacagaacccccattcgatggctctgtgcaagaaattcgacttgttgatgggagattgccatctctgcagagccaccaagctctggtcttcgccgaggccgtgcaaattccatacagtgcagggagcggccggttaaccagtgacatgcttcctgttttaagattaggcaaaatgttgttacttagaacaatattgattccagatagtagcatgataaagcaaaaggttgcaagtcagcatgtataataagcataaatatactactagtatgaattagaagttcataagagcctctcttatgttcccatcacagccacctgcacaaatatagaagtttgcctcaaaaactaacagacaacataaactactggatttagcacgaggggtgtttctaatatgcaaaccaacagttaggtcacaaagtagcgggaggattttgttgtccttactatttgtatttataattacaaaaaaacactaattggtaaattcccaagaacaacttccaactcaggttttcggcttaaaagtttcctgaaatcaggaattttctaaacatgtactggactttctttttgagcaatttccaaataaaatttcagtgcaaaaacaaattcagatttcagcttagcaaatcagtgattcctactcaggatcagaattgtttgacttcgaaacagagattttatactaaaaaaaattatagggctttcaaatcaagccagctttccaatgtgaaattttttacttttgccttgcaggtttcggaagctttgaaattgccatcatccccaccggattgcaaacatgtttataagagaggctctttgctttcgtttgaacagcgtgaagggaattgttcagaacgaatttgagatgactcgtttcaactgcagttgaaccccaaattccaaaatgaaacgcagagaacaaaacatgcaatcaagtttcatgaaatttcgccaaaaaatacgaatttttctatccgcacgttcccatatcaactcatgcagtgtgtaacttgacaggtcaagaattcctatgcatacaaattagaagcactttgggcattctattcgctcagcaatacgcttgagaacaaacagcacaaatgatgaattagaacagcactaatgatgggaaatacacacacaattagggaaccatggggggaattagagattgcttggcagagactggatttcacctgtgctttgtcgccagatggttctcttcccccgccccggcgaacggcgcgagcaagctcactggctggtataggttgctgacagctgcgctctccctggctggtctctactctgccacacgcagcggctgcagactccagcgcggcctttcttcgcgccgctctgagcagccgagtcgccggcgaggccgccacgcgtgtgcggcggcgccgacctgggctcctggatgagatgccgtcaaaaaatgcagaaatacagttcaaatcagggagcaaaatgcaaaaaatatccatattgggccctcgtggcaaaatgtcgtatcacggcccaaaaaatattgtcctagacttgggccatttgttcggcacacggcccacttaggcccaacaagtcaccctcgtcgtcttctccgatatttaattgtgcagctaattcagctgggagtagtagcctagtaggagtattaactgatcggcgatgacctgacgaaggctgtgtttagtttagcgcaaagtttgaattttggttgaaattggagatgatgtgactgaaaaatgaaaaattatgtgtgtatgataagttgatgtgataaaaaagactgaagtttggatccaaactttaaatctaaacacagccgaagaagaagacgacggaagctaagctagaatgtcacatcacgatgcgtgcttgctactcactgggcttgcctgccgtgcgccgccgtgtcaccagctgccgggcgatggtggaggaggagggccttggccttggaccaggacgcgaggaagcgaagcggagctcgacggcggcctctgggccggactcggcgaccaggaggaaggaagttggtgacgacgtggagtctgctcgccgctcactgcctgagtccgcctcggcgccatgctcggccgcgttgccctcagagccagctgccagccgtcgccgccttgaagcggatggagggatatgtattaggttagggtttttgttgttgttgatgtgtgtgtctatatatatatatatatatatatatatatatatatatatatatatatatatatatatatatatatatgtatatatacatatgtatatatatgtatatgtatgtatatatatatatgtatgtatgtatgtatgtagggatggcaattttacccatgtgtccggggtattcatgtggacacgtccgtccgaaaccgaaagcgcagtgggcaaaaattgggaatcaatttttaccaacgggtaacccatgcctggcccaatagttttgacacaagcaaacttcttgtcaccgacgataattactaggtcggttttttcttggacattaattaagataaggctcgcatagcccgttatcaacgtcgcaacatgtgcaatatatatactctaggtattttttttcttggaaattaattgagattaagctcacatagccagtcatcaacgtcgcgacatgtgcaatatatatactctagatattatatcattacacatatggttctaccgagcctaaccttactagaaattacgttgagtatttcggcttagtagcaatggtacattttttttatagagctcttactaaattctatatgcaggcaatactagttaatgttttcgattttgggtccaactaaaatatgatgaagataataagctcctacattttgcatttaaagacaacggttttataaatttttatcaacctatagatgaagatttagcagtaaaattattagttgccgaatatgtttttttccggcgtctatcttttcatcatacttttttttatcatttgcatttagtttatcaaagaattttgtaataagcggctataacttctattggggttgtttgacaagcggttttactgttgctgcagtcgattgctgccctgtcctggcacggcccaagatataatcctacagactggacccacttctcgccaaatcggcccacttaggcccactcatttctttcctcttcttcctcctcagtaccgacattattattgagcgtcactcgtacgctccctttgcttgtcgtccttctcgtcttcgtcttcttctccaatcgatttaattaattaattatcaagccattaactgatcgaggatgacctgacgatgaagaagaagacggaagctaattaaggctttgtttagatctaaacttcagtcttttttatcatattaaactgtcatgtacatataacttttcaatcacatcatctccaatttcaaaagtagccagccctcagcaagaaggtcacatcacgatgcatacctggtcaaagtcaaaccaaagatggataacacagtaccgctccctccatttcattttatatcggaagtcgtttgatttttttcttattaatcaagctttattaaatttgatcatgtttattgaaaaatttagcaacatctaaaatattaaattagttatattttgataatatatttgttttgtgttaaaaaatattactatattttctataaatttagtcaaacttaaataaatttggctgagagaaaagtcaaacgacttgtaatataaaatagatggaatagtaactaaaactaattaattccaaaaggttaattagcacggttaatcaccggattaatgaagaaggaagatacagaggcagtgacagttaatagcaattaatctccacttcaatgcgtatacataatgcacagacatgttgacgatttccatggttttgacctctggtataaatcctaactccttgtcgctgacgaggtaattgttcttggatattagttgataattaagattaagatcgcatagccagtcatcgacacagcatgtgcaacatctacaaaatactagtaattcagtacacacacaatcatgacaccaaaaacctaaccttacgagtattatacaattaagaactcattttctttctttaattaatcttgatcactttagctcgatcgatcccagcatcatcaatctgcatgcgtaagcagcgttgctgacgacatatataaattagcttagattagctaagttgaaacgcaaatgtacctaccagtccaccactcatccatcaggctgcacccaatgtctgaatcaaacagtactttttttttttcatttccaagttgctggttggttgattgactttgactgacacgtaagtgatcgcaatgggtttaagaaattcaagccactgatcacacggcaggacacgttttcaccacacaaattcactctctcaatctctgaattaatgagctgtataatcagatgtaacagtttttcttctaacagctggagctagtagtaattaactgctctgccgtttgtcttgagctagctggccttctcgtcagattctgattagttagttccaagtatggggtgtaaagtttcagtttgtcacatcaaatattaattatattatatagggtgtcgcataaggtgtttaggcactaaaaaaactaattacagacttcgttagtaaactgagagacaaatttattaagcctaattaatatgttattagcaaatatttactgtagcaccatattatcaaatcatggagcaattaggctcaaaagattcgtcacgcaaattagacgcaatctgtataattagttatttttagcctatatttcatactttatgcaggtgttcaaacgttcgatatgataggtgtaaaatttttgcgtgggatgtaaaagggcctaaatcgattcttgcagctaatttacaactaataaactgttacttcttgattgtttctgcaggagaaggaacaggagacacgtagctgcgcatgcagatacgacgactagttcttcttggatagtaatccaaagggggagtatgtaaaattagttttgttcctggaatcttggcgcatttcaaattgaatacagtttgaatattttaaaacacaaagtgattcggattgtgattgattccatgcgccaactgatgaacactagcagttcttaagcttgacggttttgtttaaatttgtgtacccctagccccaatagaattagacttcaagctgtattaattcaaactggaatgcgccaagatatataacatgaactctgtttggctgttgtgcttgcgctagtgtgcttttaacttttaattgtgttgatcaattgtctcaccaactatattgttgtacctttattattgcctccgtt

SEQ ID NO: 44045 - DNA, 1234 bp, Oryza sativa
tttattatgtcactaatttctactaatcttgtttttatcacatatttttttgtcagagagctcttccactttattgttcaaaacaatataatatcaggaaatatttgatagccatgatgcaaagcaaatattactccgtggtccgctaatttatcaggtttgccggttcaaaattggtgtatgagaattccaatctttggttgaagaaaaaaactctcttcaggatttgtacggtttcctgccgatcaaagttattacaacaggggtttctcaaaaaaaaaagttgttacaacagggaaaaaaagggacacagtacagaattccttacatgtgactgttcatcctaatgtttgcatgagtgcaacaaaaactagcattcatgagcccatatccttgataacgattatctaaaaaaaatatccttgataacgactgagaaaattgactgacagcaaaagtggagaatattttaattttttttactggttgatccaagctagcccattcaactcaaaagctattccttaaatgatgaagatttcctttaaataaaagttgaagtgatggaagcactaaatcccattcatcacaagaaaaataatgcttctatatgtgttgcacaaaatgcatgtttttggcaactagcaaactagagtgagtgctctatcacctgcaatacagatatataatagctgatacttaatgttgacttaccctaaaagtgacaacttgcaaaagtgctccattgatctatatatttatgtgcatgatttttacgatgataagtactacctccatcccagaatacttgtcaaaagttttcctattttaccctcaataaccattccacttctcatcatatattatttaataaggggtattatagacttttgtattaaaccttaatagtatattctaaacaaattgtgggatggagggagtatataagaaaagaatgatggaacatatgaagtgcgaaaagaaatctgatagtaatttctgaatcgattgtggggttgacaaaacatttcgacatacttgacattttagcatttttttttccgaatcgattgttgggttgacaaaaccacgagctacttgcagaaaggccacaaatcgcatcagcatgcttacttgcttaagtactgatggattacaggtagatgccatggtagtgctgagaaaatgccaacttttcccttttttttcacttttcactttatgcacagaaata

SEQ ID NO: 44046 - DNA, 707 bp, Oryza sativa
tattattttattctcttctcttgtttcttgtactagcatatgctactattgttagggccccattgatttataggaaaaatataggaattttggaggattttaaccctatgaaaaaaaaaatcctatgaaggcctttgaaacaaaggattaaatcatatccaatcctttaaagttcctatgaaatggggtaatcctatgcacattttagagaaaagttagcaagaggtctaacctcttggaacatttcctctgagtctatctctctcatctgattcctgcgtttttcctgtggtccaatcaaacggtcattcctgtgttttgcaatcctctgttttacaattgtatttttgtcagaatcctgtgtttttcctattcctattattttttcattcctacgattcaaaggagcccttaatttgttactgtaaaatttgtgctctacttactcttcttatttcatcagagggcatttacacaccggtaattgataattcagcattccaatttcgctatatttatcttcaaggaaaaaaatattcctgcgcttcaaacaagttcttacaagttacaagaaacagctaatgatcactgaagaatgagcactgctcaagatagaatcatgtaaggaacaaaccatgcacgcaatagaaggagagatattttttggtgctgctgattgatgatcttatctcacatcatgcgctggg

SEQ ID NO: 44047 - DNA, 9411 bp, Oryza sativa
ctgcaaatttgtagtactacgactataattttcagtttgttcgctagtctgtcagataattgtaccttcttaatttgctgggttttgtataaatggagtacacatctgagatgcgcacattttcctcgaattaatcttgtttatgtcacttcatcttaagcaactttcccctcaaaaaaaaaaagaaagaaaaaagcttgtgcccaccacagcacacctatcgttatcatcagcgtggactaagaacagaacaatttctcatcttttgtttcctgagaagtttagaccaccaagatatatgctgatgatgctgtagatagctagctagttttgcaattacttatgggttgcatcacaatcagggtctgtttagttcccaaacaaaatttttcacgctgttacataggatgtttggacacatgcatagagtactaaatgtagaaaaaaaacaattaaacatttcgccttgaaattacgagacaaatcttttaagcctaattgcgccatgatttgacaatttggtgctacaataaatatttgctaataatagattaattaggcttaataaattcgtcttgcagtttccagacggaatctgtaatttattttatgagatacagctgcttcgatcttccatcacatattcagaccgtacctaatctgaaaggttagtaatttgaactgcgtagtaatgctacaaggtaaatcaatcatcatcatcttgaattggttcctcttatagcactaggtaaaaagacaagggtgcattctggctgggctgtgttcgataaaggagtttgactgagctagttagtggcatgaaaaccggaacaggtgaatagtacatgataaactcagtattacctattataaacttgaaaactaaatttatttaaaattttaaagactagcaaagtaacgtgctctgcaacggacggattttaaaagatttatgtgaatttcttgatttagaaattgtatttgtcaaacataattgcaatcaaacatccaatagaaaaccaaaccacacacaaagatgtatttatgtagcattagaagatctcaccaactctaaatgatggtagattcaccatcaccattaaattcttttatatagtataaaaagattttgtacgaaacacactgtttatagcttacagtttgagaaacgtgtatgtttatgataaacgagggtgtagctgagccatagctagctagcacaaagagcacctcgttcttacagaataattaagcagcctgaaattaatctgagaaacaagaaagaaaatgcagagacgttagctgcaactgcaagcatgtcaaactttggccgaccgatcaagagaaaggggatgagctaagctatcgatggcagcaattcggcgccgttgaaatcaatcgaagagatatgatccgatgatctgatctgatctgacgatggacatgcagtgatggcacgcagctagtgagcactgatgaagtgatgacactccatgcatccaatccaggcaatgcatgtatttcctttccacacgaggggggcccacatccacctcaccttatcctcgtccagttcctgtgggacccaaccatgcagtatggccacccgggcccaccagtcagtgtgtggcaccggtctccggtaagctcaccggggaggtcagtgctcctcaccacctcccgctatataacctttaggcaggctgtctcaccgagcaagctggagagctagcagaaacaaacccctctcactcccagatacctgctgctgccactagcccactaccatggatccttgcaaggtcagtcactcagtgactagtgagactaaatctacttaatcttgtagttaataattgaggtttcatttagctagttgtgtagattcaagagagagcttaacttcttatagaatatttggtcgattatcagaaacttcctgaaataacctagattatcgactagattctacgaatatttcttttttagtctcaagctcttcaaacatgcatggctggttgattcagctagtcgatcattaagtatataattaattaattaattaatagtaatacgtgctacccatgcagttccggccgtcgagctcgttcgacacgaagacgacgacgacgaacgcgggagctccggtgtggaacgacaacgaggcgctgacagtggggcccagggggccgatcctcctcgaggactaccacctgatcgagaaggtggcgcacttcgcccgggagcgcatccggaagcgcgtggtccacgcccgcggcgcctccgccaagggcttcttcgagtgcacccacgacgtcaccgacatcacctgcgccgacttcctccggtccccgggcgcccagacccccgtcatcgtccgcttctccaccgtcatccacgagcgcggcagcccggagacgatccgcgacccgcgcgggttcgccgtcaagttctacacccgcgagggcaactgggacctcctcggcaacaacttccccgtcttcttcatccgcgacggcatcaagttccccgacgtcatccacgccttcaagcccaacccgcgctcccatgtccaggagtactggagggtcttcgacttcttgtcccaccaccccgagagcctccacaccttcttcttcctcttcgacgacgtcggcatccccaccgattaccgccacatggacggcttcggcgtcaacacctacaccttcgtcacccgcgacgccaaggccaggtacgtcaagttccactggaagcccacctgcggcgtcagctgcttgatggacgacgaggccacgctcgtcggcggcaagaaccacagccacgccacccaggacctctacgactccatcgccgccggcaacttccccgagtggaagctgttcgtccaggtaggtgatcatccagaaattaacgcctatacgatctgagttcgaagccgcagtactccttctaattaattatttaatactgttaggtgatcgacccggaggaggaggagaggttcgacttcgacccgctggatgacaccaagacatggccggaggacgaggtgccgctccggcccgtggggcgcctcgttctcaaccgcaacgtcgacaacttcttcaacgagaacgagcagctggcgttcgggccggggctggtggtgccggggatctactactccgacgacaagatgctgcagtgcagggtgttcgcgtacgccgacacgcagcgctacaggctggggccaaactacctgatgctgccggtgaacgcgcccaagtgcgcccaccacaacaaccactacgacggcgccatgaacttcatgcaccgggacgaggaggtggactactacccatcgcgccacgcgccgctccgccacgcgccgccgacgcccatcacgccgcgccccgtggtggggaggaggcagaaggcgacgatacacaagcagaacgacttcaagcagcccggggagaggtacaggtcgtgggcgccggatagacaggagaggttcatccgccgcttcgccggcgagctcgcgcaccccaaggtctcccctgagctccgcgccatctgggtcaactacctctcccaggtaattcataccagcaatttagtattacctccatttttgtttttatgacactactagttaaagtttgaactaatcaacgtcatataaaaaaaacggagggagtagttattagtaatgattaattgttttctcttagttaatccacatgattaacaccatgtttagcacaacagttttatgaatccatagataaattatttaatcctattttatatgaaatatataattttaaaccactgtagagaatttgaaattaatatgacttaatcgctattaatttgcactaattccggcaaaaaaagctattaatttgcactaactatgtaattaactcatttacttcatgcagtgtgatgagtcgttgggggtgaagattgcgaataggctcaacgtgaagccaagcatgtgaagaaactaaggcacaagaatgcatcatctcttgttaattaattggagtactaccaaccaaataaggccagacaatgtcagatgcacgcatcttctgttgtcgttgggccatcttttgtatgcatcctattgttaattactagtacatgatatccaagtgatcatcagcaaggctacagaaattctgtaatacgataaattaaaagaaaccaaaatggagcctgcatatgtgtaacttaattaatgtactggcgtattaatgccactgctgcatgttgtaatactccatcaaagagtctattactattaagtatttaaattatcacttcaatggtctcttttttttttcccaaaccataggtctatatacgaaccatatctacgacatcagtggtttaattatcatgtttgacaccgccaacttcatacagaaactctacctcaacattttgtttctccgctatacttacaatgactttaattagggaatgtgattgctgtgatattgagaatggtaatatgccgtctgactttgagttctttctaatttcttaaaatcaatttttaagctgagttatatcatgatcccagccttacataaccttttggagcggcaatgaaacaactgtgacccacacagcgagtatattcattggcgctgagttgttcgtgtcgatatgaaaacgaaataaaaacaaacctgtttatggtaatgataattaatatctagttggatgaatcattaattttttttatcttcattccaaatttcagattaaccaataaaccatgttaccggtgctatcacctatcatttactacgttgttcaaacaaaaatatggtagattaattctagcaccgtgaaagatgcaaatcgaattctgttgcaattccgtagtaacgtatcaaggcgatttacacctgtcatcctctacaaagttgagctaggactacatatcacctggtattttcaacttgaaaaggaagaaaatcaggtgtaaacgactcaaaagcatgctacaaggatgcaaaattggactgccacaacaattctgtacaaccatctgcttcgcaagctaaaagaaggaaaaatactacagcacggagacgctgatcatcagctcaccctgtttgtgcacgctaaaactgcctctttcaactgttctttgtctaatgatgtctccaccatcacctgcacaagagttcagtccatgctatgtaagaatgacaacacacaattttcagcttgtgactcgatcaagcatttaacattaattgtccatacctcttggacattatttccatagcgtgcaaggagtttatatttctgaccaaccaaaggtgccatatacacctagcaagcaatagatttaaaaaggaaataaggtcaggtgtcaattccaacaactaaggtgcagaattgtgtgaatgctgaacatgaaacgtatctacattttagattttacctgaaaggttggagctagtcctgggcttcgcaagaatcgtcctttataaacatccctaacttcctcaatatttttcatctcttccatgagagcatccacttcaggccactaaaataattatgatcaaataatggagtgttaaaacaaggatgcaacaaagtggatggataaggaaaagaaagaaaatcaatgccacaaggcagacgtatgaaacaaacattgcatgacccaagttcactgctatgtctacagctctcagaaatgtccacaaaatatccagaaaagaagtttgaatgaagaacaataactaattaaacaaactaagaagataggaaggatccaggcttgggtagcacagactccccgcattcaaatacagagctctatcaacttctgtatgacaaaacatgcttgcaatagaagggaaaaaactcaggtatgcccatattcaatcacagaccatgcaggaggccctaccagcaaacctacaaaaagtttcgatctctttggcacaggctaagatattatacataactcagaaaatgggatgcaactgccatgtagcagctatacatgttttcatcatttagccagaagttagaaaacaatctgatgacgtggtttttcccagttgaatagagagagggcattagatttagatttcaggccctctaaatatgcataaccttcaaatcacaaacaatgaaaaatttcaagatgatgataaataatgccataagtcacacaaacctcaaaatctgcttgtgcaggttcaagagctccacccagtgatagttcctcaccaatgacagcttccaatgcgcctactgaaggatttggctgcatagaagggggaaatgacaaaaataataaatgaaagcctgaaatcagcaattcaataagctgaaccaccatgagggaaaaggggaaaggcccccaggtacctttacatctttaagtgacaaaaatatgcggttattattatagtccagttgaataactttagcatccacaacctggaaatcaaaataaatttctgtaaatcccagaaagtttggcattatgatcattgtcacgtgatgtatctaagtttctagacgatatagagaggtatgtcagtttcaaaatgaacatgagaacttgcaactcctcctttatccacacatgggtgcacacacactgttaacaaagccagattgcaacaaaaataaggtccatgcaaaaaacaagtgttacctgaccaattttgtaagaaactgatgggtccaaggtttcatcccaagacacttcccactgctgaattaatgcgggaactccttcaacctttgaaagaaacagttagctgctgatactgaatgaaaaagcgtagaaaatatggttagacctacctcaacaaatatcccaaagtaaacaaatcgcttgatagtgcattcaacaatatctcccacattgagcttagcctgcatgttaagaaaaacagtgtgtgcagccgaacaaataaataagtaataaaagggaaaatgttggaccatgctaagcatagcaaaagaactaagctaatagacatttcaacatagtaagtaccatgagacttttctttttctgaatcaattcttcactttcttttggcttcatagagaaaaatattttcttggattttctgtcagccaggacaactgaaacacggagtctctgcaaaacaagcaatggcatgttagctaaaagggttcaactgaagaatgtttggagactaacaaaagattcatacttgaccgataaatgatgataagaatttagatttctcagtgttatatgttcgaagaagatcttcaaatttttccttagatggcatagaaccttgatcctgcacagcaagttctgaatctgagctagatactgattctatgttcctgtcattgacctcaaaactttcttctatgcccacactctgcttgaagagtgaaggatcgccacccttttgtcttaaccaagtctcaaaagctaagaatttccattttgtagcaagattgcgatacggtaagaaacctatcaatgaatcgagtgatacctggcaaagaaatgatgatagaggtcaggtaccatcagttcattataacttgattaaaaaggtgctaattctaaaactggacaaaaacttacaacaaatcctttcgagctgcagtttatcagctccacctcaactttttctccggtacttgcataattctccagccttgtccagtcactctctgtgatgtcctgcattagtgattccataaacaagagttataatcaatatctagaagaattaaaaggatgaaatatgactcaatgacccttgaatagggaaacatctcattccacagaaggcaacacccactctaagaactacagttgttgagtttgataataagcctataagatgctgaagctcaaacattatgaaattcacattacctctaatttcgatgataacacattgcctccatcatcaacataattcatgttattctcactggcattcatcttctcagcatcaacttgagatggaaatgtttcaacagctaagtctttcctacaatgtagtaattgccatattagtggtagctcggccaacatgcgagaaactgtaatgacgtgagttactcaaaagaagaagggatacacccaatttggatcaatgtaacaacatgaagtacaattagttaagcagaaatgtcaaatatatattttacaagcgatgaaaatgttatgctaaaaatagaagtgcatagtttcatcagaaagtacatcttaggttttccttgcaagaaagcttgcatagagaaattactgctgacggctgattgatcatccaccacagaagggtcgccttctcggttaaaattttgctcagatggctgtaattcttgaaaattttaacataacattagtatgatggatgaatagagactagtcactgatctattatgccttccttacctgcactaagatcatcaggaagcacagatgactcacgatcattaatactgtcaatcactactctttcatcaagacctgaagattgaaaaatttgcaatccatcagatccaaaagaaccagctcatcatggcctgttgcatttgggatgttgtaccttaccatttgtttctgggtcaactgcaccattatcctctccagaagcaacagaggcaggtccagcatcagacttctcttgatttgaattcatattatctactgaaagctctggcttttgaagaagagagatgttggccaaatcctcgtccatatctttcctcattttcaagtcaatatttggtttcagattcagcttcgacttcaattcatcatcatcactctgatgtatggtgggtttccgcaaggaaacatccacattgttctttcttgaggtgctgccaacatcgctcgactctcttctggcagctaagctccccttgctaggccaactatcttgcaccggtttaccccggacaattggtctgcttcccattggccgcaccaaggttaaagaagtgttattttcctttggcttgctccctaccggtcgtaatggagccaaagaaggaccatcttgcttgggtttgctccctgctggtcgctgcaaagtcaaaggaggatcatcttgcttcaatttgcttcctgctggtcgcagcagagtcaaagcaggctcatcttgctttgcattggtctgaacaggtcttgacatgcttggagaatttttgtctaccattggcttgcttgtttcctctggtgattcagaagtctgttcctgtctgttagcatccataaactccctcaaaatatcatccaacttggcctttttgttggcaattagattctctacatcgagcgatgaagcatctgggtctgctttcttgagaagtatctgagggaataattcaaaaacacttaaggcatgctaatgatgagaaaat

SEQ ID NO: 44048 - DNA, 3257 bp, Oryza sativa
attcctgcagcccgaaaaaaataaggctgcagtagaacctgaacactagtccacaattatgcacaaacatttctagtacatacccgcatgatactcacaagtcgcaacgatcgttttgctacaattagaacactcgtgacatcctatctatcaacgcaagtatgaattcgcattgaatttttttaaaaaaaacaaggcgacatttccatcttattccgagagcctctactctctctagggatgagatgagagcagtagtaaggcaggcacacgggaggaaggaaaccttggcgagggtgagcttgggatcctcgccgaggaagcgcccgaactccagctccatcctgtcccactcgtcgagcgggggcaggtcccctcctctgtccccaccggcgcgcggcggcgctcggaggaggcgcacccggccggaccggggggcacctctgcggcggagcagtacggggcgcgcagctgcgccggcgcccgcgaagacgccggccgcggcggcggcggcggcgaaggcttccatggccggagcggaggaaggccggcgaggtcgcggtggggtttagcgggatgggagcgaggtaacggataagttagcgggggcttcggccccgatacacgccacgtggcaccatctcaaccgtttgttcctcacaggagagagaacctgccataaattgaattttccttcattttggttggaattttctactccgttgtggtggaacaggcgatttgaaaaattataagttgaatgaaatttgcatcgaacttgtcacttgtcagtcgtatcaaacatgggctactctgattcaaacattcgtgttatactagcacttgtgtacttgtgtgatgaaacaaaggagcttgatcattttttgtaaatcaagccgaagttttaagagtttatcgatctgtttgggctatttaaattcagttagctttttactccgaacacttcgatttgtgatctgaaaaccccaaaagtcttcggagacctctttccgatgaaaaatcttttttgtgtaattccaaatgtgaagcaagtctccgtattttagtggtgaaactgaatacttgaaattcaacataaccccagttttcttctttaaccataaatccaaaaaattttctacctccttttttttcatgtatttttctgatcaggaaaaataaaaaattatgtcagttattttgaaattattgtaatctcgtacacacaaaaatttgtaattattcatctactactggaatttggatttattttatcgatgcaaattggatttggatagaagggtacattcttttattttagatagaagaaaagtttcttctatctaaaataaaagaattttgctaatttatttattgctatatccaatttatggaattgatacaccgtttaattgatatcatttagcaaaatgaaacatagcatatgcatccatctttcggctcgagaatttcacgggatagagatatggtataagaaataggctattaagtaactctaaatgaattgtggatacatctgtatccttaacatactgaaacaactgccattattcgtatcaaaccaatagcgatttatacaagttaaatcttctaatcaatggtgggccaataatgaatttttttacatatgtattaagacgcttggcctgatttcgaaattgtccagagttttttatgtagttttcattgcaaaatgatggatctccttccgtaactttccaattacgagtacgagaattgaaagacatgaaaattctcaattctctacggcgtctaggagatagatagaatattttcaggaacaagaaaaccagaagaatctttctctctattcactaccattccgcgtcttcgacttctattagtttcttttcttctttaatgcaatagctatagtttgatatagaatccatttctcaaagtaatggaaacctttctcttataggaaatggttcgaaaatcgctattccaccttttaggtatcgtgaaaagtgatacctgtgaagatcgtgcatttcagtcacattcagatccgttttttgagtccatgatataaccaaattggatggatcttccacccgtttagctaagaaacaatagatgcagaggtggataatagatcgatatgaagatcatgagctgccccataatgaaaccaccaggagtcgcgaatatctccttcttccctaatccaagattggagaaagaagatctaagagggacccatggagaatgtggtcagaaacccataatagagtccgaccgcaacaaccgaattaattatcctcatcgagaaacttagactactaagtagaaaagatttgaaaatcatggcatgggtctcctttttttctttctttagagttttctatagcacaatttctcgatgtttcgatgagaatttcttgactttccatatatagaaagagatagactataaatgacatctcttatgtcaataagaccaaagggatggatattaaatgataggaagcgctaggaagtgaaatagaatgaaatagagccactctgggcttacctatgaaatgaggcatggaacagagccactacgaagaaattccgggagttacgaaagaagcttcggactcatattgttcatgggttgagagcgggagttgaactctaggaggtcgaatcccccctgttcctcagtagctcagtggtagagcggtcggttgttaactgactggtcgtaggttcgaattctacttggggagatttgattcattctttaatttaagaataaagaattgaattaaagggcttgctttgacccttaggagtaggtaacccgttcgctatccttgtttctattgcattttatcttatcatatcacattctgttctacgattccacttcgacaaaaggaaagagcatacccaagttcaatagctttacgtccgctatcccgatcatggttttcctaccctcagggggaaagtaaaggcccttcccgtttggaaggctgtgggcgaggagggatttgaacccccgacaccgtggtttgtagccacgtgctctaatcctctgagctacaggcccaccccgtctccactggatctcttcctgggggtaccccaaaaggaacctccctctcctcagccatttcatttcgggttaagaagatgggaaagcccctttctctctataagaacagtgcgttccgaggtgtgaagtgggagagaggggatgtgatgattgaggttttgaataa

SEQ ID NO: 44049 - DNA, 794 bp, Oryza sativa
cttcccaagaaaaatcccgaattggatccaaaattgacggttaatgtgagcttatccatgcggttaggaactcttcaaataggaatccattttctaactggctttcatgctttggtgagtcatccgagatcctttcgatgacctatgttgtgttgaagggatatctatatgatccgatcgattgcataagacccacggtagcaatagaacggggagagtatacagaaaagacagttcttttcaatttcgattatctatatattagttcgtttctatttctagatatctatttctatatattagtattagttagtagtgctattctattagttagcgatcccggctctgtgagttctttcttccgtgatgaactgtcggcaccagtcctccattttttctgtggaccgaggagaaagggggctcagcaggaagaggattgtaccatgagagaagcacagaggtcaaccctcttcaaatatggaacatggattctggcaatgcaacgtagttgggtcctcatatcgatccgaatgagtcagtctttctacagaggtcaatctttgcctattaggcaagaggatagcaagttcgaaattctgtctcggtaggaatggatttctattactatgaaattcataaatgaaaatgaagtagttaatggcagggctaccattatccctttttcttgtatgtgttcctaagagaaggaattgtccctttcatgtttcgaggtctcaaaaaagggcgtggaaacagatagaaactcttgaatgagaaattgaaaggggtgcagg

SEQ ID NO: 44050 - DNA, 3022 bp, Oryza sativa
cccagaaaaagatgaagtgttaagttcagctagatgttgactcgttgttcttcagggtagtagctctatgtgaatgggttcagtgcttcagtttgcagaaagctgaaaagcatcaaaatctacagcctactaagtatactaatacttgtagaactccacaagtatgctgagcttaagctacattataaaattttaacgattttacatcctctgaaatcagtatacaacatgctcgcgagacacgagaaccgaaaacaaacaaagcatgatccaacgcatagatgttatttacccgaagaaagaacaaagaactaaaatttaataataattagctctaagagtcctatcatgactagtgatatctctgtcctcttttaatacacaacaatataatgtcctacaaaaagggacggttccatgtgagcttcagaggcgtcttaatctcctcttctcttcctcagcatcaaaaaatgagatttgctgatgagaaaaaaatcagagctctcttctctcaacattagccgacaatgataaactaatacaagtatacaacactatgattttattaacaaaattaagtatacggccctgtgccaaattatatttgtctgcaaattgacttgtgcataagtgcatgtggacaaacacctaatccccgaacaaattcaggcatcttgccctatacattatgtcccagtggttaaactaatagcactgttctgaagagaagaaggataaaggaatcttttgtcagttccacacacacataaaatcctagtcctagttaagaactgcatcctgacttgcgaggcttgttgcttcttgtcacatctagaatgtaatgtaaatgtgtagtactactgatttagttaatgattaaagaattattgggaaaatgatggtgatttgcaaaatatgcttctaaaattaaaaaaatgaagcaggaacatgcaagagggcttctttgtacttgcaatgatgggatgcaagtcaatgctctcttcagaattaatccacagagacaggcaagatggcccaattgtatacacaagtacagctcatccgggtactcactgaataatgaagactagcactgcaaattgtcagtatatcttgccagaattaagtataatggatggctgcaaaaattatgtcatcttgataagcacgtacacgaataattattaggcatccttgaggattttgagaggaatgctgaagatggtgattaagtggatggatgctgtttaacttgcttgttaatcagcatgcagcagcaacgatttgcttctgaaagtaccatgtttatgcatacttggtagcaaagaaaagcttatccgattattttaagtacattatcatggattgatgataatgttcatgcaaggagattaggagaagctagtgaccaaagtggaggcaaagaggggatccatgaggaattgagtaggctgagtacttcaggcaatgaaagatatacagatttatttcatttgacagccttttgagtctaaagtttgaaagaagatatacaaatttatttcatttgacagccttttgagtctaagtgagaatgaaaatttattttctataaatctagttcgttggacagctttggagtctatgtgtgcaggaaagaagataggcgaaaccagttcattggacaaacttttcagacataagtgatagcaagatcaatataatagatatatctatctagttaaagacagctttaatgcaaattaaacttactttcaaataaaaaatgcaaactgaactttataaatctacttacaaaattgtgcagtttcttatttaaaaggaatagttattcagtaatcgcaccttgactgggccaaatgaagcccagtttatgtgggccgataccaaaaatgggccttacctgttaggcccaactcctttgggctaacactaggccgaatgactccgttgcagtatgggccgacactgtaacattgattaggcccacagcatctaaaacttttacgaaagaaaatgagggcaaaaaagcgtggtatcgcgcaaaatcgaactgaagaaacatacacaaatggcgctcataaagtgaaaaaaaacatgtaagtatactcaatggtataatgcatgctgttggatcaatggtaaatggaaatttattgaagcattattattcttgtttaaagaataaatcagcgtgtacactgtcaggaacacatcgatcacattcaccgatcgaatgaaacaaaaaaaaaggaaaggaaaagaatcttaatccatcagtcatcctcttctactcctctctgacaacttgagcattacatccatatctttctccctttttttagtatagaaaggaaaagaagaaaatggaaggaaaaatgtggtgattaaacagaaacacaaacacaaagaagagattaattaagaatggcggcgtcacggtcgagcacggtggcgatgattaattaatggaggatgatgatgatgtgtttgcaatgcgttgctcactgtcatgcagccacgtcgtcgtcgtcgtcgcccccgacgccggcgacgtcgggggtgagacggcggtgggtggtgaagagcttgagcacgccgtcggagccgccggcgacgagctggccgtcgctgtcgtcgccggcgagctggcgccatgcgaccgcgctgacgaaggcgtcggcgtgggagaatgggtggacccagatgggcttggaccagcggaggtcgtagacgaagacgtggccggactcggagccgctggcgatcagccccgcgccacgccacacccccatccccacgaagcttcgcccgctgacgtggccgctgtacgaccgcacctccctcgccgccgtctccgccgccgccggcgccggcagcgcccacagacggtgggtgccgtccgccgccgacgtcaccacccgccgcgccgtcgccgcccaccggacgtacgtcacggcgcggacgcggccgtcatggacgccaccgcgccgcgccccagcgcgcgcacgttgtgcaccgc

SEQ ID NO: 44051 - DNA, 3894 bp, Oryza sativa
ccaccatcgtcgccgcgccgccgccgcgggcgtagtagagcgcccacacccgccgcccctcgtgctcgtcgcgctcccagaccggcacgccgcgctccacgtcgtactccgtcacgacgccgtcgtagtcgccgcaccccacgtgcgacgccgccaccgcctcgccgccgccagggcgccaccgcacgctgctcagcttggccgggacgcagatgcaggcggcggggctagacggctcggcgaccctgtaaatccggatcttccgggcgatgccgccggtggcgaggtgcggccggtggggtcgaagtcgaggctgccgatggagtcggacgcgcccgcgagcgccggcgacggcacggtggccgccaggcgaaactcccattcgcacctcggcggcgacagcttgtcctcgtcgtcgggaataatgccggcggcggcgtgttcttgctgcagcgccgcctcgtcccggtgatcctgatcgtgcagctgctgctccccggcggcggtggacgtggccggcgaggaggggttgctcatggaacgctagcttgctcgcctcctcatagggctaagctagctaccaagctaagcttagctcaagctcaagctcacaaccctattcttttcttgattcgagatcgatttttttttggtttgtttttgttgaatttgatttggtggttcttgtttgtcctggggcaagaactagagagagagaaagaaaaagattgtagagagagagagagagagagagagaatggtttggttgaggtggattattaatggagagccacaggagaggagaggagccaatgagaggaaaggtttaggttgcagtgcagggtttgtgtggctgagtgaggctcatgtcgtggctgcatttgcaattgcagattagtacgtgctcctggtaagtggcatggtgaccaatcacaattcaaattcaatgcgaatccaattcaagctggctaatggctatggcttgctgagctgagctggtaggggttagttaattagtttggttaggtttggccacatatacacaggcagataatggtccaagatcgaggcagttacttgtactgtactgtgtcctggttggaatatttctcaccatttattttggttagcagtacatctcaactagtactactctcctgcctcttcttttcctttatttggaaaaaagtcaatcctccttacatgtaatcaactaatttaatcatgcatgaggccgggttaattctcatcatgtcaactattattggtacatgcatgcaaagtataattcattcgatcagtacaaaactacaaactgaaaataaattactccatccgtttcacaatgcaagtcattctagcatttctcacattcatattaatattaatgaatctagacatatatatatctatctagattcattgacaccaatatgaatatagaaaatactaaaataacttacattgtaaaacggaggaagtacttacaatgtcatacccacgagtctcctaacacacacctgaaaagacagatagacgaattctcggtctcactaaatttgtactcctaaagctcacttgcgcgtgtgtaaattcctattgaaactaaagctcactcgcgcgtgtgtaatatatatatgatttgtttattattgacgtgcattgcacattacttgttcaagaaattaatattttttttcagaccaaacaaaatttaatttatacgcagtcaaatgttggataagagaaagctagctgcctgcaaattaattaattaatttaaattttaaaaatagattaatatgtgtcgacgagggatgcccgtagaccggatatagagggtattggggtacgctggtacgaggatctacgtagtacgacatcaagcaaacagaaaacagagattatactggttcaggcccctcggaaggtaataaccctaatccagttgatatgagattatatgattgaaatcacatattacaaagggtataatagaactcgatgataccgtcgagaccgtagtcgagttggttcgactagatcacctggcgacttggctcctgtaggctccggcttcgtaggctgtggtggatgtgttggcggtaagatttgatgccttaggtcctcccggggggttccttttataccgtggtcagttggtctttaagtagaactcggagacatcagaccccacacgatacagtaacgacccggttctgtccgagtaggactccttccatccgtggactccatttctattacacgatgaatttccttaacgtgtacaggaaacatccgtatacacgcaggtataccatatcagtatacgtcgtatatccaagggtagagggtataccttatccgtaattctgacaatatgatttttaaagaatcttttatataacgatttctctttttttttgcaaaaactacatagtttagcaatttgggaaacatacaagcgggaaacgggttcttttgtttcttttgtggttgtaacaaacgcaacctagtatgtactcgaaattgtcaaagtttttgtttgtttagtactaattaaaagaggagaaattaggctttgggggacaaatgaaataaaataaaagatcgatccccattggaattattatatgtatagtttgtatatataggatcgagaaaacagtggagatatgagatggacgtccttactagctggagtagctcttttgttgtatagatagatagatgagattggtggtcacaccgttgacaggtacgcaggcagtgaacgcgtgtggaccagatcgtttccagttcgtacgtactagctttattagttggcgtaattactgtgtcctagttagctaccacttgcaatataaattattgttttggagcatatatatgcaattaactggcatcatatttagattagtagtatatatgaatgcatgtgtgtgataccgcaaccttttttcaggaaaatgtgtagttttcatatttagattagtactccctccgtccataatataagctccgttccataatataagggattttaagtttttgcttgcaacatttgaccactcgtcttattcaaaattttttgaaattattatttattttatgtgacttacttcattattcacagtaatttaagcacaaatttttgttttttatatttgtaaaaaaaatttgaataagacaagtagtggtcaaacattgcaagccaaaactcaaaatcccttatattgtaggacggagggagtagtatatatgaatatatgcatactggtggagaaactatctttggtcggtccggcaaaatccacaatagtcccggatccaaaaagaaccgggactaaagattgtttttagtcccggtaataaaaattttgatctttagtcccggttggtaacaccaaccgagacaaaagatgatctttagtcctggttcatcctctgtcagatgtatgtcagggggccgagaatctttagtcccggttgatgtcaataacaggaactaaagatcaccactttagtcacggttggtagtaccaaccgggactaaaattaaacacgtacggttggtactaccaaccgagactaaagatcaagaatctttactctcggttggtagtactaaccgggactaaaattaaacacgtagtatataatccctatccattattctctcctccacagttacaacttagacagatcgaatctcacccctctcctcagatctatcctctctaactctcctctccaactcctccccttctctccccttcctccttccttcccagccggcttccccttcccatccggcgggccggccggcggcggggccgcgcccggcggggtcgcgcctggcggagggcggcagcgccgcgcgcggcggcgggc

SEQ ID NO: 44052 - DNA, 2701 bp, Oryza sativa
cgagtgtcatatctgtccatctttttatctacctgatgacgccgtcactatctactactccctccctcctataatataaaaaaaattaactttttcttacactgtttaaccactcgtcttattcaaaaatttatgcaaatataaaaaatgaaaagttgtacttaaagtactttggataataaagtaagtcacaaataaaataaataataattttaattttttttaataagacgaatggtcaaatagtgcaagaaaaagtcaaaatccctatattatgggacggagggagtacgtacttcgttcgtctcaaaatataaacaattttaacggaataaaatacatccgacactaatactataaatatgaacatgttacaagtctaggtagttttacgaatatgaaaagttaaaaattgaactaaccaatgtatgacattgcttagttcaaatttgcactatctactacgaagtactatcctttttctatatgacaacgtatgaaagtaaatataggtagtatttaataaattgagttttggtattgaataaattttacaaaactacatgtattttgtacaatttatcacgaaattacagattcagtgtctccgtttatcacaaaactatatatgctttgtacaatctatcagaaaattacatatttaaaaacttatttcataaaactatagattttatatagtatatgtagttttataaaatttactctttagtatttattatcggacattttctggctaatcatataatatgttgtacggttaggtagccggagtagctaacactaatttttgatatccaatcaaatcaacctctgatcccaagttcccaacatctgaaaaaaaagtaccccctctgatcccatcgattaagccgcaaatgaaagagtttgcatgcatcgatgcaccgaaactatttaggccctgattagtttccgtaattttttttatccaatcatattaaatatttggacacacacacacacacacatatatatatatatatatatatagtattaaatatcgatctacagtatggagaagggacacatatatagagtattaaatatagatctacagcatggatagggcagatcagcagctaatattagcttgtgagtatttgttaatttaatttgatataatcgatcacgagaggtgattattaattaattagattggatacacaacaacgtaccgtacctacttaattaattaagagtagcaagcaaaggcattgaatgcatgggtgcaattttcatattgcatggtttggcgacccccccacattgcaagagagcacgtgcattcctatggtccatacaaactactattactacacacatctccatctttctatcatatcgtgccacgtagccagcccatagcggatctaggaagaaataacaggagagtacgaaaaaattagataaaactacaaccccttcctatttactaaaaacaaaaaattttaataaatgcttcgtgaggactctcatagttctcacaccaatagtggaggctggagaccccgtcgcccctgcagccagctactgatcacatatacgaaatatatgtatttatatattcaccaaggttttaaatctctgactattagtcactatctctagtactccctccatttcgaaatgtttgacgccgttgactttttaacacatgtttgaccgttcgtcttattcaaaaaatttaagtaattattaattattttcctatcatttgattcattgttaaatatatttttatgtaggcatataattttacatatttcacaaaagtttttgaataagacgaacggtcaaatatgtgctaaaaaataaacggtgtcaaacatttcaaaacggagggagtagtagtttaaggagagtagctatttgcatgctctcatgtataatttagatattattagacactgtaacctcatttagccgctattaactgtttgaaagggtctatacttaaatgttttagctcactatttaaaaccgggatatccacaccaatgtatgcatatgtattttgtacaggaaaaaaagcactggctctaaacctcatcgtaaattacaaaaataaaaacctacaaaaaaagaaaaagggaaaaatatactgtagtactttgtggttcggagaataaaattccaaccctgcgtgacctcattggaagctgacgaactctctctaaccaacagaaggcccacgggaatcccggcctagttctttccaggcccagataaactaaaccgagtttgggccaagatcttggggtggaattgggcccagaaagagcccaaaccattcaaactcgcgaatttaaataaccaaacaaatttagaaagacttttgaaacttcggagtagctatgaattgaagtaacctacgtgtcatgcaattgacaagttcgatgcaaatttgttgaacctattttttttcctttttttttttcaaaaaacgtacatcgtgtcccgtgttaaaaaatctacaattccaatcacggaatcacccccttaaacttgttagcaaacacgaaaaacaaaacagaaaaaaaaaataagcaggagttggagtttaaatctctgaaccctatccatgacctcatttgagaaggcccacgtcttgtatagtttaaccccatccacggttaaggataatgacttcaaacatggccag

SEQ ID NO: 44053 - DNA, 2181 bp, Oryza sativa
ccggtggccgtcgtcctcccgtggctcgccgtcgccgttcgccatcgtcttcctccgcgccggccaccctcggtgaggcatcctctcccttctattcccctccctctccctcctagccgccgctttagcgccgccgcccgttagccgtcgctttagcaccaccgcccgtcggcgccgcctttgcgccgccgtctccgtcgccggttgccgtcgccggcaacgcgtgtgcgcgcgccgtcgccgtcgccgtggccgcttggccggtcttgagccgagccgggtcgccaccgcccgtccgatcgaccccgagggcgatctgggccgtcggtcccgtggaccggcggtggaccacccgcgtggtcccggtccacggtgaaccgcccccccttgtgtcgctgaccggtggggcccgcttgccggcgccgcctctcccccttgctgacgtcagcgaggtccatttcctttgtaaaaataaataataattacgcaataaatcgagtttaattctagaaattcatttaaatggctcaaaacttctaaaattcatatctaattcattcgaactccgaattaagccattcaacttgcaaaattcatctaaaattgagctctgcatgtttgtttagtttttatgtactgtttccttggtttttattagagtttttcctcattttgtgtgccagcgtgtagaatccgtcgtttcggaagtccgcggtcgcgaggaaaagagttcggaagatcaaagtgaagaagcaaggcaagtcacacattccccttgagcatgttgatcccaatttacaaatgttttactgtttgcaaataaatatgcatgttttgctaattacatgggatccgggtattacctatctgctcgcttgtgccatgtttacttgatatctgttctttgtcaaccttgggtaatgaatcgactagctcatgttacttatgtgtcctagctagaactatatgcttagccatgcttaattaccactagctcagttgatgggataattacagtattagacctttttagtatcagagtgagctgcgtgctcgagacatctggccatgcttcatggtcgtaattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctacgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggtgcacgggaacgtgtcgtggggctgtgtcttgtgggtacagttgtacacctctgatcagagtaaaactattcgaatagccgtgcccgcggttatgggcggtcgactagattcaccgtgattagtcccaccttaataaatcgactcaatacactgtagttcaggtgggttggttgggcctgttcaacgtggtgtagcgttgatcagtggagattcaatattactttaattactcaacagttttactgttttgctcaataaaatgttttacaaccgcctttatgcaaatagccacaaaccatccttgtatccccttgcacatctgcatcgttggtgtggcttgctgagtacggtggttgtactcagttttgctattattccccctttttcagaagtgtagtgcttctgagcggaagatggagttagaggaccaaggctcagaccccagttgagttttgcctgtggagtggagctgaagccccgctaggatcgcctttttccgctgctgtcgttctgtttcggtgtgaggactaagtgcctcttccgttttacgctttatttacgtttggaactgtatattacttgtcgttttgtgtaccctggctggtcctggacagggatttaatacgcaaaatagtctggaaatttgggttaaatttctgggcgtgacaacgcgttagtacagcactgcacgggtcgagtcacacagcacctagtat

SEQ ID NO: 44054 - DNA, 725 bp, Oryza sativa
aagttggataaagcaaatatcttgagtgatgcagctcgtctgttggcagaactcagaggcgaggcagaaaagcttaaagaatctaatgagaagctacgagaaacaatcaaggaccttaaggtattttgttctcacaattttttaccttctacccctggattagaatgcctgatgccctccacagtcatgtcctgtgtcctaaaatgatatatcgcatgcactgttcccaggaacagagttcaagcagacacaacaaagaaaacttttctaaagtgcgccgagtttgatttctgtgcaattgttggttggttcaccagataataattactaggttcactaccttcactaatggcaagtccggaattcattggtcagacctcccatgcatctacgagaagtcttgatctgaccaaacatgtatgttttatggctctattatttttcaggtggagaagaatgaactccgtgatgagaaagttactctgaaggcagagaaggagaggctggaacagcaagttaaagcattgagtgttgctcctacaggatttgttcctcatctccctcatccagctgcattccatcccgctgcattccctccatttataccaccttatcaagctctgggcaacaaaaatgctcctacgcccgcagcattccaagggatggcaatgtggcagtggtcgcctccaactgctgtggacacaactcaagatccaaagctttgg

SEQ ID NO: 44055 - DNA, 717 bp, Oryza sativa
gtcccccacgagcccgatccgccgcccccgggccacggccaggaactccgcggcgtcgatcctcgggacggcgccgccgccgcagcgggcgggcgcccaggagagcgcggcgacgggtgggcggctgttgcgggggcagttccaggcgttgcggtggaaggggcaggaggaggtgtagagcggcggcggcaagggctcccgggtggggacccagcggccggcggtggcgtcggagggggcggcgccgcaggggagcggctgaggctgaggctgatgcggcggcggccgcgggggagggggagaggggaagaggaggaagagggtgagggtaatggggaggaggaggagtagagggaggcggcggcgcggcatttgggggagagaccctctccccggcgatcgatcgccggcggcgaggcaggagagcgagacggatactgagtgtgtttccacgcgaggccactgccctgcctgcctttagctttcagagtttttttttttttggcttttttcagattcagacttcttactgtactgtgcaaagtttagatcatggattcatggtatagatgttttcaacataagaaatttccaaaaatttgaagagaacaactcatggatctgaaaaacttgtagctctaccacatgaggacagtttcatgaatcaaaggactctgaatagagatttgttcgggtccaacaaaaagtatctcgagg

SEQ ID NO: 44056 - DNA, 4210 bp, Oryza sativa
aggtgacactatagaatactcaagcttgtagatcactttcagataattccatcaagaatgagatcaatgacatacacggccattttcctaacttatcatacaatttttcttttctcctttttcaggcaaactgctctccttcacacggtttgcagagctagcattcgctccatccagtcgatgatgtctgtggcgatctcatcacgctcaggctcaaagagcagatcgtgcaagaacccatcgtacagcctcagatccttgtgcctcgatgaggcctcgttgtagaggtcctgtgaagccagggggtcggtcacccggtctgcggttccatggaggaccatgaatgggacggtgaccttcttcaagttgtgcagcaggtaggaggagatgcgtaggatttcatggccggtccgaactctgatcggcccggtgtaaaccagcggatcggagtacttcgctagcagggcagccgggtcgcgggacaccgggatgcctctcttgttagctcccttgaactgaaactttggtgctaacagagagaatattggcgccacagcctgcaagattcagatagttggtatgcacttatcagaatgtcgaaaaaaaaaccaagatggtccaattttttaagatttgcacatcaaggacgagattaaatgtagttctcgtaagcattaattttgtacagattgtttttctgccgggcatagtttgtgcagattggaaaattctaaatatataatgcaatcattttaataagcgcatacaggtcatagtatatctgtttttctaacgttgaatagaatacaactgccacagtttctcgcagaaggtttgataagatggcaaatgataagttgcttaaaccaattttgcaagctgttttaattaattgaaatatacctagttcttcaaaggtattcatgatcttcttttagcaagttatgcagatgaatctacttttgctgacctagaggatgcttattccatcaaaacaaacacagtttagaaataaacagggtatcagaaaaagcagcattacccctacaatgggatgagcaggttttacacgcagagctggtgaagttaggatgatgccttccagttttgctctgatacgagggaacaatgatgcctggaaaataccagctattgataagcacaagggaaagaagaacatgaagcatgtaaaatgaacatatctgcagccaaaccatttcaagttttcaaccaggctattttgttaatgctttgcaccattgctctgcccgtcacgatatccattattcacaggcccagaggagtagggtcagtttctaaacctggcctaaatagagctgagaaaaactacttattgttacaaggcataccttcaaaactacagctccaccagtggagtgaccaagaagaaaacaggggacccctggattctcaagcacaattttaccaagaagtacatcctgtttgaagataataaaatatttcataagtaacagaatgaaggaataattgcaagacagacttgctattttcagacttactatatcttctacaacataatctagtgaaggcacataaccatgtagaccatcgcttccaccatggcctgacattgtatatggagatgttagagttagcctgttaatgttcaaaataaaagtagaaacaaacagatgttgttgatacaaaaagcgatgcaaactgcatggataaaatcaatgaaattgcctactgtgtttggttagtaagtgtgcattgcagggtcaatttgtgctgtgagtgaacagagtgtggtaacattagaatcatgagctagaagttgattctgaataaaatttcatgcttttgtccataacaaacggtaatactctgttatcaataagactacttcactttcaatatcaaatgaaatatttagctggttctaaatttctaattagtcatactccttctaatagacaatccccatattttccaatgactttttggctcacacaaaaactcagttagttatattaggtccgacaaaatgggtacttaaacaaccccaaaaactaatttcatgtgcattctgacccaaaccactgtaacttacctaaatgtaggactaaaactagccatccaaagagtgaaagaggcaataatgcatgtccaagaaaccaaactagttctcacctatccagtccattgcatatactccaaagccacatgatgtgagcagctccgcaaagtgcaaataccttccactggaaatacgggatcaaaaagtatttaattattcttttgacaacaaagaggaaagaacatgtatattgtatattaaggtgtgtggtgggtgggggacttaagaggatatatagccttacctgtgctcattaagcccatgtatgatgaccaaaatacccctaaagtaaagagaggaaatgatcagtataaattgaaagtggaagcaattgtacaacagtgtcactgcaaagtaaaaataaactgttcttaacattagcattgaaacacatgctaccctcgtaaatagatggttcaggctaatgaagaattccactttgctgcaaaagaggcttcaacagaacaatactcttcaaaaggtttcagctgtagggttgtcaaatttgccagcagcgtcaagggtagctgatcagctacactttgaagtattaaacaaaggtggttggttcctatttcaatctttgttcaatgcagcgtttgactacagtatcatttaaaatgtgaacagctgaacagagctaaaccagcaggtcatgggaataagaataatccacagtttggttatacaacattggggcaaaggaataaaaaaaagcttcctccttttcttgatagctaagctattcagggtcactttagtttaagccatcacattcagacgttttcaacgataacaaagatatagcaatggagcaaaggttgtgagataaggaatcgctttgattctgctaatctacccgattgtgcttaaattggtctcctaaactaaagcctaaaggtacacgaataaagcttctataatctcttcttatccattagtactagtaagttaccagcactaaacatttcataccatcagagagaaaaatactctgcatcagaagctgtcgtaaacttagccaactggtttgtaagagagtatgacaattggcaagaagtccatttgaccattatatcgaactactcctacctaacaattgcagaaccacggatgaagacaagattatgcagcggcgaactacttcaattgcagcctagccggtgcaatgaatgcaagaacgttgcccggtatctgaggccggatgtgtgtaggagacgtgcattagacggcacgtctctctcagagagactcgcagatgcagcaacagagtttcagcaatgcgatttacgccacaaatcctaccgtgataaatcaaaccactaaattattatgatccagatgcagctcatcttcacgaatgtctaatcggaactgaaattaaccgtcatttcacagctagatcaccggaaatttcagcgaaaacaatctggaaatttgaccgaaactgccaccagctacaagcctacaaccaaccaaaagaaaacgcttggagaagagacaaaagaagcctcttccaattccccaactcgaggagaacaaaacgccaccccaattccgaaacctgggatctctctccaccaagaaacaaaaatcccctaaaattcagaacgaaatgacgaataataatacagtaaaaatattcacaggaatcagacgagaataaaaaggtagtcctcttgcgtaaaagcagagccacaaaacgcccttcccccaccaatccaccaatgggagaagatcgattttaaaaaaattgaatcgatgtgtccaacaagaaaacgaaatcgccataagccaacaaaaaaaacaagccactgatcccctccacaacaatccaaaccactataccgaaggaaaaattgatcgccgaaccctccgtgctcacctcatctcggcggcggcggcggcgggcgcccagacgcggcagaagagcgcgttcctcctcgccccggggacgacgaacgtctcccaccgcctcgccccctccccgtccgcgtcctccaccatggccacctcctccgcgagcgccctcctccgccgcacgtcctccttctccgccgccctcctccgcgtcctcaccgccctccc

SEQ ID NO: 44057 - DNA, 9264 bp, Oryza sativa
ccgcgtatttatagggaggtgggcgcaagcgacgacgtggctgacaggtggggcccacgctccgagccgacggggggctgacaggtggggccatcgctcccagcggcagtgctacagctgccggctcattcatgtggtccccaccatccaccgtccactgtatcatggagaacgggacagccatgctccattctttagggggctcgtctcgcccgttggatctagtgtgctgtttgggaagtttacggaggttgtttcagattaattacattttaaactatattatttttaaaaaaatatcaaatatatacatacatttagttttttttcactaaactctattaaatccataagaaatccagccaaaatttagaaatattgttaaattgccaaaattttggctaaagtttatttcgactataatctgaacaggccctaagatttcgagaatatgctagttggtagctaacttctgataatttagagaagttgtaaaccagcttctgaattctaagggcccctttgattgataggattggcaaagaattttcatatgattcaaatttctatggatttttttctacatatccctttgattcattggaaagaaaggcaattttccataggattgtattcctatgcttcacattttataggaaaaatagcaagaggtgtgatttctttgtgaactttcctttgtttatcccatagcattatcgaaggactcgtatttgtctttcttgtgtttgttaattcctgtaggatttgagcaacgtactacttcaattcctgcgttttttctattcatgtgttttttctatcctgctaatcaaagggcccctaattcattttctggattctataactacatattctcagaatttatgtgacaatctgaactgtttaggaagctgaagattctgtgaaaagttacagctactaaaagctccctaaacaggcactaggttgtgtttgattaccggttacattttatcacaactatactttgttagctaagttatagtagataaaaatatggtagatagattactagctataatatgtggtaaagttaataaaaatataactatgataatgaaccgaactcaactatggtagcttaaaaaatggtgtagtaaaacgtgataatgaatcaaacacctctttaatccgtccagatcaccggcagtcggtgagattgcactcgatcatcgagactgtaggacatggccattttgttgactatcagcgaggaccctggaccctaaccaataaccatctagatgatggacaattacattgattaatcaactacagaaaaaaaatagatggaaaattctactttcttttctgacacaagcgtggctaagacactgtcgagaggacatacatcgtccgcattaatactgttgatgtaataacaatcacttgggtgatctactccagttttatacaaggggcggatccaacgtggatgcaggggggattcgattccccccctacacccacaagacccatggatacctccggagcaatcctttcaattttctcgccataaatgataaactaatggtccctaaatagctgtaggttaaagaaactatataattaagtccatcattttttttttattcctggatccgccctgtttatacacatacaatcaaccaaacgcatcgctggctgcacgagggatacgagccaccccaatgcagccaatcaaacatacccatactacatcagcagtaatgcattgaagctgtttgctagtgaaaggtcattgtcaggtagctactgattgttattgctgcatggcacggtcgatgcagagagagagagagaatgcgacccatacatgtgtgcagatgtgctcatcgatcgtcgtctccttgcaagcgacctgtcggttgcggcaaaaccaaccacatccacatgaacacacagtcagtaacattaacagtaaaattaattttctctgtacctttgatatataatgcttcctccgtcctacgataacttcacttttcactcatcacacatatcaataaaagggaaaaaagctagaatatcttctaatttaacatatcccaaaacaatcgcccccaccactttaataagtctcattatatttgcgatctactttcacaaactctaataaagtgataatctaaaagtatttgaggacagattagatggtgaaaaataaaattattttagaaatgtacgacctgatcgtgcctgaggagtaaacaaatatactacggctgtacggcatatatggctcgttgcgtccctatcgaaccaatgctattttccaagcaaagaactatgaggcatctagcaaatccacagcatcgacgtgaacgaatatgcggccatggaattacagtactaattgccctaattttttttcctgtagaaaggagtataaatgtataattaataagatgatataaacgagctgtggaagttgcgacaaagagaacaagggagccaagagccaaggatttatttatttatttctcctttttaacttgggagtcttttgctattttcgtcttaattaagccgtcgatatatatcttcctgatacttctgatgatactccttgaaatctttgtgataccttcgatatactcgttaatatacggtgatacttgctggcaagtacactatgatagttgttgatattcgtatgtactatcttaaaataaaccatatgagaaaaaaaagggggatacatagtaggattatatcctgccataatgggtcttaaaaaacataatgagtgacaaaaagataagcgtggtcccctgtttttgctagccgagcacatttttgtgggcctaaagttcacaggccttgttattaacaacaaagttatccaggcttggaataagttcactttgggcccctctatttgtcgcttagtccgattttcgtcccttggtcgcaaaaccgggtacgacaagtcccccaactttcgaaaccgtttaaatgttgtccctcggcagtattgcatctggtttttgctgaggtggcgcctacgtggctaggtctttgtccaatgtgtcaatgtggcggttacgtggcaattagatccgaaaaaataatagtacacgtgggacccacatgttagtcgcacacaacttaaaaaaatggtgggcccatgaggacccagacgtcatcctctctatcctctctctccctgttctatcgctctccagccggcggaacgggatgggcggcggccggagcgggcgacggcggggcggagcggcggcggaggcagagcggggcggagccgaagggcgaagcggggcgggcggctgccgaagcggggtggagcgggggcgagcggatgtcgtcgagccgtcgccatcctcgccgcggcggacaccgtgaacgacgacgtgctcgcgcgcgggtggtcttcaactcgggggtgtccaacccggggaagggaggggggggggagctcctggcgccgtggttggaggacgccgaccgcgcccaacgacgacgagcgcgcggagaaggatgaggcggcggaggctgtggtgttcatcaacggggaggacgatgaggcgacgatctgtccgggttcaggggcctggttcttgatctctcttataggtgacctcaacgacctcaacttgatctgacgatatcatccaaagttgcaaactattttgtttatgatagaccaaattttgcagtgatcgtgttagaaagagataaaaacaatttgaaggaattttgcatttttacctcgaaatataaccaggcctgtgaacgttgtctgctggaagcgcgcaatttgtttggaattcatggcgaaggttagcttctctgcttccaaaatcatttttaacttcaccatcagttattcaaagttcattatttgatccaaaaacatgcaacagcagcgctcagaggggcagagcacacggcggcgatggcaggagcttggcgcttcgacggcgtcggttcttgaccccgtagccgacgacggcgaggagcgcgacggcggtgaggaagacgtagacgtcgtcgtcagcagtagcctccgccgccgcccacggccgtgctgccccgcgtccccctcgaggaggggaccgacctcgccgctgccgtcgcgcacgagggctccggctgctacgtcctcaccgtcctccgccgcgccctccgtcctcgccggaagcaggaagggtgccgcccgggtcgtcacgcgcgccgcccattctccccgtcggccgctgctcgtcggtcgtcctccccattggtcgccgcccgtcctggtgccccttctccccgccggtcaccgcccatcccggcgccccttctccccgccagtcgccgcccgtcgcgccattctcctcgccgacagtcacccatctcttcgttgcctgtcacgccgtccaccccgccggccgctgctcgtctcggcgccctagctgcatctcctcctcctccggcggccaccgccggacactgccccttctccccgccggccaccgcccgtcggccgtcgcgcccgagagaggagaggagggagagagacgaagagaggggagatggggagtgaggaggaagaagaggggagtgagattgacatgtgggcccatgtgggctccatcttttttaattattgttttgtgtaactgacatgtgggtctcacgtgtattattttttttccaaatcaaattgccacgtaagtgccatgtcaatgccacgtgggacggagacctagtcaaaccagtcacgtaggcgccacgtcagccaaaaccactacccaaaccgctttaggaccttatgtgtccggttttcgtaagttgggggccggttcgtacccggttttgtggttcaagacgaaaatcggactcggcgacaaatagagggacctcaagtgaacttattcctccaggcttgtctatacatactgggctgatacagtaaggtgtacagggagtagcctaatgacacgataaggaaagggagaaaaacccagcccatatgaagaggaggccgcggcccacggcctcttgactcggataacgggctcaccttgccataatggaccaactttatggcctaacgggcctgtgtagtaatgaacgaaggagaaggcaagatgaaccgtgctcgtccatacaaaacgttcagaatcgctttcaacaaaggaagttcagaatcgttttgtttcttggttttttatgtgacctagttttgatgctccggttagcatccatgctaatagttcagttagtgtgaagtgaattgtttcggtgaaccccgcaaaaaaaaaaagaattgtttcggtgaagatggtagattcagtcatgaattgtttcggtgaaccccgcaaaaaaaaagaattgtttcggtgaagatggtagattcagtcatccagacagtggtcctgtttggatccaaaggatattttttaggcctccctcaaatagtccaaatagctcaaaaagatccaaaagggtgagctatttgagggctatttggaaatagcccacccaaaaaaactatcccacccaaagagtgctaattggggctatttcaggtggggttcattgaaaaagtgtcttttatctctatctctctccatgagaaggtacattaaaagccaaatagctcttaaaatagcccttgaatccaaacaacttagggctattttattggaggactattttttttgctaaaaaatagctctcaaaataactctagactagttctccaaatagggccagtgtttgtttacaagtgttttgcactactgcaatgagatacagtacaacatgagctggttttagatgggtctactgaagtgcctgaaagataagacatttttattcttgagtaaagtgtactggcgttgtgtgggtgtgtcaactagttccctgaactctcaaaatgaatttttaggtccctcaacttgtcttgggtgtcacgtaggtccaaatgtgtttcaacctgctccgtgtgctgacgtggcatgccatggtggcgcctacgtgtaagtagaacccatatatcagccacatatagaaaaaaaataagaacatatttttttctcctctcttttttcatttatttttcaaaattaacacatcattttctcctctctttttaaattttattttttttctacatgattgacatgtggatcgcactgacatgtaagcgtcgctgtggcatgccacgtcatctcacggagcgggttggagcccgtttggacctatatgacacacatgacaagtttggggaccaaaaaatatattttgagagtttaaggatctagataacacatttgtacaagtttaagaaccgtccgtacacttcactctttattcttgcttactgtttggttttcttccctatggatgtaatgacacgctgacaggaatgaagacagtatatgatacctagcctctgtgttttcaacttctgcttgtggcagctgctaaattttcattcatctgactgtgtgaaggtaacagcttaaataaactccatttcacctgatatacagaaaaaacgtagcaaccagcaaaacagatgggcgggtaaaatgggagtagttaagtaaatcaatacatttgtcaatacacatgcacatttctagatatcaaagaagccaagacttcaaaggagacaaactttaagtaattactctaataattaacgatgaattacaatctttaagtaactacaagagctcgcatggaattcatgaaaattctacaccaatagtttcatttcagtacaatcaattttttgaaaaggctttcagtagtatcaatagtactaatcacttttgttgcaacaagtttcttgattatcactcgcaatcagacactaattaatcaacctagaggcttaattaatttttaaattttggcgggctttgcacccgaagaaggtgaaggatttcatttgttgggggcagctgatcagtccttggtaatggcggggatgcagctggagctcctggtgaggccgccatggccgtggtccctcgggctgttggacctcgacctcttgcggaggatctccctcatggcctccgtctgcatcagcaccgggttggcgcgccccacgcggttgaaccgcccgcacaccgccatgtgcgccgccagcgcctcctccgccgtcgccgtcgtccacccggtgccgccgtggcggcatctcctgtcggcctcggcgctcgccgcggcggcgcacaggccgcacacccaccgcccgcagtagcgctcccggacgcggcgcgcgtactccggcgtgcactcctcctgcatgccgcagcactcgcaccgcgcctcctccaccaccacctgctgctgctccgtgatctccggcagcttctcgccgccgccgccgccgccggctgccgcgtccgccacctgctgcttcttggtgagctccagggccaggtcggacatggcgcgctggagcccctccatcgagatcctccgcggcttctccgcccgcttccccctcgccaccgccggcgccggcgccggcgccgccgcagccgccgccactgcgccttccccgtttggcgccatcatccactaccactagtatgatttctagctgcaaaacgaatgctcaatttgctactcgatcagatgctgatgagctgactgattactaccgacgagtgagtatgaaccgaattcaatgtggagaagaaggtgatatcgatgagctatatatacactggccgtgcacgggaaagcgagcgagcgcggatcagattgcgtacgtcggcgtggatgatgagcccgtgacatgatcgacgaggaacggagcgagctggaaaaagaagggaggggaaagagggagaggtcgcttgaatgccctagattactctcactctcaggctctcagcatccattggctaattaagatcatatcgaacaatgggcaatgactaactcaattggccatgcagtgtcaccgagattgctgcgtgtttggacgcctagctcgtgctcgtgagctagatgctaaagtagatgctcgagttttcttggccacgagtaatcagaagaactcctgtgtccatcgatctgtgtggttacaaccttgattaattaattaattgcgtaaattaatggagtacaaaattaatcggtcactgcaaaattttagttgtgtgtcatactctcatcttctttcttcccacggtatatatatatagatctatctggccgattgtgttgtataaaaaaaaactctttttcttctaatatattggcgtgcaatatttttgcgcgttaaaaaaaatgtgccacactatcgtctctatgatcattcatggatagatgaatatatagatggcgcacgcgtgaaccacgttgtgtgtcaatctcgatctctaaacagcgagcgagcatgcaggtgccgtgtccatccatatgccgcgcgcgacgccgtccacaactccacaagcttccgctactacgatacccatcaagtccatcaccacctcgcgcgctgcgcgcatgtgtccgtcgtccgtccactcccaactcccaaccagctagcggccgccgcgcccgcgcgcgccggacgtccgcttcgccgcgtgattgcgtcaatgattattgcgccgcgcgcgcgcgcgctttccctggctgcacgagcgccgcgcgccgggcggggcggtcacgagatgtctgggcgagggcgagggcgagacgcgctggcttttcgattgtacctgccgccgatggcctcgatcgcacgcggaggtgcgatgcctttggctgggccgtgttcaatgagccgttctcttggcccagcaaaggaataagttcactttgtgacccttaaaaatgatcgaaatctaaaccgtgaccctaaaccataaaaccagatatctcaacccccaactcttaaaaccggtgcaatttgactccctcggtggttttggagggcggtttcgctgacgtggcgcatacgtggcattattgactcggtcttctttgcacgtagcgttgaagtggcgcttaggtggcattagaaataaaaaaatgtgtgggacccatttgtcatccactaaaagtatgggtgggacccactgacatgtggggcccacataaaccatgttctcctcatcctccctctctttctttctcttcggcgagcggcggctgagggacaggggccggcggcggcgggagggcacgcgggcaacggtggctgcggctcgcggcagtgggaggactaggggaacgacggcg

SEQ ID NO: 44058 - DNA, 4522 bp, Oryza sativa
ctcagccacgacgactgtggcggtgaccgcgagcccgttggcatggaggacaccgtccacgccgcgtccctcatcgtaccggggcgcccactcgcgtccgtgacaagttacctggcggcgcggtcgaggcaggaggtgcgggagatggtggccgcgctggagagccacggcgccgagcagctgaagcagctgtaggttcccgggctggccaccgccatggagcaggcgcagcggctgttggagatgttcgccgccgacgaggaggaggtgaccaggaagaagctgaagcgcgcgagcgactcgccgccgggaggcgcggatgaacagcacacgaagcagagcaaggtggtcggggttgatggcgtcgtcaaggcttcttgacgcattgtcccctgcttctgatctctattctcactgatcaatgtgttattactagttgtcatcaactgtaaacctctgattttgtcatcaattgtaaatctcttttgtaaacctctgatcaatgtgttgtcaaatttgtaaaccaccgacagcgtcatcgtggccatgtcgaacttgacgatgctggtgttgttgtcgcagaggaagtagagcgcgttctccacgaggacgcttggccttcttgcctggatgaagtcgtcggggtggtgatcaatggaggccgggctgctccatgcctcggtctccgacgagtaaagggcggcgtgcgtggttcccgcggcgtcgatgtccaccagcgccacgcggaaggggttgccgccgtggcagtcgagatggttgcagccgtccacggcgcagagcaccgtcgcgctccacggcgtgaacatccagtgctgcggcgcgctcgagttgatgttcctccagcactccgccgccgccgctggcccccgtctctcagtcgccgctcgccgaagagaaaaaagagagggaggatgaggagaacatggtttatgtgggcctcacatgttactgggtcccatccatactaaaatgacaaatgggtcccacacattttttttatttctaatgccacctaagcgccacatcaacgccacgtgcaaaaaaaaaaaacctagtcaatactgccacgtaggcgccacgtcagcgaaaccgcactctaaaatcactgaggaagttaaattgcaccggttttaagagttgggggattgagatatccggttttgtggtttagagtcacgggttagatttcaatcacatttaaaggtcacagagtgaacttattccccagcaaataatcgctctcggccttcgtagttcgtagttggccttgtgacttttcctcacttctcgatcacacggcccatctgtaaatgcttttgagtttggtaggaagaataataatagcagcagcagcatcaacaatcatactcgtaaatcgtactaataagcataaacagcaataagttgatatgacacgttatatattgattcatactccctccgtttcagtcactcggtttgaggttacaaggcgtttgacattggacaaagttaaattgctttaagtttataatactatattaatttcgtcaaatcaataattacatatatttttatcataaatttattttgggttaaaaatattattacttttctttataaacttagtcaaactttaaacagttagtcaagacgtcctatgacctggaacggaggaagcagttaagatacgtaacttttcacgttaagatttgggacataaggagtactctttttttttttatgttgcaagcttacaatcgaccagccgcaatttgctgtagtttttaaacttcatgtaaactttgcgcaagcatgtatggatcgttcattcgttttatgtgtccgaggcattattggctgtggcatagtttagttcctaattttttcttcgaactttcaatttttccatcacatcaaaacttttctacgcacaaacttacaacttttccgttacatcgttccaatttcaattaaactttcaattttggcgttaactaaacacaccctgtgtttctatgagtgagttggaaacatagtgattaattagcacataattaattaagtattagctattttttaaaaaataaattaatatgatttttcagaaaatacatggtttaataatttaagaaaggtgaatgtggaaaatgagtgaagttgaaaagattgagtaaagaagacagcctgtgtgtacaggtacaatactatccagcaaataaaaaaatatatttttaaaaaggagaaaatctccaaagaaaaaagcagagatgcctttagcacagcgctagagtagacagacgcgtcgctttcctccgccgccgccgcctcctcctccgctccgcgcggccgtctcccacctctcgcgcctcacctcctcctcctcctaaaccctcgctaaaccctagcctcccacccccccaccccaccggggagcatgcactccaggctcctcagcgccccctcccacgcctccgccgcctcctcctcccccctccccttcgccgccgcccacccttgccgcgcctcctggacgccgcggcccacctccccgctgccgcctctatcgctgctgcgcgccaccgcctccatgcatccttctcctcctcccgaggggtaagggcccgtttctccctgctggtcttcgagttcgttgcgatttctgtatcattcgttggcgccgccgcaggattttcacctgattggattttttttttttggtgtgtggtgcttgtaggcatagcgaccagcctgtgcatggcgtcaccaacacggtcgtcggcgtgctggggggaggccagctggggaagatgctgtgccaggcggccagccagatgggggtcaggatggccatacttgatcccctcgaggactgcccggcgagctcggtttgccacgagcatgtcgtcgggagcttcaatgatggcgccacggttagcgagttcgcaaagaggtggtggcccctagttgcaaagctcttatcaagcttcattcggagaacacttgtttactttcaagctcttatggtttacaaactgttgtaaaaaattcctttggttgctgttaggtgcggggttttgacggtggaaattgagcatgtcgacgctgtaacactcgagaagcttgagaaacagggcatcgattgtgagcccaaagcctccaccatcatgattattcaagtaaactttcacttcttgttctaaccatctctatatttcgttgttgctaaattttagtacaagttatctttagtacctttttactgtgaagatgaaaccttgaattacagttagcacttgtgctatctaactagcgttatgcatactgttaacattctgagcacttttgctaactaggttaattagttgtggccatatctattgttcctacttcctccaaatagattgctactgtgcattttagttatttataaattttatggcattcataccatgtgtcacctggaaattgtatttgtggcgacacctcttttttagtacagtttgcatacaaaatcttcatgctacggcttgctgcttcatatgccattttatccttatctacttcatttgatgcatccatgttttatttcaggacaagtacaggcagaaaactcatttctcaaaatttggaattccgttacctgactttgtggaagtaaggcactaatttctatcttgttagaaactaattgagtgtctgatataaataaagtaatacattccaggtagatactttaagtagcatagagaaagctggggaaatgtttggttatcctctaatggtcaaaagcaagagattagcatatgatggccgtggaaatgctgttgctcacgacaaaaaagagctatcttctgttgttgcttgtaagttgataaaaattaatggagctgctttctttatttgaattcctaaaattatactctctcaaggatgctgttacttggtttacagtagtatttgacatttttttcagctgttaatttgtggcttatacttttgaacagatgatgagctgatccactcagctgtacaagtaaatgagctgatgaggattttttttttcatttttcccttgtagctcttggtgggtttgagcatggcttgtatgttgagaggtggacatcttttgtaaaggttagtatcaatttaatttttttgggtcaaattggcagctagtaatttaaatttctcttggtcaagtagacaactaacgctctttaagtgtctcattagattgatcaccaaacactatagctaatttaacacatttgtttcataattcagatatttttgaattttctaggccctttttttttgtaatttaaatcatcttcagtatcatggttcacatggcagtagatttaaggtcatatgcctgtgtagtcactaggtcatcgtgtaaattatgctacatcctggtacccctatggctctacagtcatgccgcattccttgttttctgttgattttaggatatcttctgcaagttcgttacatgataatccctatgggctgcagg

SEQ ID NO: 44059 - DNA, 1200 bp, Oryza sativa
cacatctatgacactaaacatatatattgttagcttgattcttagtcaaggtttgcaatgttgattttcttaaaattgtggcatcttatattttgaaacggagggagtatcttcttaatggcaaaattgcatttgaggtccgcgaaatattgcctttcgtctatcaagctcgtgtactttctagtttgtacagtgaatttggctttgaaacttggcaacatgataaatatagttggtttcagtgcaggtcaactgtttcagtatttttcaataccacacgtgccatattttgcaaaagatacatggggatgcatcctaaaagggggatatattctaatctttcagatcataaaatttcaaatctatattcactctacaaaggcctgtattgtatctggcacatgggccattttgtcatcaacagcaggtgtaatgaagggcctaattaaacatattcaagtagttgagggacttgagctaacaaatttaaagtattgagattttattagacaaaatgcagcagtccaggtacctcaattgcaattttgcccttttgttttcagagtcgtgtttgagaatcagacaagaatataactgtttgctctaatgtttacaacattgtcatggtttatggttgatgaccttttgaattaagatacttctattatttatagtctgttgctttctttcttgttttaggagctttctgtcattgtggcaaggagcagagacggttctacggtgtgctatcctgttgttgaaaccatccacaagtaagattttcttttatgattaccttgtgttattgattggcattgtctgtgttgtgcttttgccctttggaattcccaaaatatgaatccttagattggaacatccagggataacatctgccatgttgttgaggctcctgccgaggtgcctgataaaataaagaagttggctactaatgtagctgaaaaggctatcaaatcattggaaggtgctggtgttttcgctgtagaattatttttaacacaagataatcaggtttgctgggaacatacctgtatcataagttttaatccttcttgagtggtgttggcatatttatacccatgttgataatttcactaggttttattgaatgaagtagctccaaggcctcacaacagtgggcatcacacaattgagtcatgttatacctcgcaatatgagcaa

SEQ ID NO: 44060 - DNA, 1378 bp, Oryza sativa
tggtattggatgatccactgaatgcttacgagcgaaacaccaggaacactggctccagaccgaccgggtgatataccagtatgacaccctgatgatcttaggctcggtacaatacaaattctgtggaccaataatgtcacttcggtgcgaaaaacccaacaatggaaatgttatgatcagtaatcctggatttgccttggaacagccaaaagaataacagccagtacttggtaacaggatttagaggccgaacatcacgtccataactttggacaatactgattttgtgggtgaagcaatggcccccgaagcaccacggccactcccgttgccgattccatttggcatataattgctaggcaaaggtgctagtgcatttctagttgtaaatgaacttggtgctacatgctgtgatggaaatggatctgttgcaccaacttgaaagttctcatttgtcttctcattcaggtactgccgctgccatgggtccacttgcttcacaccgatgataagaacactgtttaactgttgaccgtgcttggtgagagctttttgtgcatcatgccggctctggaagatgtcgaacaagatagagatcagcaattagaaacatacataacaaacaatggtcagaactggcaacaggaacattcagtgatatctcgcatatatttgtagtttgtaatcatgattgaattaagcatatggtcaagccctacatacgaacattattgctggtaggaaaagctcatcacatcaatgtactgttatcatactacatctgaattctgcaatctatcctaacaaaatacacatgacgatcaaatgaaagggaaatattgacccttgagccacattgtcacctcatagttcatgcatgagatattgtcatgtactaggtccacaaatcacaaactgtgcgtctgtgacaccatccatcttttggtttagtgttgatttgttttcacatctaaacaatttaaattctgaaacaaatgcagagagaccaaaactagcagagagcaggcatatgagaggatctccaaaagactacgtgtatgactagccatcccaaaatttggctagcgtagcaaaaaaaaaaaaaaaaagaggtcctccaacagactagccattggttgggccatccggctagccattccccacctacactcactattatggcccaccaaaaaatatgaactatggagagtgtgatttgggaatttggctagtctgttggagtgcacaggaaatatggctaggcactttcttggctagctagccataagaccatttggctaacctcttggagatgctcttagctgcttacataattacataatgttccaaacttttcataatcatgtcctgaccaaaa

SEQ ID NO: 44061 - DNA, 2154 bp, Oryza sativa
tttacaagccagttacattttgagcttgctctccttttcttttggctattgatatgcaatagaaacacggtaattatcttttatcaaatctaaaacaattaagtcatcaaagtttttacctgatacaggatatgcatccagttcgcatcccttggaccagggacatgtctcaagactataccacacttctcaaattctctcagtaccaagttggtatcgccaggtaaaaaactggaaggacaaagacaggggcaacattatcaaagtgaattatgtaaaacagtgtaatcaaatatgcaccaagtcaggggaactattcgagatagagtaagacgaggacaaacctaagtacaacaatgagaatcatattctattgaaagctaaattaagggaacaatatgtacagagcgaatgcatggtcatatgaatacattcatgacgattcccccaaaagaaagaatagcatcaggatgctgtttctgactgtctagtgcacgtgaaattatatattaattcatcccaagaaaaaggtttgctaaactatttaactagatttttgggatctccttttccaacttcctacactcaaaaccttaaaattttccaattactgaaatgaatcacgatctctattctctacttcagcatatcgattcaactacaacagaaacatcaagacaacatagcatccaatcacatactcactgatcaacttagacaatcatcgttttgcagtactatgtagatttaattgaaatatggcataacacatactcaactatatgaacccaatgccacaaatttcatcaaacttatactagtttataacttaatcatcctactatcataacagtaagaggagaggccacatacccaaaaacggtgacccactcctcctcgtcgacacggccagcggaaggtgtcgaatccttcggcatctccggccgcgcaacttccctgggtggcggcagcgtgatgagcgtcaccttctgctgctgcgactgctgcccagacgccgtcgtcggagacggctgctgctgcggctgcacgacaccatcgaccggcgagccctccctggccatctcctccctcgaggaggaccaccacgcggccggggagggggacccattggagcgcagcggggtggaggagaagaggccgccgcggtggggagggggaggcgaggggctcatggccgccgcctgaggtggggtggcgggcctcggcgagggggagtggtgggagaggtcgtcgaggaacagcagcggcggcggcggcggcggcggggtggtggaaccttgcgtctcgcggcggagggaggccgggggcagccgcacggccgaggagatcggcgacgagaggtcccggagaaacggcgggtggtgccgccggtgatccggcctggatgcgctcatctctgatccggcggcgacggcgacggcgagcggcggcggcggcggcgagaaaccctagtggagaagcgagtgcccgttcgtgtcagtgactcgtgtgcgtggcctttgggtttatcaaggatagatgggcccacctgtcagtgggacaacagaagtctgaccagaaagcgtaaattcgtcaatacgtaagctcgcttcggaggcgtagttatcaataggacaatgaaatcctgctagaaggcgtagagttagaatacgttattccttttagaaggcgtaatttagttttattttgggcttttagttcaaactgacagcggagcggagaagcgtcggaggagatggaggttgcgacggcgacggaggcgtcggcgccggcggcgagcaggcggagccacccgttcccgtggctagacctggccatctccgagccctactacttcctccacctcgtcgccttcttctcctacttcgcggcccgcagcacggtgccctcggccgacgacggcctcctcctccgccgggtgagatactgagatgagataccggatctatttgcagtgtaaacgatccggatcgtgccgtttgggtggtgatcgaactatttcggctcatgtggatcggtggtggttggtgtgtttttttttctgctgcaggagatccaggcggtgctcacgttcctcgtgctcttcgtcgtgaaggtacgatcgttctcgtacggtgtttcgtgacgaatgct

SEQ ID NO: 44062 - DNA, 2486 bp, Oryza sativa
ttccttcttttactgataatgacgctagtgctttcccagtcaatgtctgataattagttaataatcttcaaagtacctttttttgtcctgagtatagtatatttcatacttttttatgtaatcttgttcacactttattaatgcagatactctaacaagaacatttcgtttggaataattgatcttgggcattttccaaatgctgcagcaaagtttggaatatccatgtggggtaaatttctagtcttattctgtgcagtattgctcttctcaacttgatatggagtgcctgcatttctttactgtattgtgttcagaattttgtgtctgtttctttcaaaatggttccttattctcatttgaatttcgtttggcagatcatcttcccacttatatactctttgacaaggccactgaagttgcacgattcccagaaatcatgaatgaatcaaaagtatttgtgccaaaaattacaaaggttgtttttttcccactgtgctttcttatttttgttatgagttatgaacaaaataagttgcatcatgtttgcatcttatttcgggtagactagtatgatttggcacagttttgcaattttaacctaccctgttgcagaagatttaacattactagtaccatatgattacttacacatataagcaaattaggcctatgcttaaactctcagcatcaaaccaacataaatataattcctcaaaagtaatctagatgctgtctatggtgtgttgcatcaccctttaaatttgaagttcaaattcaaagtatgatgctagtacttactagtaacaaatgtgataaattctacagaaagtaacaaatggaactgaacttgaaatgttataataagtagggtattttatatgcgcatccacattttcttctcatttcatttcatttctttatgtgtgcatactggggcagggcgggaggcagcttttgcactaaatatacttttcatacggccaattattccagttgaaggggaaataggaaaccattgttcctgaaaagaaatgaaagaagacacacataggagattagctagtgtgacaggataatggtgcttagagaaacatatctcccacttattgaaatgggtggaaccgataaaaataaaatgaaatggccagcctaaaaaaaggtgcgagagaggatcatatgcagtacagtatgacaacacagttcctttttggtttggccaaaacatccaggttggttacctggcactgtacttcaatcgaaatagtgagaactgacgtgacaaatttattgaagccaccaatgatagaattcctgaaacatcagttagctatcgagtcgtcctcaataacctaagtgtgaaaaattgactgtatcaagtactgctgatgtggtccaattttgtggtattgctttttgtgggggattgttaatattattcttataacttctcttacagaaacttctctgccagcacttcgaccttgacaggcgactgattgaatacctatctagatgtaagtcagccagagattactttcactgtctttttctcttcaccatcaatagaacacctgttaactgaatgcatactgtcgcaggacccatcatctatcccagctgtctcaaaaagaaagcgccaattcccttttgtcgacgaaccagatgaatgaaccggacagttgtgcggcagcaatcacttcagggggtatcttcaagcttgttttattctatgagtttacttgtacccatccaatcaaggacagtatactttagggtagggtgggggtgggcaggattatgatttgcatcttactaccatatgtcacctcttgaattacggaatgttaccacacctgtggagatcttgcaatgatatgccaactatgttttccactgcagttagtgatcaattcagacaccattcgtttccagggcaggcagtgtctcggaatttgttcgttgacaccctttttccgtagtggtagtggcctgcatggtaggtcatcctggctcccctccaattccattgcattacctgccatgcctgatgcttttccttgccaatttacatcttaaatatgcctagtgctccctgataaccttgattaaaacacaaagccgttgcatttgggcaccaccattatcaagtggaggaaaagtgggattttggtggtattattaacaaaagctgattgtccagtaaaaggagggattggtgatgggttagaataacaaaaggctgtgtatgttgggtgttcaaaaggaggagagggaggggggtgtttgataagatcaccatagaatagttttgcaaatctggggaggccaaatggtagcatggatgggtgatttggcttagaataacacaaaaggtgtgcatatccaggccatgacacgtcagacccaggtaagtggttggtagtgggataggacaagctctagcttttttagcttttggttatcgtctctttccattttcttat

SEQ ID NO: 44063 - DNA, 12961 bp, Oryza sativa
tcctaagctgtgcccaagtatactactgtactgggaactaagagaaagccattagataagcaacgaaatagctgcattatcatatgaaattcatttccatgctttcatgtaggtagcatgtgctttcaactagaaatccaaatggcatatgagtatctcaatatcacatcagttttaggaaaatgtcacaaacagtagttgagtaattattatgaccacaggtggttctattccacatgaagataacatgagggaattattaaaaaaaaaacttagttgaactaggaatttcacaaggatttgatagaaaatttacagaaagcagtattttcatctctacataaacataagaaatttcatgtatttcaagtgggccttacagagagcatttcaatgtggtccaaactgtccctttatttttgtccttcgagctgtgtttgatctggctgattgggtgtacaaggaggctaaaatttttactgcctaacctggaatcgagaccagaggcatgtcaaagaccatagggtgaaaagaaagcggtaaaaagaaaaaggaaagcctgggtgaaaagaaatttgtgagagctttgtttgatctgggtgactgactgggttatgaagaggctagattttttttttttaccgtctatcctggaatcaaaccaggtagggtagtacactatactccatccgttctattttaaatgcaaccataagttttcgtgtctaattttaatcgttcgtcttatttaaagattttttataattagtatttttgttatgagatgttaaaacatgaatagtttactcgtaacttatgtttttaatttttttcaaaaaaaaaattaaataagacagacggttaaagtttaactcgaaaaactatggctgcacttaaaaacggcacagatggagtagcaaagtattagcaaatagcaatgcccaaagaagcggtaaaaagataaaggaaagcctggggtaaaaaatattttttacggtggccgtggtgatacggaatctgcgtggcggatcagggtccaagatgcggatcgccgcctttaatcgggctccaaatgccgagaaaatccgctttttctccgggtcttctgcctctacacaacccgacccgataatattttaaccgtcctcctccccccctcgtgccgttcaaaaatccaaggacaaagaaaactgctgctgtctccaatctcgaggaaaattctcttggtttcactcaggtatccaagtccaatcacatatcctcttttccttttttttcccttttccgttcgctaatgacaaagagaattgtccctaatgacaaagagaattgtccccaaatcaaaaaaagtaataatgaaaagaataagagaaaacagttatatttgcaggctaaatatttagggagaaatgtgagtttttgctaggagattttcagtgtttttataaggacgaaaccagaggcagttcgtgcaaaggagcactagatcgaattcacgcaaatccacgggaaatatctcctaattatttatgggatcgagaattcacgccctgactcagggggagaatgtcttgagtacaacgctagtaaaaatattaaaaggagagcaaaaagaaaaaggaaaagagattcctttaagcacatctaaattttatttttttttcctcctcttctctcctctctctctctctgggtgtgatgggagaaaggaaaagatacagattgtattctaccgatggaagaaaaagaaaagcttggaatctctaaagcatgtgcagaaagctttcaattatttgcgtaaactatctgctcgttaatttgttaatctgccattaacttcacctcaacttgttactccaagaccatgtttattcagaatatgttccccttctaaagtgcatgtcatttaaattcaaaatatgacggttcgatataccacggtcaaaacgaatatgaaaaatattctcaagcccccaaaagtttcatattcgagtcttattcagaccaaatgcttttcttaacaaatattaataagaatttcacatgaaccaattcaattcacacggaaatcagagaggttaaagcatttcaaagaagcccccttacagaaaggtaaatgatacacgtcaaagaaacttatttacatgcgtcttagaaaaactgatgtggcatgctacgattgtttcttgatatttcataactaattgcttactaaattcaaaaaactgtttataaaagttcagtaaggttttgtaagtacatactctcgcttctcggtcccaaaataagttcatttttcacctattacacatataccagtataaaataaacaaaactataatactctcactttattaaaagtttttacgcgaacactttattaaattttaatataattagttctatctttatttgctctcaatgcatttattctctactttcacaaaattcgatgtagtaaatactcagaaataaacttattttggaacaaacgggaaatgataaaaataatcttatgagggtgcagtatagcattactcttacagaaatgcctcgtggaagagttacacaccatggtcttaggcgggcctcacaatctctgatggtaaagtgataatgacacacgaagatcatcataatgttttgatggatggatggatggagagtactcctacgaaattacatgcgccaatctcctataacaatctagaatgattggacatttcatagtatccgtccagattcgttgtaatatgaaatgtcttatctaattctaggttatattatgggatggatggaatataaaaattttttgaaaaaatgtttgtttttttttttaaaaaaaaaagaaaattacatgtgccaaatgtgcattcgccggcgacgtcgcagccgggaactttcctttttcccgcaatttattagcgcgcgcgcgccgcgccaccgccgtcctcgcgtttaaaggcgacgagacgacgaacaacacgaagctctccttccccccctcacctcgatgtcgccatcgagctctacgccttctcggctatagcctagcttgcttgcattgagctcgatcgatctggcatggtggcgtcggcggcggcgatggacgcgagcaagtacgtgaggtacacgccggaacaggtggaggcgctggagaggctgtactacgagtgtcccaagccgagctcgctgcggcggcagcagctggtgcgggagtgcccggcgctggcgaacgtggacccgaagcagatcaaggtgtggttccagaaccgccggtgccgggagaagcagcgcaaggagtcgtcgcggctgcaggcgctcaaccgcaagctcaccgccatgaacaagctcctcatggaggagaacgaccgcctccagaagcaggtctcccagctcgtctacgaccacggccgccacggcgtcgccgccgccgggatgatgcggcgagttcctgccttccctcctcaggccgccgccgccgccggccaccagctcgccaccgccaccgacaccagctgcgagtcggtcgtcaccagcggccatcatcatcagcagcagcagcacaacgtcgtccagccgccgccgcgcgacgcaagcccagctgggtacgtgacgtcaccacctgcgccatcgttcttgcaggtgcagctctagcttactcgttgttgcgcaggctgatgtcgatcgcggaggagacattgacggagtttctgtccaaggccaccggaaccgccgtcgagtggctccaaatgcctgggatgaaggtcacaacaatttgctcttcatcgtcaccaacttctcaattgcaaaagcttgatttgattttcgtcgtcgtcgtttgcagcctggtccggattccattggaatcatcgccatctcgcatggctgcgccggcgtcgccgcgcgagcttgcggcctcgtcggcatggagcccgctaaggtaattaaccttcttgtcactgtcacttctgcaataagcaacagtatttctgatcgatcgattgattggttggttggttgattgatgagttgtggcaatgatttcatcaggttgccgaaatactcaaggatcggccgctgtggctgcgcgattgccggtccatggatgtggtgaacgtgctccctgctggcgccaacggcaccatcgagctgctctacatgcaggcaagaacacacaagcctgaaaattctgaacctgaacctgaaattctgaagctgaaatttgtattcgatcttcagctctatgctccgacgacgctggcgccggctcgcgacttctggctgctgcggtacacctccattctcgacgatggaagcttagtggtgagctgctctgatcatggagcgtgtaaaacaaattatccatgtgtaattagtaccaaagtatttgtgtgtcactatgatgtcctgcctgcttgcctgaacgttcttgctctgaattctgaaggtgtgtgagagatcactcagtagcaagcaaggaggcccaagcatgccacttgtccagccttttatcagaggtgagatgcttcccagtgggttcttgatccggcctagcgatgttggaggcagcgtgatacacatcgttgatcatatggacctcgaggtactaaccattacaatttcttgtccaaatagttcattcatctagcagaatgaaatttaagccattttgtggtcgcagccttggagcgtgcctgaagttgtacgacctttgtatgaatcttctgccatggttgcgcagaagatctcgatggcggtacagtaattatagcactctgttcttgcttatttgtagaaattcttgactaattcagttatgcaaaattcaggctttgcgctacctgaggcaggttgcacacgaagatacacgttctgtgatcacaggatggggaaggcagcctgcggctttgcgtgctctgagccaaaagctcaccaggtaggactgactcctgaacagcagatgcttcttggttcttgccatgaatcttctccagctcaaaagtgtgaattttttttttgcatgctctcttttcagaggattcaatgaagctctcaatgggcttgccgatgatggatggtccgtgatcgagagcgatggcgtcgacgatgtttgcatctctgtcaattcatccaaagtgatcggttgcaatgcaacattcagcagtggactccctattgtcagtaccggtgttctttgtgccaaggcatccatgctgttgcaggttagcttcactatgaaactagaattaatattttttttgtttggttgatcatgtccagtttttttcatacaatatttctgctgtttgctaggatgtctctcctccatcactactgcaatttttgcgcgaacaccggtcacagtgggccgacagcaatttagacgcattcttcgcctccacgatgaaaccaaacttctgcaatttacccatgtcccgtcttggaggattcagtggtcaggtcatacttcctttagcacacacgtttgaacctgaagaggtaagttcatcttctactgtctgtcagttacataaaaggtcctgtccaattctgtcctcctgctcaattattttgatgcaaccatctattgtttttcagttcctggaagttatcaagctaggaaacgccagcaactaccaagatacactggtgcaccgtgatctgttcctcttgcaggtgacttcttgattcatgagacttatcaccagttgaagaatcattttcttttttttttcctctgtaaaacttgtgttcttggcctgattgcaatggcagatgtacaatggagtagaggagagcagtgcaggaacatgttcagagctcatctttgcgcccatcgacgcatcgttcagtgatgattccccactgctgccttccggtttccgcatcatcccaatcgattctcctctcgtaagtaaatctcacacaatagtttcaaatcaaatcttctgaatttttatgtttaaaaagaagttgttctgaatattctttccctgcaaatgtcaggacacgtcgagcccgaactgcacgttggatctcgcgtccacgctcgaagccgcgacgccacggagcaggatcagcggcgtcaatggcggcggcggcggctgtgctgctgctgcggcgagctctagctccaaggcggtgatgacgatcgcgttccagttcgcgttcgacggccacctgcaggacagcgtggccgccatggcgcggcagtacatgcgcaacatcatctcgtcggtgcagaggatcgccgtggcgctctcgtcctcccgcctcgtccctcccggcgccggcgccgccgccgcgcagctctcaccggtgactccggaggcggcgacgctgcccagatggatttgccagagctacaggtctgtggcttcgcagctgcttgtgtgatacagttcatatctgtcaagaaattttcacttgccatcatcgcaagattttttaaaaaaagttcactcttttttgaacgaaaaaaaaaagttcactcttcataactgatgatgctatgcttatacagatttcattttggagatgaactcatcaaatctgtagatgcaaacagcagcaatgaatcgattctgaaagcagtttggcatcatccgagtgccatactctgctgctctctcaaggtttcttcagccccctttttttcttatttagatacagattttatcttaatttttataagcatgttaattaaactgttaaactgtatatttcgtacgaaaatttttatatagaaactttaaaatataagataaatctatttttaaatttaaataattaaaatttaattaacgagatgttaaatgttaataactttctcattttacctgtccgtaatcttttatcttaaactcgaatggggccagtactcatactgctatgcatggaggattgtttgttctctgaatttatttccgggacttatgaatctttgctacagctcgactgaaattttgttttgacacaaattcaccttaaagttgacagtgtaacgcaccatttaaccatctgatttttcatgtaggcgatgccagtgttcacatttgcaaaccagtctggcctcgacatgctcgaaacaactctggtggcgctccaagacatgacgctggagaaagttttcgacgatcaagggaggaagaacctgtgcacagagctccccaacatcatggagcaggtataatcatatcacaaactgacatgagataagtactaatgcaaaaattatttttcatacataaaaaaagatacttttagattaataagtaattttgactttgatcaaaattaaactacttcaagtttgatcaagtttgattaattaagtttgtagataaatatagtaatatttacaacaccaaattagttttattaaattaataattaaatatatttttataatatatttgttttaggttaaaaatgttactacttttttcagtttgactttgaccttaagtcaaaaatgagttataatctaaaatggagcgagtacattacatggaatgcattaataatcttatcatcttatcaatagaagatacagtaagatttcaccgaggctttcatcagttgcaaattgattaattagtggcacgcgattaactaaattgcaggggatggcgtgcatggagggaggggtgtgcgtgtcgagcgttgggagggcggcgtcgtacgagaaggcggtggcgtggaaggtggtcgacggcgacggcggcggcgcccactgcatctgcttcatgttcatcaactggaccttcctttgatttcatttcattatacaccccaatgcaaaacggatatataatattacaactagtgcaatttacgtacgtaatctcatgaaacagcgtgtacaaatgttttggattttgagaaccgcggtgctagtttttgtacggatcgatagtggatacattctctgttcggagtagggataaaaatggcttcttctttttttttttctttgaaatggaatcagaacgatagagactaactcgggaacaacttattgtgaaggcaaacaagctggtcacagtcatatgcaaactttataaattaacatcgtatacgtaattattagcgaaaattcaaagaagcaagtaactaatttaagcactccattatatattttgtattaacatcggaaaaagttgttacaaacaggcgcaacaactatgtacgctccacctagatgggcgctcctgcctccctcgagagcatggcctccgatgttgctagctccgctattccctgcatggtcttgcattaaccattgaaaacccggttgtttcgttacttccatatcgtgtaggccatcaagatgatgatggtgtcaaaccctcatctttgggccgctatgattttgtctcggcgtctcaccataatatggaaggattgctcatttgatccagtgccatatagaactatccaccatagctatagtgtttatcggcattggatcagaaggttggtcaattgactcctcactttgattacaaaagacgcatttctacggaccaagcagtgtcggccctcacttgctcagcctatcaccaatccaacatcaacggtggactaccaaccaattgaaataccgatatcgtggcggcgtgtggttcttctatatttgcttgtcaagtaaggattctctccttagcaaaaaagcgtgataagctgatctagaggagtattgcttcgaggactcctagcaccagaggagcgtgtttcctagtggagaaagggtttttgcattgatccgtgcccatacggcaagattgttcatcaaggcagttgtctcattgactggccctaaggagctcgatgggattggcatcatcgatctccacttgccacagcactgttgtattatgtgtttcttttaagatattaacgtgcacttcataacaatcaacacttacagcactagcgcgttcgtaaaatatcatcgcatgatatcaacactgacaatacttcataacaatcatatactatatgtaactattttgatgaaacacatcagacttattttgatggtttagtttgtgcgataaatttctctcgaaattccggatggaaaaaaaaaagatcatttaaggacggtatttggaatcgaaataaaataaccgtgtaccgtttcacccctattttcgaagcaaacaaatacggcgccgcgcaaacgagcttcggcccaccgcgacgttgggctgggccgaaagcctgaaatcccacgttgcaaaccacaggccgcgcgtcaaaccaaagtttgctacgtcacgcatgcaatgacaccattgatttttttttcttttaaactaagtttgatcattcgtctttaaaaaacatagaaaatataaatcgtgatgaaagaatatttaatcataattaaatgattttttagtaaaatatgaattaattggttaaatgtatctcacaaaaagttaattgtatcgtatattaaaaaacggatggagagagtacaatactcatgtagctagacactacagtgcactcagatcatacaatgcaactgatccacatacgtacatgttcaatattaggtaggagtactaacactactgtctactgggccgcactgatgcagtgacagtacactaccgttggatctaagctagctagcttggttaatatatagcgtgatatataccctatctgccaaaaaaacgaatcgaactagatatgacacattctaatataacgaatctagacaaagatatatctagattcgtagtattagaatatatcacatccagtattagattgatttttcatgaggcggagagagcatttacttagaaaatacgattggttacacatatatacaaccacatactaacatcgatagagagcgatcgagttaattactatcgaacaccatggagctcgatcatctgcaccgatcgccgggaggagcgccgccgttgatgacgtcggcggcgaggaggctgcagaagcgcgggtcgcagctggcggacctggcgagcgccaccgccttggacgccgccgcgccgaggcgccgctcctggcacgacgccgacgtcctcttgtcgaagctccgccgcgcgatgcggcgcatggagcccgccagcgacagcgtcgggttcagcctcgtcgtcgcgttgaagtccctgcactccgccgcgtgcgacgccagcgccgccgccacgccgccgcccggcgccgggtcgcgccgcgccgtctccttcacggcctccgagcacagcccgcacagccagtcgccgcagaacgccgcgcgcacgccgccgatgtacgccgccgtgcactcctccgccacgccgcagcacgcgcaccgcacggtctccacctcgccgccgccgtcgtcatggcgtgcgtcgccgctgccgctgccgctactcttgatgatgatgagcttctccatcttgtttgagctttgtgagtcgttggctacgtgaagctcttgttctccctgaaaaaacgcatgtgtgacttagacttgtatatatggacgcatgcatgagaatatagaagtgtattttcatttctggatgtctcattatctgtctctgcttgtcaaattaaattatattagtgaatcaacaaattttattttgtatagaagaatcaactactatgtaaaacttaatatgctattagaaccaaatatagttcttcttttgacagtcggcagctacaactattcccagaataccagtccggattcacatttgcattctacagaaccagaaaatgaactagtcaaaaatttggtttctccacattctcaccatctcgatcgatacgtactagctaattctcaaaatctccgtatatatctctttaagtagggccatagtcaatttgagacttaggataattcaaaatcattccacgtacgatgctcaaatttcaacttaattattagggtggataactaatttgatatatgaataaatacatgttatgttattgtgcttcgtgcatatccacagtattggccaatggccagtcaatgtgaaactgacgacatcagtgatgatgtgttgtgggaattagagcaaactaactacttagatggtattaagaatcaacacaaacaacatatatatgcagagtctaatatttatgtctacaacttcaaaatgatttgtctttgggaagaacttgggagttgagatttttcttttaccttgggagagaacctgcttgtgtttctttggataactgcagtttcctggtgctgcatctatctgatcttcaggaacctgtgtatatgttagtctgatccacaatatatgatagatgcatcaagatgtgatcatgtccccatatttataggcacagagtgatgagcatctaaccactcaaaagtggtaactaaagtttaaaaagtgcaacttgaatctcatcttttaaaaatttgcaacctagaagaaggtgacaggtgatactctcctagctagttgcactgcatgtagctagctagcttgtaaaggagcatgcaggttctcctaatcgtagggcaccatatcttatgtgtgaaagggaagcttgtgacaggggcaatctctacagttcagttaagaggccggaaagggtgtaaaagattgcactttagttaacatcaattcactaatatgtggcactgtccatgtccaacatgcaatgcaccccaactgagccgcaaagcaaagttccctaggaaaacgaaggcatctaggctcggttcatgcatcccatgcaaatggcagtgttgatgtgtgtgttatcaacttatcatcacactatcaatgagtaatcatgcatcatgctaaaggtgtaaagagagaagaaaagcttatgttagctgatcacaaatggatgcaaggaacatacccaattttgggttttaattagctttttttatatatgcaaggataaaaattagtacacttctcgcgagcgaggaaaagaaaggggaggggggtgcgtatagtttatacgaaattaataaaagtataaagcaactatagtaaagattaaatttaagcgctttttaaaaagataatggatgaatcaggcgctccgcccctagaattaagttcgatcatatgctacatacaccgttattgagttatattcacgagtcagttataccctaaaaacataaaactaattagaaagagaattcaattcaatactccctccgtcccaaaatataagcaattttagcatagtatcaagtcaaacatttttttaactttaactattaatagcaaacaaaatataaaaaatatcaatcatgtaaaattgatgttattagatttatcatccttagacaaactatcataatatagaactcttgttatttaaaacatcttttatagatattgttggtcaaagtagtatctcgaagattatgtcgaagtccaaaaatacttatattttgggatgcagtgagtatatacttatactcaccttccggaagaaaccccctcatgcctcaaacatgaaattaaactgtattttatttttattcaacactactcccttcgtccctaaatatttgatgccgttaacttttttttaagtatatttgaccattagtcttattcaaaaacttttgtaaaatatttaaaactatatgtatatataaaagtatatttaacaatgaaccaaatgataggaaaggaattaataattacttaaattttttaaataagataaacggtcaaacatgttttaaaaaatcaatggcgtcaaatatttagagacagagggggagtatatttgtgttgcaagtatgtagtagcattcaatttataaaaaaaacttaagctggtgagtaatggtaggcgtcgtccacagtaatcttgcttgatccttaaaccacacatccaacacatcaacaaatcaatcatattcgagcaattgggtgaagtgctccaacggtgcaggcaaaaactgctaa

SEQ ID NO: 44064 - DNA, 2323 bp, Oryza sativa
cgtcacgcttcatcaggaaattgctaataaagcatgatactccacaggttctcgattctttttcttttttcagaactcgttaaaattggttgatttttttccctgaaacatcatcataagatccgcatgaacatttcaggcatcctctaaaacaaacatttcaggcaggcatgttgttacagttatacaagcaaagttttatgatactgagatgctcatgcgccgtgcttcgttaacatctttcactttgtaagtcggcacgccctctccaggcctccactaaagaaaaccaaatttcaatgagcggagaaatttataaattagcgagaaaaaagagaaaagaatgaaaaggattttaagaatgtgccacaaccatgggtcaatctgcttatgtcaacactggatcaaaaagaatgacaatacaatgggcaggcagggatcaatgcttcttcaagtatagcttagtatattcctcccaacctagttcctcaagcctttttgctttctccaacaccatatccctcagatcatgctggcattcagttgccctgaaagcaagtcgggtgctaacatctactttttatgaggcaacttaattagcctacatcagacaggtgtagtgtaacaactgaaaataggtccctaactgaaaacatgctagccaaataatcacttgtgctcccagacaatgtaactaggttttcagcaggtcaaggcaaaatgagaaagttgtactgatgactaatgacctactgcaaatttcgagcaactgtaacgtaacattgatcattcttttcgaacagattgatcaattgagaacttttttcatgattctacatttctactgactagctttgttggcaatttggtacattaccaaaggtctcatcagtctactcagttactcactggcttgctgcagcctggcagatatcagctcaaaccactgcttatgtataactccaggaattaaggaattaacatatgtgagccaggtcgaacatatgcaacttactgctatgaggtatctattatcaattgcatacatacatacagttaccctaagcaaacttcgaaatttgcaggagaattgcaaaaaaagaagaaatcatacttgtcccccaactcaggatctcttgaggccagcatcctaactgccaataaacctgcattttctgcatttccaattgcaacagtagcaacaggaatacttttcgacatctgtcaaattagtgagagtatcagcaccagaatcaactccgttgggataaaaacaaaagcaggccgttccaatagagatcatgagtagaccaactgttttagtgttaaatgatttaatcactagtttctctctgggctttccgcttcattagttaaaaaagaaaaaaaaatgcttgtggtaccaaatgcttatattaaagaatagcaataggtaggtcaaataacaacacttattaatgggattttgaacccagcaggtgcgccaccctcactctagcttccaattcatatatgtaacaaagcaactgtggcttgtatccttctcttttcatcagcccttcctccatctagcatgtgttcttaacggcactaaccacctacaatgcccggcaacacagaagccttgaatccatcaggtggccagtgtatgaatcagccactcgattgataatctagtgcaatataattatatattatctgctattatacagaaccatgtagatccaaaaggaaaaaggaattggtaaattaccaaaatctgtaaatctcttctcggagctacatcatcaatgataaacagggggaaaatgctctagtgatagggagatcaccaacgcacctgttagtactctagtgaatgcgtccgtcatgtcaggacctatctttgtctttccccttttcccccttatccagtatctcctgcaatgaggtcctcaaggcatggaacatcatcaaacatgtcagacgaaggagcttcacctcaaaaactattcaccccacaagctcatggcaaatcagcttaccctaggatctatgggaatatcgatgaaggaaataccagcaattcacaaagagaatttggcataaacaataaacaaacatactatttattagttctgtacgctcatacctctgtttgcatacagtatggctagtgatgcgttgcttattcatattatttacaactttcggcttcattttcttgacctttatcagaactgcagcaaaagaaacacataaagatcaacatatttttcctgggcaaagaacaaaatagaagaagttgtgcatttactgatttgcaatgaccacaaaaaaaatc

SEQ ID NO: 44065 - DNA, 1793 bp, Oryza sativa
ttatgtagaacaatgtctgacttcgcttcagctagtgaatccctcaggttctgggcttgtgcaggcccctgaaaaagcaaaggtaactctgttatgcacaatacaagtgggttttcttgtcctgaacccgagtagcatgagaaatccatgtaaaaaaataaattgcaacccattcaccacattggtcacatcaatttgttcgttattcaagcaatttgttgtgcaattgatcaattagtgattggaaaatgtcacatgtgggacactgatcatctaaatgaaacgggaaaataagtttgaagacaagaaagaaaacgattatttttttaagacaatcattcatactccgtatttgcttgatggccttaaacgcctagggaagcagcgggaacaggttcctcccacccctcactataatatatactgtgacacaatcaattcagcgagataaacaaacccccaaagagagaacaaatccaaaagggagaagggatgcaagcagagcgaacctcctcctcgtggccggcgaggaagaccttctccttgttgaagatagatgtctcgaagtcgagcgacgtcatggcggcgccgcatggcagtgaccgcgcggcggcgagcggcgcgcaggcggcatatgagaccgggaaggagacgctgaccggcgcacgggggtggtccgatcctcatcccccgaccacatggaggccggagacggcggcgacagagggagaggggaaaggtgttttgcgaaaaaacccctcggccttcacattttcaagcgcagtcctagttcgcgttgtttcctctcttcttcccggggaatatccggctttagtaagggcttaaacttaaaataacatctcagaggtaggtactgttcgtgagggatctagatcgaatttcacataaactcaagtcctatttcgttttcaagagattaattaattttctcaactttgcaagggcagtcagttttaaaagccgtggagtactccagtagtatatcttccccttccccttgcgtaaggaaaacgaaaatcttaaaatctcctccccgtctctgactcatcttctagatcagctcttctcctccttaatttcagagccttaacctctctcttaatttcagtttgtttgttcgttcgttcccccaaaaaatttggatccgcctctgcagattggtgccttccttccgctggaggcaacccccccccccctcccttgtacgcttcgtcttcgtctccggcgacgagcggaagcaaaccttctccggcgagcagcaggatgcaggtgaagcagaaggtgtacgagctctacaaggggacggtggagcgggtcacgggcccgcgcaccgtgtcggccttcctcgacaagggcgtcctctccgtccccgagttcatcctcgccggcgacaacctcgtctccaagtgccccacctggtcctggtagctctctcctcccctccgttgctccccctcaattgctgggtttgggtttgggtttgggtggcgtctcatcgatccccctgtgtagggaggcgggcgatccgagcaagaggaagccgtatctcccacctgacaagcaatttctcgtcaccaggaacggtatgctgattctggattgcttctatttcatcttgtacatgcgatggaatggaatgctgcattgggtggcatgattgttatgcttagtttccacttcctagtggtcttgattaggccaccatgttttggaatgctatattggaggataacaactagtaaagttcggtttccttcgtgttttagttgaaa

SEQ ID NO: 44066 - DNA, 1121 bp, Oryza sativa
gaatgattcagtggtaagaaaggctgtgatcctttcttcgatgtggttaaggaaggctcataatgttcatagtcattactgattccagctttgccttcgtcatcttattttaggctaccgctcaaccttcatattttgtcgcagaagagcctgaagatgacaacatccttcgtactaggacatatgacgttagcatcacgtaagctcttttatttgatcttcatgctttttaagtcttttgttagttggttagtattagttgccttattatgtgttattagtttccatattatcttcctcctctttctgagtctgtatatgtttacacagaacttctatagacattaccaggatttatcttcaatcacatgttctttcgaccatccaagttttatattttgcatatctgctcctcggcacttaaatatagcacataacacactatctgtgaacaatgaatcgtagttggcattatatgccttgatttcaaagtatttgcatgtacaacattgtgcaagtgatattgctgttgtcttgaacttctccctgttgcttctgagcaatgatgttgtcctcttggttattttttatttgccatagtattgtgtgcctcagtcttctagtttaagaaagtaacaagtagttctcttatttcagatatgacaaatattaccaaaccccacgtgtctggcttaccggatatgatgaggtaagtcattttgccattagaagtgtcttgttgcagtcctgaagatgaagttgattcatttaattttattgttgttgcagtcaagaatgccactaaagcctgaacttgtgtttgaagatatcagccaagatcatgcacggaagacggtactttcattcattttagtatttgctattgacatgtaaaatgaaacatgaatcaacttgaactggattggttcaccaatatccttaattttgttagtactgcttatattttgaaccgagcctttcaatgtcatagagtacacactacgcattaagccaatgaaaagtatttgaagtattcattttttaaaaaatattttatatcagtaatgtctccagaaattagattttgcaatggtagcataccggaattattggcctccttt

SEQ ID NO: 44067 - DNA, 6324 bp, Oryza sativa
agcatcaagggcgcccgcgccgtcctcaacttccccggcctcgcccctgccctcccgcgcccggcctccctcgccccccgcaacgtccacggcgccaccgccctcgccgccgtcatgcaccaccacaaacacccctcctcctccacctccacctcctcgccgccggctgctcctccgccggacgaacaccaccctcgccacgagccgcagcagcctgagtcgagcagggaggatgaccagcagcagcagccggcggcggcggcggcggcgcagatggcggtggccgagctggtgttcgacgagctggcgccgctgtgggtggaggacgtggtggagttcgggacgtcggatcattgctggacggcgtacgatgcgcttgaccccatcggcttccagcctctcctctgggagtactaggctgctgcttgtaaaacagcttcctcttcttttcttttcttttctttttttggttttgttttttgtgtggattttttcccctagtgctgcttaaaatgtggcttgttttttttcttctctctttcaatcttgatttgagttggatttggagtttgtgtgatatatgcgatggaattagttcgagatgcgtgcacattttgtcccaggaaaaatgcaatgcttaactcgaagcagaagctcaatattgtggttgagactgaaccaaaatcaatctaaaatttgagggttgaaaatttagacttctgcgaaagttcgagggatgtaaaagaagaaaaatgtcaccgtattatctatttttgaacgagaggtttaagctatatatataagcactttgtttactctgagcaatgggatgtaattttcatgaaagcaagcagtgcatatatcgactaaacgagtccagaacttcagataaaaacatatgctagattttctagaaactgacggctcatggcttttgcttgcgtaacagcacctatggtaaaatagtctttctgaattaatcgcaaaaattaaaaaaaaaatctttctgaattctgacaagtcagaagaaataaatatttttgctggctcgatcgcacaaatacctgcacatcttgccattgtgatcactttcactatgcgtaacataagtcatcgatttttttttcgaacacgcaaaagaattacacatcaatatattaaaagaaatcagagttttggttacactacgcaaacgaccagaaggctattgccaggggacatgaaaaaaatggaaggaaaaagaatgtaaaagaaaatttcattaccatgaattccttgaaagcaatttcaaggaccttactactgtaatacttatcagaactgactactactaccactacttaaactttgaccactaatagcttttaaactgccagattatggcgatttaaacaatgcatagttgcaatgatgtttatcaaaatttacctgcaatttaaactgtatcaatcgctcagcaatcgaaccttacctaaatactaataattgactctgcagctgggacctgcagaaacctagcttgggaattaactaagcatggtgtcccatggcaacgccgatcaattcattaatctgtacaactcagagatcctattgagattcgatgaatgcaatgtgaatcgtcagagaagttaattagctgtgaataaaatctaaagaaactgatcctcttacagggtgttagctccacgtacgaaaaaatagagtaaattgggtgcagtgcatgtatgtgtgtgtttgtctgtcttagccggccgctggtcgctgaacctgaacctgaactagctgtctgaatatttctgtcgcctgaatctgtctgaatgatcatctgatgatctgatccgacggtccagagctcgagccaggccaaatgtgtgcaacagattcaatggctggagcccccatcaagattcaagaggtagggacggctgcattcactggcgttgtcatgtcactcagaaaaatatccatcttgacccgggtaatttctcttcggttttcagggttacaaatctcttttggttttgttgaaatataagcacttctaaaatttttcagagagattatttgagaagataagtgaaactaaatgagaaatgatcagtgacggagccagcacagttgtaaaactcaaacgactagtggtgtttttgggtgactggccgatttttatagatgactaatgataatagagacggcagcggcggagcctgggtggcagcccgacctatccgggagttgccttcactgctggaaatgattgcaattggttaaaacaagagagtagtcggaggaattactatatatagtttgaaataaaatttgaacactaaaatttgctatagtttgggatgaagtatttttcatttctccctttaatttcctataggaattgtgtcttcaggttgaaattaagcacatgcagtgcattttagtgagattagagatttgcggctgaaccctgactcttttgagcgttcgtgtgcaatcacgttttctgtgtaatcgtaaaaaaagtataatgcaaaaattttacagcaactttgtaggattttccaacgaacttatcaaattacttctgcaatagccaagaaaaaaccctgcgttcttgaagctgtatatggtacatgatcatcatagccaactttcttgatctggataatttgtatccaaggttaagcagagtgtgacaactaccaggggcatatcttagataccacaattttgcaaagatttctggaagaatatatacaaatacagtgataggccaacaacatgatggtcctgatgaggaaacagtctgattagctacatacaaatcgccatgtgtgttctcctcctgtcctgagacagtgagacaccagagattcagaaggagacggctaatgacagttttgatggattattacatgcaagccacacacctgtgctgaatgtatgcatcattatatcctgcttagacaattctaatacccctgcaggagttactcctatatatatcactcagagacagtgtatgtgattgacattagagatgacacctgtgcacacgtgtcagctcgtgatagactggctggagattaccctgagattctggacatgaatgccactaactgtaatgcctcctggcgtgttgatgtgtgtgcttgttaattagtgcaacagttgcaatgtgggttgccataagcatcgatttggggaattaataatccatgaggttgatataaactatatggattaacgatggatgttggctgtgtgcaattgtgcagagtgtttgattacgagtcaactttgttcagttcagatcatatttcactggtggagaaaccatctttagtcggtccaccagatttcacaatagtcccgattgtattaaaaaccgggactaaaaacatatttagtcccggtttgaaagctctgaggaattttttaccaaccgggactaaagatctatttatagtcccggttagtaacaccaaccgggaaaaaagatcggttgatgttatcaaccgggactaaagatctatttttagtcccggttggtaacaccaaccggaaaaaaagtcgacataagcggggtggttgcacacggatcggatcaatacaatctcatcatctccttttttaactcatctcctcatagagtcacccttatctcttcctctccctcctcccttcctctcctcctctccacctccctcctccccacctccctctgcaacggcggggcacggagggccggcccgcgcagcggcgcggcgagcggagggccgggcgaggcggcgcggcggcgtgcaggcgcactggcggctggaggcggcgggcggcgcggcggcggccggcgaggcggcgggccgttcgtcttctttctttctttttttttgagaatctgtgattcggatctgagatgatttgtgtgtgatgtatttgatgtgtgtgtgatgtgaatatgtgatgtatttgcaatgaattttgtagaagttgtgatgtaatttttttaagattttgtgatgtattcacagatattgatttgagaatttggagactattcgggcatgattgatttaggattttgggatcggatagagtgaatcaatatattaaaacccatgaagaaaagcatagaataaagtagcagccggatctagcctctttagtcccggttggtgtcaccaaccgggactaaagatagagtatctttagtcccggttggtaacaccaaccgggattaaaaatggatttttactcccgattttttcaccagggactaaagatagcgatcttgagtcccggatttgtagtcccggttggaaaaccgagactataggggggttacgaaccgggagtaaaaactccttctccacaagtgtttggaatatatgtgtgcattttactattttgggtaggataattaagaattagttcaaagttataatttagcacatacttgtggtaacgatatatttgttcaaaattatcactgatatgtgcaaatttttcacaaaatgctgctagttaacttgtaatattgtagggattgtgcttgtttagaaacaataatcaatttgacctattttacttaattaacataaataatgaatttctagttcaacgttatgtgcgttttaaaacaagctgaccaaaataaaactaattaaaacgctataataatgttgattattgaaatgcactgttttcttaaataaatggccctactctaatcaacatgtacatgctgatgtacttctattaaaaaaatagtacacaataacttttaaacgctaaccacatgataatattatatgtagctaattaactactccattcgtattttaatatataacgctgttgatattttgagatatgtttgaccatttatcttattcaaaaaatttatgtaattattatttattttattgtgacttgatttatcatcaaatgttctttaagcatcacataaatatttttatatttacacaaaaattttgaataaaacaaatggtcaaaatgtcaacggtgttatacattaaaatacgaatggagtagttaattaagataagttaaataatgttggtacaatgctacagtatgtccaccctcgtgcaagtatgtatacagagctagctacgtactaccaattaatattagtgttcatcagtatattaattagtcctttaagcacgtagcttgtcttcaagatacgagacaaaagatctcttagcttacagccattaattgtcacactcaacccaaatatatatacttatactactacacataatacttcctccgtttcacaatgtaaatcattctagtatttcccacattaatattgatattaataaatctaaatagatatatatgtctagattaattaacatcaatattaatatgagaaatgttagaatgacttacattgtgaaacagagagagtattatttacaatcttacatagattaattaagctaattaataagctgttgatgttcttaaactcgttgaaacttaattattattttcccttaatttgcccccagttgtaggataattcatgcatcattgttcatgatgaattgatgcgtgacctcgtcaaatgataattagttggcgccctggatgccggacatgtggtgtaattagccgcagtttcgctgcagggccatcaagaacaatgtcaacgttaaattaatcaccttgatttaatactgatagagcacacggccattttgctttgatcaatataggtgttattatgtgtgtagctgcatgtggttcgtctttaatttcctctctaaatcgaatgggcagaactactgccacatccggtttcgaagaaaaaatcgccctgatgaatcaattcaagttttttttctttgaataaggggacttttctttgttttttagcagcggctcaaatagatgttttctttgtttttttacctaacttcacagtcacttaagagggtgtaggtttgatccaaaggcagaaattgattcaactagaatgttatcaaattcatagtgcagaaattattcaaccactagaacatttttttcggacgggatttcgttttgtcctgacgggtttttttttccgttagagcgaacccggttttcagtgctgaattgtttacttttccccatctccctggtattatttgtgtttttactcaatattttctaaactctctatatatgtgtaatttttatagaatttgtacaattgtcaaggtgttacacgattattttcgtgagtcttataccctgtttagatgtgactaaaacttttaagtccctatcacatcggatgtttagacacta

SEQ ID NO: 44068 - DNA, 2888 bp, Oryza sativa
  unsure (1)..(2888): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataagccgccttctgaaaggaatcagactctacttttaactttagtctagtacaagttaaacggctgcttaaaaccaagacttggtaaatgttgactttagtcaatcgaagaaaaaccttgcgcaaacagcaactactgaatttagcaatttcgattggtaatatcagaccaaattccattcactctattataatttgaagtatggtgaagcttatacttcttagaagaagactaccaaaaatggtagattttagcacatattttatatatataacattggtaatttcataccaaatttcattcactctattataatttgaagtatggtgaagcttatacctcagaaaaaaaggctaccaaaaatggtaaattttaacagatatttaatatacataatatacatttatgaagtacacataagactacgatttagtctgactcaacatttacattactcgggcacacaatttcagaatcataggactcacaataaccactgaattttgcaaatttgaccgaaaatgaataccctgagtgcaattggaacttgacaagttctgatcatgtttggttccattccacagcctttcctagcaagtactaggcaagatttctcatcaacttggccacatgcaggacgtacattcactgcaaccactgaagttttgcaaatttcactaaaatgaaaccccacgtgcaactcggaacctagttaacaggttttggtcatgtttggtcccattgcacagcatgtcttagcaaggagtaagcaagatttctcaataacttggccacatgtagggcgtacgacccactagcgtggggtacactatacaaaaacaaggaaccaagcatgcccaaaacttcgtagatctaattcacacagcatacctagcaatctgaaatatacaattgagctagcatttcagcaaactgaaaccagaacatggagaattgccagcctcatgataatgacatctgtagaacacccaaattgccgctaaattaacaaatggccttcttccctctccttcaaagttttttttcccaattaaaaggcatttcacagctagactttcctgtacataacgtgatatatatcccccggaaatatgggggaaaggaagccaataaaacttctcttgcaaaatcacgtcgatacgaaattacttgctaagcattggccttactgctgcatagctcgatagctggagcggcttgaagggaagaccggggcagcgccaaagtcactgggtcttaggccaaactgatgatgcccatccccggagtgcccatggcctctccttgctcttgacttctcaacccgggttcggcggaagacttcttgaatttggcggtcattttccttcagcatctgatcgacattgcctgaagggcaaattagaggcccagaatggtggatcttgttaccctttgatccatagccctgttcagacaagaaatagtcaattagaaatctagacaggggaacaaagtaaagttatctgacatcaaagctagtgctataatatttttcggtttttccaaatgtgttaatcgtgaactacaaataatgctaggtaaacctcataataacctgctggaactgaatacataatatatgaggaccttggatttgctgaaagaaacttttcaatttgacaactgagatttgcaaaaaaactgccaactatgaattaaatggcataacaaactgttttcatacttttgctacttaggtctggagatacttacaatagctccatccaccctgctactcctgtcatctttctgctgaaatacttgatcatactttccactactactgaaacgctcatttatagattcagacagcctccgttcatgcggaaaggcttcggcttgagtaaccactgttccattgccattatctgaacgaatatttgatcttgttgatacaaccacacggaagtccgatgcgtttgcaacaccagaaagatgaatatcgccattttcactccgtccagcctttgaaggtttattttgattaactagaggcccagaatggaatgttcttgtgtagacacgttgagagtcttgagacgattcagcaggatgagttggcctgggtggctcaatcggaaagccagatgcagagtcttccttgctgggattgaacatctcactcctgctcttggcattgacttggttttgtcttttctgaaattgtacacaaaaataaatatattcatctaaaaaaatagaacaacttggatagcaagattgtagaggaaaaatacacttggaatgtgtgctggctattaaaggcttcatgtacttgtggaaaaaaaggagacaaagcgcacagcttagacacatatgaagatcacaatatagagccagtgattactatgtatgtgaatgtaacttacaaataagcatatacggatatacctcatcaacctaaatatgaatagtacaatatattcaataacagtcaacaaggtattacctgcaaagatgacactaattctgcatttgcgtcaggtgcaggaactgctctcgactctctagtccgtctttcaggatcatacttgtgttgctttcctccagcaataccttgcctacagaaatgtgcaaatgtcaattttgaaagaaaatgcaggcattgcagattcatgataagattgttt

SEQ ID NO: 44069 - DNA, 3231 bp, Oryza sativa
ctcctctaacagtaacatctagtggatcatggtacacagaaatgaatagcaacagagcttttatacttctaaatccaaaaccttgatccaactaggacatgatgactttcatagacattagagatggttcagggggaattattttgcagaaagtatttacttccaaacaaatatagctgatctgaagtttctaaaaaaaaggaaaataacgttttaacagtgatactttgctattttaaaacttcaaacagcagaatatttgaatgcagcacattactccctctgttacaaatctctggtgtttctggaattgtacgctctccaacatgtgcctttgactgttacttttaatttatattctgagagagtgagagtattattttacagcaaatgtaatggtaaggctttcatctgattaatcttgatagtgttatgtgggttagcatttattgtctgagagttcacggcacacatgccatgttgacatacatttgtaaacagaggggacaattgagaattgaaatggagtaacgtataatcaaatagaatctctatatggattctctctcgaaataaaaaagaatctctatatggaaataaacaggaatgtctccagcagctggagaaaagtccaaggaatttgaatacctcactttgcaatgcagaagatgctgttcctcgatctgctggatcaactgaaagaagaacatccactaacgccacagcaggcggaggaaaatctttaaatgtttctgatacacgcctagcatatggatgctgtggcttaaaaattgtggcatgaggaagtttagacttcctccaatagtcctctgatggtgaaccacagagtttaaatattttatgtaactgctcaacctacaaaaagaaaaaaaacaatatgaacactatttcaagacaaattcaaagcattcactaatagcgtttactccctctgcccactaatataaaacgtgttttgattacagaaattcaaatttgaaagattttgaccaatgattagttactacctctgtcccaaaatataacaatttttagctatgtatctagacatacccctgtccagatacatagctagaagttgttgtattttggacagagggagtaccatacaagcacatttagtgtgtcaaacttatagcattagattcatacttcaaagtaatttcacataatattggttttacagctattgggattatatttaatgagaaattagtggtcaaagtttagtcttaaaaacattctgcaattaaaatgcaccttataaacatgaatggagggagtacttccaagtaaaatagtggtcgacagcatacctcagttctaccaggcatgataggcttgccagcatataactcagcaagaatgcagccagaactccaaagatctacagcaacaccataatttgtggcaccaagcaaaagttctggtggtctataccaaagtgtgaccacacgactagtcaaagggtgacgttgttcaggatcaaagaaacttgctaggccaaaatcagctatcttcaaaatgcctcggttgtcaatcaaaagattggaacccttaatgtcacggtgcagaatgtgacgactatgacaatgctcaaggccacagagtagctgctgcatgtaacatttaacctgcaacaacagaatgatcattgcccgcttgctttactcgtattttaagtaaacagctacttgaggcttttttaggactactataggatgcaatatattcctttagtctttctttacagctaataagatttaataacgagtacagattccagaagaggtaatatcaatatacctgagactcagtaaatttcactccaggaaaagaagctagtccagctaggtcatgttccatgtactcaaaaacaagatataagctacaagacattcttgaagttactagaccctccagcttaataatatttggatgatcaagccgtcgcaaaataaggatttccctggccatgaacttcacactctcaggttccaaattatcaaaccgcactttctttagggcaacaatcttctccttttcaagatcgcgagctctgtaaacattactgtatgttccctgaccaatctgtataaacaaaataacaacaactgaacacaccatggtataaagggcgcaatcagtccaggtgcaaagtaaagtttaacagtgcacaatctagttacaaagaaaaagggacataattgtcaaccaaatagcagttcctaaaattttgaagttcagagaaataaagtatcccgtagcaaacaaaacaggaaaccgcggtattataacagctaaacaccagtgattcagctaaactgaaactggatcaactgttagcagaatatattacattattactattactatttaaattttaaaccaagtttgcaggtgaaaaaaaaaagttgccaccatactctcagatcccatagcaatgtagtactactactagaatagcattgttcaccccaccccattaatagcagggcatgagttgctagtaatgcccactgttcccaggttccaaggtccaccaaaattatcaagaaatccaaaataaagaaaatgccaccgcattttcgcatccaacgtaaaaggtgcctcccactaataacagatttgtactgtttccagtcgtcctagctaccaagaatccacttaatagacaacccaaataaaaacatcgcgatagtacccaccctcatcaatcgtcagtaaatatccctgtaagaggggtaaactccccacattttacagcccaattttaccttttttccttccattagagaaagtatgaaggtggggagcacattgttaatgcatcaatttatattctcaacgagaaacagaaatccaaaagggggaattcgcagcccgcattgctccaaattctcgccgttccaatgttccaaattagagatcaaagatgagagcagaaaatgaacagagccaaaatggagatgtagagagagagagagagaggagaagagagtgtgtgaccttgtcgagcttctcgaacgactcggcgcggcgaggcacccacccgcgcacggcctccgcggcgacggagacgagccacggcggccaccccgccgccacctgctccccctccaccgccctcggcacggggctcctcaccctgcacgccgccatcgccatcgccgccgccgccgccctcctcctctccgccgcctcctccct

SEQ ID NO: 44070 - DNA, 17525 bp, Oryza sativa
tccccctccctcctcaccatccccacccccatccccacacccttccccgccgccaccgctgcctccgccgccgccccgcacctcccatcatccaccgcagccgccctcccgcacacgcaccccatgcccgctgcctacactcactccgcccacctcccgcgccggcgccgccgccacgggcgcggcatgcggaggccgggatcttcccggggtaggtcgccgcgccgccgcgccgaattggggcgcgcgcggctagggtttggattggagtggaggaggaggaggaggaggaggaagtggaggggagtagcaaaaaccagcaagggagtagtagcacactagcaacggccaggagaagaagacagcgagaggggaaggggagggacctgtttgtaatttctcggttttgtttgtaatttttttcaggggtgtttctgcttaatggcttctctctaggtctttgaggggagggacctgtttctaatttcgtggttttgtttgtaactttttgcagggttgtttctgattaatggcttctctctatgtccttttgcatttgaggaccttgaaggatggatatttttgaaatggaggtaaatgtcaataccttgattcctcttggtcacatttctctcctctaataacaagttaagcaaataaagttaaggttttccgtaaataggcttcgattatagataaagaaatgtcgaatttaaagtttgtaaaagtaggacccctagataacatgcaagaagggatttgtgtcattggcatattgttcgccaaatttctagatgagggctatatataataattttcttgctgatattagcgactatcatcttggagagaacggtagagaatagcaaaattatccacaataagctcacactgtatgattgattggttaatatgataagaatgtctagatttgccaacctttaacaataaaaatcagtcacgctttagttgcatataaaacccacgccatgctttcaatgaacactggtgcatgtatgggatcaaaactgcattgcgacactcgatactacgaaaacacaacaaatgtataacttgatcaaacttgactaatcacaagtatgtctatttaaccacgtggctcctaagcccaaaagaagaaatactcccatacttgaggggctcaaagagtcaagaaccatagcaacacagttcatgagcggcaaagacaggaagcttgtgagacaacttaaaagctgaataatcaagcttttggggggcatatatgcagatccctttttcttgcccccacacttctttaaaaattataaataaataaacaaaaatacagaagctgttcttccctgtggtgtctctgcaccggctcgccaacttttcctaccctccaggatctcactgacacgtgagtcccacatatccgggcccacccgtcagcgacacgtggcgacgcgaggggtatgatttctggtgcgggtcttcgagaacggcgccggccgttaaactgttgtcactgggctaagctagctagctgccaatttggctcgttgctacgcccacacggtgccacgtacacaggatctgggcatagaggtgtgtgtatgacatggtgggcccaccagctgaactgctactgtttgtgtattgtgctgatttggcaggtggttgtggtaaagcttcttcacgatgggatcgagatcgagtttttttttaactcaataatcctcgtgggcaaaatatatgtttttgtcacgagaaatgcatggtactacgtgtcctagaggattttttttcttactaattaaatccaagctcgtttgttagtacacaacgagagctttactactggccactaattcacatgctaaagctgatttatacaggacttttggcatttatatatactgtcatggtgtttctatttttcttttcattgcaaaaaaaaaaaggacgctccctgtcgtccacgcgcgggcgaccggccgccgccaccggagcgcgccgccggaaaccgcgcggcccgccgggatggcggcggcggggccaaaacccggcggtggcccgtcttcggcgtgaggaggcgatgcagcgtgccgggaggccgcgcggcggcgcggcttgtggctgcggatccggcgccgccgccgccggatctgatggcggcgcgaccgggcgacgggcgacgcggcgcaaccgggcaacgggagacgcggcacgccaggagacgggggttgacggcggctggtggaggggtcggcgacgatgttggagatgatgcggagaccggcggcaggctggggcggcttcgcggtgggcagcagcgactcgtgccgaggtcgcggcgtcgacgggaggttggcgccagggcaggagacggcgcggagacggcggcaggcaggggcgacgtcgccgtgggcgggcagcggtggctcgatccgtccgcgcgcaggcagaggctgtggcggcgtggtggtcatgacgacgacggagctgcagcggcgcggacgttgagccggcttgtgccgccctggctggatccggccatccacgaccggatttcgcctaggtgggctccagcggggttgttcgctggcatctcattggcgacgagcctcctgccgagcagggggcttctttggccagtggaggtttggtggctcaagggcggcaatgcatggatgtggagttggcgggacgacggcttgtgctggcgtgaagcaggaatggggcttgatgtccgcggcggacttcctcgttgctggccgagtgtttttcccttccttcggtttccccccttctttggccggacccttttctggtcgtggggaacgctagggggagggcggaggcttcggtttgccgtaggagtttgcggcggattgatagcgttttgagggtggccaagggcccgtctttgccgtttgttacgatcaaggtatgaatgcttgtgagacgtcatagactattctatggccgtcgatgtggggtgcttgtgtgggtaaagtgaagatgctagcgaaagtcttgccgtgcctttggccggttcgacgacgacggcgctcgtggtcgtcgtttcccttcttggaggcgttgtcatggcgttctttcatatcccccacaaatcttcaggtgaaaaccttgttccggctttcggacgagcggcgacggtgttacgcgtcgtgtcctccttgggggcgtcgcttcagagaagtttcaacgcattgacgactgttgatggtctttttcgcttcgaaagctttcatacattgtgttcggcgaggctttcgccttcttgggtctacttcgtttcttgtggtgagtgtcacgctctttggttgtttctgttgatgaagtcgaagctgctcgctgatggggtgcggcgaagcttggcaacgatgacatgttgcagtctcttccaaggagttctggtgctagccgtgtgaaggaagtggctcctcgatggctaggctgatgtccattgttggatgccggagctgcttttcgctttggtgattttcgtggattcagtgtcgctgtggttgtgaagtcggcgctgctgggtcgcttgggcggctagctcgacaacgataacacctcttatgtgatatgggagctgtttagtcgcttttgtgttcagcttggcggcgacatcctgcgtttgggctccgccgtagttgttagttatgtagggtggttttcagccggttttcctgtaattaaccgtgcaattgtatggttttcgggtccgattttccttataagctgggtcaattctcttcttctaaatataaaagtggagcaaagtttcgccttaggtttttttttaaaaaaaaccatgcgtctgagtttttacaaacatcctatgtgtgtgtttttggcagtatgaggatgtctgtttcctcgcactgacatcttacttgaaatgtcgtctctgcaggtctgcagatatactgtattgtccatgataaaattaagagtagaatataaacaagcagacagctaacagcttgctaccatgagcagtcaagagacaatgcaaattaagattgcaagtgtgtgtgccttgaaagttgaaaccatgcaaaagtacagacacccaatccatacattaattacacaactcaacttgcatcatcatggtaagtattggttcatttttaatccatccaagcgatgacccaaaattaagtcagctagccatcccaatgtacacaaaattaatgagatagagagggagagagagagaaaaataactagacaagcgtggacaactggacgaccgaattagagcaggtacaatagcaggctataaaccagctataaacatattttaaagagataaaggaaaggagagaagagcagcgggctacagatctgtagccagctgcagcacagactctaagacgtactgtgtgtacgacaggtaggaccaggtattaatagtatagcaagtaactactgtatgaattagctattactagcaaaagtgcccgtgcgttgcaccaggtgattactgagtgtgtatattgaccaaaagtgttgtttggtttagcaaaagtgcctgtgcgttgcaacgggaagcgtatagatcagcagaatatggaattaattaaaatataaattcactgaaatatttggtatttttaagtaggtatgtatataattaaataaaaatttacaagtaaagtatgtgtgagaaataaaatgatatggttaaatttaattttattaaattctccatgattagtttcgctctttgaaattttatagaattttcagagcttaattgctaattttaataatacaaacttcatttaacaattatttaattggaaatctaatttaagtttttgttgggccgaccgacctacgtgtggcccatgaagcgcgtgtggcccatcactgatgcggcccgatgatggaggccagcccgacgcgggagcgatctgagccgttcattttaatggacggctcagatcggctcctaatctatcaaaacccccaacccaaataaaacctaaccctaatttcattcttccccttcctcccctccacgcaggccgcctctctccctgccggcggccgcgccgcacccccaccggcgcacctctccacgctccttcccaaccggcgacgcctcttgcccccctccccaccgccggcggccttccccaccgagcagcggcgacgacggcggtagcggcgccctgccctcccgcgagcggcggcggcggtgacggcacactccctcgcggcgggcggtggccgccgcaccactctctcggcagatccggaggtggtggcggcggcggtagccgccggtggatccgaaggtggcggcggtcgtggaccggatgcggctccctcctcccctctcgcctccctcctgcccctgatccggcggtgatggcggtgtcgtaagttcaagtgccttaatttggtttcggtgattaatgacaaatctaattatatgagattaacgtttttatgagcctttctttgactagtcttatttggatatgaaagtaaaaatgatgggaggtatgtattaaacttcgcatattctaacttggtctctcttgtggatccaaaatatagtgtgagctccctcattgatcttgattgattatgcacatatgtgttcctttatatccatatgtatgtacacttgagggggagcttattctatattttgtttattataagatttctatcttgatttgaaaacatctttcatctcatctctctatattgtttatatcgggttattatccatcaccaaagagagaaaagattgaaagatcttggattaaacaatttgtgtaattgttacgttggtgatagatgataaaccgatgtttatgggattaacctctcttttgcataagttatctactaggtcatttcccgataatgagatgtggaagacatgcattcttttgtgatggaccttaatcatgacaaggatgaaatgcatggagataaaatgatatgtaccacttcttatctcttactttttgataggttcatatatatgatttccatgttattgatatataagtgtgagactaatgtttacttgaatcttatcttatttagtctcgtttacattgagaacatggagatcatgaaggtatatgttttatgttggtctatatcattactacatatgccttctctctatgtgtataggataaaccccaattggtcattctctaattatgcatacacttgcatctcttgtatttatttgtatgcatatatttagggggagtaaatcctatacatttattgtgcatgttctagatccatgttgttcacctattatttatatcggatctttgcacttaaggttgcatacgagtatatgacacttgtgatgttaatgaatactcaacaaacatatccatatctttcatatgtaaccggttggtcatcaagtgaaggatgacaactgatttgttgagactaatgttctcctttgatatgtgaaaaggaatagatcccactatgatgaggctaatggatgacaccatgggttaatagtcaccaagctaaggacatcgccatgttggcaagaatgaaatcaagcttgtgatgagaagaaagtcttgacaaatgatggtaaataccttggtataaacatggttgaatcaaatggtcacaagtgttgatctcaactcaagcttgaccctaagatggatggcgcaaggcaaaggtataatgtagctaagaatgttttcttagtcttttcctggtcttagtgtttggtgtagaccggatttgctagataggcgctgtactatcaagaggggtctatgaagcgagcttgtggatgatcttgtgccatattagttcatatgcatgtaggtgtatttggtgggcttgtctagccaagtgtggtgagttttctcaagtcctaaacaaagagagatgtgggcaaatcctataggtttgggtagcctcatgtggttatgtccggtggagtatcctttggagtgtgagccctttctccctgagaaaatttgtgtttcttggatggattgttcatgggttggatagccctttgaataagctttccataaagccaagaacgccaaattccgagacccgagtcaagagatatgttgttttactaacggtcggttgagctgaaaagtgatctgcggtctgaccgggcctgttagccggtctaaccggcgtggtaaggccgatctgaccggccccagtggtctgttgcacttgtctggtttttggtggcgagacagagccgccaaagccacaaccggtcggaccgagccaaaggcagtctgaccgagccgtggaaggtctgaccggccactacactgcggtcagaccggccaggttgagtgggctcaatgattgccctgtaacggctagttttctagccgttacaaagtagtccggtctgaccggccactctatggcggtcggaccggcagagcacagagttggggatttcgaccccaacggctagttttggtggttgggggtatatatacccactccccagcaacaagggtaaggttttggcactccattgcattatattgaacccttgcaagagctctcacacccttggacacttagtttatctagtgaggtgttagagagtgagttaagccaatccaagtgcattgcttcattgttatagctagtgtggcacttgatcatcctcggcaagcatcctagacttgttactcttggaggttgccgcctcctagacggcttgtggaggtgttgcccggtgacctctctgaggagattgtggaggaggccaggcaccggttgtgagtggtttggagttcaccaccttcggagtgaaggaagaactaccctagtgatcgaggctttggtagtcctctccgtgggccagctcccgccttacccaccccttgacgaagggggcgtgcggtggcttcgtggttgagcggtggagttgggctcgcctcaacggagattaggaaaccggcgagtttctgaacctcggtgaaaatttcttgtctcttgtctcctttattttatgcaaatttactttgagcaagtttacatactagagtttatttgtgctattatcaccctaggcttgcaaacctcaacataggctagcttctttgtgcacttacttgagactagttgatttaggttttgaattgtgcaaaaccattttgatttacgcttccgcatataaaactcggttttagctaaaagtttgaaaaaccgcctattcaccccccctctagtcggcctccttgatcctacaggtgtcggcggcgtcggcgggtgggttcgtggccgacggcgaggtggcgaggagcagcgcgctgcagcctccggttcggctcgccccttctctcctagtcatctcgtgttaatatgatgttttctaatgattccgatttagatttggacttggattttgtgtttgatttggatttggattgtgatgatttgagattggagagaaggtgtgctcaatgtgggattctatttgtgtgatgatggaattccgactgggttttttgagggggggagggacgaaaaattaccgtatggatgaggtaacgaccggaaaaatccgaatatttatattagttatagatattggctataaatgatttggagctagtagttagctatactattaaacttgctcttatagtaacaagtggagggacgctgtcacatgaaacaaactgaacaggcggactgctatagattacatagagagattattattgtcctcgatatggttccaaatcatgtatagttagatccgcaatttatcattaccgcgaagtgcgcgcgcaaataaactaaaatagccaaactaccgagaatagcagtagcacttgatgacgatgaactcagcattacagatcgaggctaatataggcatatgcaatttgatgtaattaatactacattcgttccaatttaagtgtagttatagattttcgtgtccaacgtttgactgtccgtcttatttgaaaactttatgaaatccttttaaaaaaattagtatttatattttatcatctaataacaacaaaactactaatcatatttttctttcaaacaggacgaacggtcaaacattagacataaaaaaaaatataaaactgcaaccttttttttgacgaaggtagtactatatattccaatactattatagtacatccgttcttatactgatcgagtagggcattaccgagtaactaaaaaaatctataggtgatgttccatatatattttcatttgatttagtcaccccctgtatatatggagctcgatagatcgagcgagcgtgtattcttggtttgttgcgtggcatgtagggacaaagtatatatggtagggcaatagacgacgcctggttgctttgctttgcttgctcaagcagaggcagaccacatgcatgcatccattcgacgatatatggatctggccggtagatcgaaaaagctaagccaaccccaaccaccgcgaggaagtggcccttcccgatcattaatgcatgctgctagctactccctcagtcacataaaaaaacccaattacaaagacgaatctgaatatagcatatgtttaaatttatccttggaatttaatttttgttaaaatagaggagtagctgctacctgtatatacaaacactagagattatcttcttgttacgatcattaatacatttccgaggtatagcaggcaacaatgactctgaagaattattgcaaacgttttagctacatatatatagctcatgatctgttactaatggagacgccgtacgtgatgtgggtatgtatatatggaatcggagcatcgatcgatcgatcacagtacagtccctgcatgaattgaacagaggaagaaaagagagtacggatgctgctgctgcttgaccgggacatcgatcgatcgagaaagagaagagagacgcagtgcagtggtggtacgggttgatttgggagacgagctaagctacactcctactactcgtagctcggccagtgcactgcacagcatgcgcctcttctcttgtctcgacgcatgctggtgcagagacgacgagacgagagagagagagacggcaatggcgccatgcgtaggagcatctcggaggcaagagatggagttatactccctccttcccatagtactccctgcgtttcaaaatatttaacgccgttaattttttagcatatatttaattgttcgtcttattaaaaaaatttaagtaattattaattctttttctatcatttgattcattgttaaatatatttttatgtaggcatataattttacatatttcacaaaagtttttgaataaaacgaacgatcaaacatgtgctaaaaagtcaacggtgtcaaacatttcgaaacagagagagtattaaaacctaggactggatgggatgtttcatagtacaatgaatttggacattggacatgaacatcttttatatatgttgtactatgaaacattccattcagtctaagattataatattataggacggagagagtagctcgcagagcaggtggtcacatggcacttcgatcgtgtacctgcattctgcatttgcagccgcccgcgactgcaaaagctggaccctctagtttctcgtgttcctctctcacacaggccacggcaatactacatactgcttttttctttatttaaatttaaataattttatagtatagtatagtaacaattttcatacaaagtaaacattgtatcaaaatatgttcggtgttaaatataataaaactaatttggtgctgtggatgtactattttttttataaatttagttaaatataaagtagtttgacttaaaaaaattcaaacgacttattatatgtgaaatagtcagtagtactagacacaggtagtagaagagtaagctttgctctctttctctctctgtactacggcccaaccaaatgggcctcgttgttggtggcaggagggcaggcccagcggggaccatttttaattctggccccgatggactcctcgatcaggagccgactatcattttcttatactctatcaccttatcagccaaataattcaaattccatgactaaattgaaccggacactatgatttgccggttgataagttgattgatcttgtgtgactccgtttttgtttcagttagccaatatcatttccatcctcccaactcgttgttaatttccatacctttttcgtcgagagatgcatttaacaatgtagtgataagttgtggtaattaacccccaaatcccaccgtgtacgattctcaataggttgtccacattttttttcatatcttttgtcgtctgtcataccacaattttcatagcccaaagttacctctccattttttttgccttctttattgtgtttgttgttcatgtaaaaaagactttttttagtctcttctcctaatatgaaatggcagagctcctgcccgctccctccaagaaacaatttgcaggggcaacgcgccaggaaggtgctaccatacaagctctctgaagcacaaatagcagatgtgtccaggttttccactattccggagtcgtttcttactctgacactacatcgtactctctccgttccaaaatataataacttttagcccttaggatttatcctaaaatataacaacttctccaccaacattctcttaccaaccaatcacaaccctccaccattcacttttcctatctacctccactactcatctaatcacaaccatacaccactcacttctacctacttttttaaaaccgtgtccaactttaaaactttttatgttttaggacgaagtgagtacgtgctgaggatcatcgtttcccagcctgctcttctttgatcctgagcacgcagctgcaagcctgcaatagccagccagcaagcaagctatagatggccaaaaggccagaggcccgatggcccggcccacggcacggtgttttggcccggcccaagcacggcacgacccgtcaagggtcgggcccgtgccggcccggcccgaccatcgggccgtgcctgggcctctccgccggcacgttgggccagcacggcacgatgggccgcatgccaggcccgacacataaacaatagggagtaaaaataaacatattatatgtcacggttaaaagaatagggacgtaaaatagacttatttacctatatatatgtcagcccaaagaggagggacgaaaaatagacttattttcactatatatatgtcacagcccaaagtggagggatggaaaatagacttattttcgctataatatgtcacagcgcaaagaggagggatgaaaagtagacttatttaaaaaaggcacgatgggccacccgtgccttcgggccggcccggcacgacccgacagctggtgggccgtgcctgagcgggaggcgcagcccatgggccaaagtgccgatcgggccatgccggcccgatggctggtgggccgtgcctgggccgagccgtgccgggcaggccttttggccatctataaagcaagcaaggacactggtgttgtggtgccaaattaaatggcaattcaatcctctcacgtactccatccgttccataaaaacgaatctacgaccggatgtgacatatactagtactacatatgtttagattcgtagtgctacgatgtgtcacatccggtactaggttggttttttatgcgatagaggaagtaaggctaagttgcaaatattattacctaggatgaaaaatacattaatagtatcgcctaccattggtaatttagtagagatccaaaacaaggcccttttgcataatttcggaccactagcaatcgaagccgtctagttcaggggcctacctgcattatttcggacctctagcaacagtaccaatatggatgtaaacggtcagaaaaatgccaaactcattttcatactatttttttgatgaaacggaatggaaaacgatatattcagaaatagaaacaaaatcgaaacaaaaaataaaaaatatacggatgttttgaaaacatgtcaatatcgattgttggatcattggaacccagtaataaatgtacctcagaaacattgagcttcgaaatcacatatttaaattaacatgatgaaataaattcagctttgctattcctgctatgaccaacttttttttgttggcatcaaagtaaacagaccctaaattacaaatttcctcttctttaatcatttgctcaaattggagattggtcgaggagttgatggacttctcatcttatattctggcccaacctacatgggccgcatgttggtggcgactcagtttcaggcccaacaacatatagggctccacctttcgctggcaaaaccgtcctgtttttccgcaggacgaaagtctaatttaaccaagcaaactattccatcagaccataaccaaagtggttcactttactggttaattatatttctctttatttttcctttatacaagtcgtattttaagcataaattttatagagatatagatgacaccattattaaagttttaaaaattgtcatgactatttgcttgaaatttaagacatatatgtttgaattagtctcagtgctatataaacaacgattaaaaagttttaaaaaatattgagagatatgttataatgcatatatcaatcccaccaaattttattgtaaaatatcgttagggagtaagatgaaccattaaagacgtaaaatagaccaagaaattgttgaagttcgattgagtatgatagacctttttactaggcaaaccacacgaatacacgattgattaatttcactgagaatagcacgggtacatcacatcacacaaattcatacgttgatacacgcatagtcgccgaagcgaccagctgcttaattaatcgataacacacgggtttaattcagcaataatcagcacacacacaaaccacactcatatgggtggtttttattgtggactaattaaggtaggtgactcgccggcggcgagtgttcggttgcttcgtgacttcacttgccgcacttgcagtcggtgcaggagcagctggtgccgcacttgcagccgccgttctcctcgccggcggcgacctcctcgaagtggctgcacgcacgcacaaagcaagcaaataattaaggcgtcaggtaaaaattgttgagaactatctaatctcgtatgtaaagttcttactatttttctgttaattttaaaatatttttgatgaagtttttttatggtggttgtagtatatgctacagaccccatcatttagcttattcgtggaataagtcaaacgatataattgcaaacgaaaataatttataaataaaattcatatatatatttttagcaactaaaagtagagggtgaaaaataaattttaataaaaaacttaaaatcagttttaaatttaagattgaaaatttaaattttgtctgataaatataagcatgaacgaatacattaggccgtacgtgtctcgtatgcgaacgtcaggatcgatagtatcgtgtgtgtgtttgagagcaaagacgaagaaattaaaactgtaaaattcagacgagaaatatgctttggttgatcgatattgagttagttagttacctcttctcggcttcaactatgacgacgccatagctggtacctttcttcctgcaaattaatcaccacgtcaatcgaatcaaaccgatcagtgtttcgcaaaattcaaagaaatcaacatgttaagatcgaaacaaaataattattgactgatctagatcgaggaggcagctagtaattaagtacttacacgcactggctcttgtcagcacagtcgcagttgccgcacttgtccgacatggtcgaagatttaattagctaagtgagtgatgagttaatcccttgtgttgcttatgctttcttgtgctctggtggtgaggagcaatggctgcttcggctggtggtatatatatcggctggatgcagagagagagaagaagacgacaattaaccaaaggaagaagaagaatcatatcatcttctggagacgtagcagctggatggaggaggacacacgcctcgatcgagaggcacgcgctccaaaggcgccatccgcctcacgaaacgaatctctagctcccccacaccggataatgccaagctttaggtcccgtctggaatgcgtcaactttccgaatatttgttgggggtaaacttcacggagaatatcggctccacctcttcttaagctaaagctcggctaaaaatacgagcagagttgtgtagaactctctcataaaataagctagagaggtggacctgagtttaaacagcttcacaactccactccagatctaacttcctgaagctaaatttaggagttgaaactctaccaaacaagccattacttaaaaaatttataaaataaatttaaaaatagtcgcatataattattattcatattttatcatctaataacagtaaaaatattaattataattattttttaaataagttggagagtcaaacgttatataagaactgaaaaatgcattctttatgggagatagagggagtagctcgttttcacgagaaacggagaaaagcctcacagttaaatataagaggatactatagtttactgggtttttttttatactagctacttagctagtcgtagccaagatgttttagagtttaaaaaaaaagtagcagctagcaactcaggaagaatacacagttaaatcacatatgcagcgaaaaccaactattgtggaaaaaaaatagacatcttaggatttattcatgtcaacataagtaaaacattttctctaacatcaactttttatcattttccattacatattttttcagcaactcacgttttcctatttactatgtctatttcatattataaagtcgttttgaggtttgactaaattaatttatagacgatatttttaacagaaaatatcaaaatatgttcaatgtaagacgtaatgaaactaatttaaggctataagtgttgttatatttttttttataaacttgattaaactttcaaaaaaaatgattaaaaaaagaaacttaaagtgacctaacacgaaatggagagagcatctgcgagttgcttcagcttacaaggaactaccagagcctgtgtttggtcgaaacacccccgtcgcaaactgccacaataatttttgcatccatatatcgatcaatatcatcttccatctctcatcagtcgacaagctactagctactagctagcacggcatggcaaagagcgaatattattgtggctgtatgtatcagcggccttatcacctttggcgtcttgtcgaagattttacagtgctcccctcgcgtccggtctccgtcgtcgaccatcaccgtccggctcgatacagagcgatcagcgagaattttcaaaaaaaatttgacgcagatatgaattccaaacagctctgaatatattctccttttcgttggacccggacgtaaagtaacttcctaaaatcagaattcaaattcatactacctccgtcccgtttcgattttttttggtaatatttgattattcatcttactaaaaaaatttagaattattatttattttgttcgtaatctgtttcctttatgtcctcttctttctacaattctttctttctttatttatttattttccccagtcagtcaaggactcaaggtgttgctgcccttttctttttctccctttcaaaaacctgtaaatttcactggttttatgagttttcatcttctcgtggtgactactagggagaaatttcgaaattttatgttttggcgatttgatgatccttatcgtttcgacgtcgccaggaggaatctcgttcagaatggcgctcgtagcatttgtcgaatcctaatcgatacgtatcgccggtcaaagacttaaaaagtaatagtagtaagagtaaggaggaattaaagtttgatggcaacattttgtatcttgctctttgtttcaaagaatatattttcacccctagatagaagttttttttttaaaaaataagggttttcaccgctccaaaatacgcgacgtatcgcctttggaagccattcgaaatcccaaattgaagcttgtccatctgttccatttttgggcacgccttctgttattcaaggcaaattggtgggccgctattgatggtttctttgggccgacattgaagtttcctttgggctttcaaatgggccgcaatttatggtttctttgggccgacatgacgttctctttgggctttagaatggcctcagttgatggtttaattgggccaaagttgacgtttattcgggctttcaaatgggccgctcttgaccgttttctttgggcttcgtgataggccgcgttttttcaccggaagcccgtaaagatggcttcaggcccagttcgtcaaacacacaggccccagttgtactggccatcatggcctttcactgcacagca

SEQ ID NO: 44071 - DNA, 9009 bp, Oryza sativa
ctttagtcccggttggtaatcccacccgggactaaagatggctcatccgtcccggttggtgttaccaaccgggactaaagatcgagctgaccttttttttttgcatggccctgttgctgcatggtttatatatatataaaccatgtttcagtacatatatgcatatataatatatgcatatatatatatatatatattatattatatttatatatgtttcaatacatatgtacatgtgcataatatatatgtatttatacatatatatatgttatgcaaatgcatatgcatatatatatatatatatatatatatatatatatatatatatatatatatatatatatatatatatatatgaccaaaatatatttacattatagaaaatgtgtacacatgcatatagaaacatatgtagtcatgtattaattacaatatattatatgtcctagctagctacgatttcgacgtaatagtagtcactagctcagaagctaaggacctatgaattgtgtttccgtcgtagtagaattcacccttgggatcaaggatttgttcgttgatgaatcccatgagttgttcttaaaccgccgcgataaattccttgtgcgtggtcaggttatccctcatgcgaataaactatatgaatgtatgaaattgattagtaattaaacaagaaatcgatacgaatgaaattttgaatttatttgtacgtacattgagctctcttgtggtgatgatttggtctgcaaggcagtggcaatactcgcacacgtaatagccgcacaagttagttcccttcttttgctttgcgcactacaaataaatgacaaacaacgagaaatctaattaatatacacttgtatgtatttgaatcagagaaatataaatgtagagcatgtgtactcacaagaaatttgaacttccgcctaagtctttctctccatttgccgcggaccaaatgacggaaccgataccaagccctacatggagtttaaagctatgattcgtagtagcaattaacataacaagattttcttaattaacagaggaacttatgacggtacctatctataagttcgaaaaccttgccaaacgtagactcttttttatccattgagtcatatacgttgacggtgcaggccgacaggtcgaagagtaaaagcacccagtggaatctgcaatgtgcatgggatgcattacatataaaacacttagcaagttcgtacgggaatgaaatttgatataggaagacagtaaaattaaactaactatgtgttgtacggcaacagtatgaacgtcttgtaatgctgcgccttcaggagatggacgagattgtcctgtgtggcttgcggatattggtcgagcattgcgacgtttactttccgagggtcgatgaatccagtatcgaaaaccccccgccgtcgggccctttgaatctccattctacaacgataaaagggagtatattattttctatagtctacttatatacaaggacctaattaattaaaggagacgtagtaagaaatctaactgaacgatatacttacaaaatccagcaactcataatagagacgtcgagggcgtccagctggtatagttcgtagattccattgaaattgatccagagaatgtcatctccttgcaagaagtccgtgtctctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattcttctatcgtcatttctttaccggtcaccaacggctcgatctcctggtttggttgctctccaagctgagggactagtttggactttccagaagatgctttctttagcgttcgctcatagtccgatagcttaatggcctccttggcaggtgcagacatacccctgaagaagttcatgacactcgggtctataggaatcttcttttctggacttcgaggcttgaattgtctcttgacttctgatgccacgtaagcgtcaagctcctcttgcgtgcaatcgtaccccgggtccttgttcttggcggcgtcaattttcgccttcttcgttgcccttctgtgggcatgcggtggagcttggggggcccttgactttgaaggtgccggaagaggagcttgcggaggagtcggtgtaggagaccgaggaggagtcgatgcaggagcctgaggaggagtcgatgcaggagcctgaggtggagacggtgctggagcatgaggaggaaacggtgcaggatcctgaggaggagatggtggagccggaggagatggtgcacgagacgccgcttgtcgcctagggaggatgatgtaccgcctgcgccatagaataattgcatggcttgtgtctcgtagatgcgtctcaccgtctcctccagggtaatccagctcgaggtcctcgtacgcaccttcgaccaactcaacttcgaccttggagtatcctgctggaatcggcctgcagtggtaagtacctgaagggtccattgggatggccatgcccgacgccaccttcatgtggtgagaggtgatttattagtaatcaacatatataagcagcaactagcggaatgggcaaatctaaaatatataaactacgagcttacctttattaataagttcttgaaaggaatatgcagctcacatggtgtccgctgagtgatgtcatcaacggggcaggtggattcgtcttgggtttgcatggcgtccatgctctgtgatcctacctgccctgttgaggcgcagctgctacagttttctgacgggctcaccattgcaggaggaatggtcggctggggatcattggaccgatgtgcggctatgcgttcatcaaccttccttgccacctcctcttgcatgctgagctcgtagctcgataccctgaactcaagatctgcaatcttcgcctcggtatctctcttgctcctcatccgactcccatacgtgtggatgtcctccttgaacccaatcttccaaggaatcacccctttccctcgtgttcgtcctggatgctctggagtctgcagggcgagtgacagctcgtccctctctctatccggtcggaacgtgccctgagaagaggcttccactgcgtctgttagtcgacgcgcagcctctcgtatctgatcgccgaagaccagtgagccatcagctgggttgagcgttccaccgtgagcatagtaccagaacttcgatcgttccggccaattagcggtggccggttcgatacccctctcaagcaacctagcctccatctcctcccacttcagcatcgcgacgctatagccgcctgaccccaagtggtgatggtacttcttcttggcggcattttctttgttctttccatcatcgcctgcccttgttcacctgtcttatatgcaacgaactcgtccccgtgatcccttagctttgggaatgtgtcgaagttcggtgtctgccccttcaggatatatttcttgtacaactctcccttgaagctctgaaactgttctgccattttcttcagagtccaccttttcactttgtcctctgtacccgcgggaagggtgaatgtctcgagcattgtggtccacagcatctctttctccgaatctgggacaaagctctcatgatctccgcgtgcccttgttctgcgccagtacaccgtactgacaggcacgttatcccgcacaacccaaccgctatgacatacatagttcttggcggcttctgccggggcactaggtcggctgtcttcgtccacttccgttatgatgtgccgaccctcaagcttcttcgcggcacctcgttgcccgcgtgccctcttctgtccagcggagggttgacttgcactatccccctcctcctggttcccctccacatccctttcaacgtgcccctcctggttcccctccgcatccctctgcacgttcccttcctcgttcaaatattggtttggatcctcgttcccctcttcttcgttccagtactggctacttccctccgcgattgtatcgtacaatatctgttcctcatcgcgatcagccatctgttcatacatgaaatagctgctaagtcatgagacatttatgttttaacaatcttatatgctaacaatcatatgctaagtctaggtgacgtatattacaggaccctagctagtcaataaattatatagtaagtctaattacaaatctaataatcttatattaaaacttaaataatcttatactaaaactcaaatagtgataaatgctaagtctaggtgacgtatattacaggaccctagctagtcaataaattatatagtaagtctaattacaaatctaataatcttatattaaaacttaaataatcttatactaaaactcaaatagtgataaatgttaagtctaggtgacgtatattataggaccctagctagtcaatagttatatattaagtctaattacaaatataataatcttatattaaaactcaaataatcttatactaaaactcaaatagtcatatatgctaagtgtaactgtcgtatattagaaccctacacaaccttatatgctaagtctatttacaaatctaataatcttatactaaaactcacatagtgatatatgctaagtctaggtgacgtatattataggaccctagctagtcaataaattatatactaaagtctaattacaaactataataatcttatattaaaacgtaaataatcttatactaaaactcaaatagtcatgtatgctaagtgtaactgtcgtatattagaaccctacacaatcttatatgctaagtctaattacaaatctaataatcttatactaaaactcaaatagtgatatatgctaagtttaggtgacgtatattataggaccctagctagtcaataaattatatactaaagtctaattacaaactataataatcttatattaaaactaagtctaagtgtcgtatattaaatctaatagtcttaattgcattacaaatataacaatcatatatataattacgtcactagcctgcacgaattccttcgagggatagctaccactctggcttgagggacgactccgacaacgtcttttttgcaagatacaaaaagatgtattaggataaacgcgaagtaacatatattgaatttgatgttcacgtttcgttcacgatcgttcacgttcgcgttctcgttaaggtcacgtttcattcacgtacgttcattcgttcacgttcattcacctgcctatattgcatttcacgttcacgttcattcacgttcacattcgttagttcacgttcatgttcgttgacgttcattcacactccttcgttcacgttcgttcgctcgttctcgttcacattcgttcgctcgttcacgttagttcacgttaattcgttcgatgccgtggcggcagctggacggcggtgtggcgcgcggcccggtggcgacgttgcgcggcggcggcggcgaacgcgcggcacggcgccggcgttgcgcagcggcggcgtggcggcttggcgcggcgcggcgccagtgccgtgccgcggcggcgtcgtggcgtctcgtcgtgtcgtgccgccgcgtcatgtcgtgacgacgttggcgtcggcgtcgaggcggccggcggcaaccgagagggagagagagagagatcgagatcggagagagagagagctgatgagagggaggcggcgtcggctctcaccccagagatgcggcggcggaggaggaggcggaggcggcagcgacgacgacgagcgcgagacgacggcgagatacggcggcggcgttggcgcggggatgccctaggcagtggcggcgaaggagaagccgagagagatcgatcgggcaaaaacttctaagtgttggtggagaagacgagggcgcgcatcgggaatatatatacccctagatctttattcccgattgatgagaacaaccgggagtaaatttactcccggtttttctcaccaatcgggaggaaagttatctttactcccggttgttctcatcaaccgggaataaagatcttttcccgctatttccaaaattttttaaaacccggttagggtcaagaaccggggctactgataagtgcactgagtattattttccattacatatgtgtttctaaaatagaaaataatgcattaaatttatttaaagtacaaaaattaatgacaattactacggaaaattagtactgtctgtaataaattaagtggataaaacgtaataagcaaatattacgttttaaaattaataaaaattctaataatcatatatacttagcatatgaatgatattaaattgttaaaaactctaattaacatatgtatatacatacgacatgatttaaaattaataaaaaatttaataatcatatataattaggatattaaattaattgttaagaactctaattaacatatgtgaatgccacatgcatgatttgaaaattttaaaaattcgaatagtcatatataattagcatatgaatgatattgaactaattgttaaaaactctaattaacatatgtaaatgccacatgcatgatttaaaaattttaaaaattgtaattatcgcatataactagcatatacatgatttaaacttgttaaaacctcaaataatcgtgcgtaattaacatatgccatacatcaattgatttatatggataatcaatacatccaaaatagtttacatcgtgtacacaataattacggcaatacatcagcggggatggttgaccgcacgtactttctcctcactattgttccctccttgtgatcgctacgtgagtaaggggtgtctttatttgataggaggatgctagggtcaatcgtcaccgtgaaagggggttgcccatccaactgatcgtaatcctcgtcagtcttgtcctcaactccgacgatttttcttttgcttgggagaaccacgtgacgcttaggctcgtctggccctctgcccttctttcctttgctagacatgtccttcacgtaaaagacttgcgttacatcattggcaaggacaaaaggttcgtccgagtatccaaccttgttaaggtcaaccgttgtcatcccactgtcatcaatcattacgcctccaccagtcaacctaacccattggcaccggaacagagggaccttgagaggaccacagtcaagttcccatatggcctcgatggcaccgtaatacgtgccagttgttccatcgtgtcccatggcatcgacacaaacaacgttgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagattgttgcagaaccgtgaaatgggctttatggaataaattgttgtctaccgtcattattgctttccttccgagagttccctttccccgtagtctcccttcatggcatgattcaggtaccccgattgggcgaaggtcttcaataaattctacgcaaaattcgatgacctcctctgttccataacccttggcgatgcttgcctctggacgagcacggttacgaacatacttcttcagaacgcctatgtacctctcgaaaggaaacatgttgtgtaggtacacaggcccgagaatactgatctctttcacaaggtgacaaagcagatgcgtcattatattgaaaaatgaaggtggaaatatcaactcaaaactgacgagacattgcaccacatcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacatgcttacagtgtatctttcgactttccgtatacacctaggaagccaagaaggtttacgcaaaggttcttagtgaggtgcatcacgtcgattgcgtggcgtacgtccaagaattcccaatagggtaactcccaaaatatagagttctttttccacatcgccgcgtgaccatcttcgctctctataggctggcttccaggcccctttccgaacactacttttagatctttaaccatagcaaacactgttttcccgttgcgatgtttagacttcgtacggtggtcagccttatgttcgaagtgcttgcctttcttccgtaccgggtggtttgctgcaaggaatcgacgatgacccatgtatacaaccttcctacagtgcataagatacgtactttctgtttcatccatacagtgagtgcaagccttgtaccccttgttggactgtccggataggttgctaagtgcaggccaatcgttgatggttacgaacagcagcgctcgtatgttaaactcctcctgtttgtcctcgtcccatacggggacaccttccttcttccacaacagcttaagatctttgaccagtggtcttaggtacacatcgatgtcgtta

SEQ ID NO: 44072 - DNA, 743 bp, Oryza sativa
ttgtaaatggtgaagttcaattttgttgagctgttttcaccaactttagttattacaagggcatttttatttattttcaattaaggagcatcctgttctctgggagttgcaaaatagtagcttggaatgggcagtagattttaataggatctattttagccaaatgaagaaagaataacctgtcaggatggaaagagactgtaggaggcatgtgtattctgaatcatctatttagaacatccaagtctgagaatacagttgaggcctgacaaggatttaattgatagatatccatgcacacagcaaattatatggtttgtctaaatcataggtaactctgtttgatgctcaccgttgttgttttatctgccatggtaaaactaatcatgctttgttgtgccaccttctgacccactttactttctaaaaagtcctttcatgttcttcataccaatgggctgacaaagtataataatattgtactagttgcagttaaacctcgtgctgcaataataatgggttctgattctgatcttcctgtcatgaaagatgctgcagtagtattgaagaaattcaacataccttttgaggtttgatctctgaaacccttccattgacaagttatgaaatgtttacatgctaagtcaaaattttctaaggatgcaaaatgattgactgtcgaattttgtagcttacaattgtttcggctcatcgtacaccagagaggatgtaccattatgcat

SEQ ID NO: 44073 - DNA, 6553 bp, Oryza sativa
gacactatagaatactcaagctttgacgatataggtatcacaaatgtctagcgtgatccatgccacttcatctaccatgagtgctgtcatgtgaaaggagatttcttcgacccagagggtgccctagcggcaagtgacgaattcaaggatcttcgggagtggaacactgctatgccataatgtaactacatggcgtatttgaagtgacaatgtaaaaaaatattttaatatatatatatatatatatatatatatatattggcaacacctttgagttatgcaatatatgtagatttctcagtaccaaatgcttgataatcttccactatatgtacataataatctacctgcaagaatttctattaaataatttaaaagtaatttacgggcaaattattattaaatttcaatattttctacctatcttcgcaggcggaagttttttttttttgctggcggtcgattcctattttcgaaggcggaccggagtagccaacgtccgcctgcgaaaactgcgaagatcggcgatcttcacagtcgttggcttacaatcggacggccgccccgcctgcgaagacccttttcggccgcttgcgataatgcttttcctagtagtgagtcggaaatgagcgaaatttcagtccgaaatttcccaccctggcagcgagttacaaacaagtggataactcacgtttgccttgtggaaacaacccaagaaataagaaaatatatatgtgtggcactttaggaggaaattgaggaagacaggaagtgcatcattaataaggccgcggacgggataacttggcattggacaccagacactgaatactcaaccacaaaagctagctgaccggatacagttcatcggataattatgctgtccgttttattatattggtaaagcaggacactgcatggacatgggaacatcaacacgaacacacgagcaccttaaaaaacatagagtagttgtttcgtgtataataataaacttgctaagctttcaaatcccgatgtgtagaaattaaatcgatcgaacgcgaattcttcccctatgcatcgtccatggatcgattagtgccctctaccaggtattggcgggcaggattgctggaaagccgctacaaatgacaaagaaggcatttaattagctagaaaagcgaaaggcgtaatttgcagtaaaaccaatcttgcgtccactggaaatagcaacaaagaaaaaaaaaagaaatatcagcagtgccagcttacggttgtttgcgcaggtgcttggtccacttcgtccgaggatgccgccgacagaaaccagtataacgaggaggacgacaagcagctgaacggaggtcgagtagttctttgccattgttactgacacgcagtatgtgctttctgtgtttggagaggcgatcgagttatgccgaagaattcgtgggtgctcgatgctccaaatgcaataccagttccagcacttataaaggcgtagccttagcctccatgcattcaaccagtaacggatccatctttaatttggctggaagttggttaggtggaaatgtgcaagaaggaacttgctggtcgactgaggtaattccttaattcacgttaattgccttctagagaaaatactggtttcaaaaagagtaaatgcacggaaggcacttaaatataccatttacgttccttaacactccaaggctgtattcgttggtgggtgttagggacccatctcacacgcacggaaaacagagcgattcattagcacgtgattaattaagtattagctgatttattttttaaaaatggatcaatatgattttttgaagcaactttcgtatataaactttttgaaaaaaaaatacaccgtttagcagtttgagaagcgtacacgtggaaaatgaggcgaaggagttggaaccacacagccaaaggctgtattcttccccctactttcctacttcctccgtcccttaggttgtattctttcccctactttctccatcccaaaatgttgctatctacccatcctaggataacaaatttggacataacatttatccagattcgctgtcttaggatgggtcaaatcccatcttagctagcaacattttgggagggaggaagtaactaacctccctctttttccgtacgcatgcttttcaaagtgttaaacggtacatttttttcaaaagttttctacaggaaagttgctttaaaaaaatcatattaatccatttttgtagtttttataggctaatacttaattaatcgcgtattaacgggcaacactatttttttgcagggaggtggagaactcagcccaaatgcgttttcagaattccgaacatgtcttgggtgtgatacaggtccaagcaggtgccagttcgctatatacacttgcgtggcatgctacagcggcgtctacgtgtcagtgacatagaatttttttaaaaacaataaatatttcttctctctaccttaattctttatatttatatatatatatatatatatatatatatatatatatatatatatatatagtctcctctacctaagaggaaaaatattttcaaaatttatcttttatataaaactgatatatgggtcccatcgaatatgtaggcaccacccaaacatgacacgttaacgtacggagcgggttggagcccgtttaaacatatatattcaagagcaccaaaatttaatttgagagtttatatatgtaactagatgacaaaaccgctcaagtttaataactacccaggtacttcactctttcgaaaaatacctcaacgacttaatttgtgaagcaaacgaccagtatccagtatctactacttgtcgataattattagtacttggtaacagagggatatttctctttaatcttccaaaccataggtggcatgtcaaatcaagcacagtcaacttacgtactcgatccggtcaccgtatcagtcagcttcaatacaagatccacaatactgaaatggaattttgggtggttttgcatggttggtgggtggcttcagctgtgccttcgtggaaaaaactgtatgtggccgacatgataaaattatcttacgtggaagtttggacacaaatcatccgattgagaacgcacgcgccttgccttgacttccacaaattaaggtttgttggcatatctgggcaaattcgagttgggtgcatacatgttattagctaactggctaaagtgtacttaccaaccataactggaaattgcccgtgcattacaacacaaatgtacaattttacaatgagtattaaaattaaaaataagaaaaaaaatgcaaatacaaaacgtggttacaacactatgtgcctattatattcatgcattccaataagttgccacaagtgcagatcgaccacagaatggcattgggagaggtaaatattagcgaagatcacccaagtcagtcatggcgaattcgtcatgaaggtgcgtcgataggccagagtagactagaggatgaggccatcaggataacatcacgccgcgacaccgccttgctctgagcatcggcaccaaagagcccgacggcctcctgcactcccacatcatccttcacattgtcgccgtcatttcacttcatcaactcactgctagatttcaacttcccctcttctccacaatctttagcgacacgagccgttggaccattgccaatgcccttgctggcacacgacatcctttgcatcggccgccaacccgatccaccaccctttctccatccccgcggctacgaaactgtcggtggcaccttgccgcccataggtaccctcctgccaccactggtcttcctcccactatgctagatctacccatctatgatagcctatctgtaacggactgaggtgccttgtcacagatgacatcatctataacgggttcaaccgaagcccgttcaagataaggctatgagacacggccagttataggtgtaagtaattgatctatatgtgcacttgatagacaataccactaatgggtacatatgtaggcccatcaaagattaaatgttatctctaacggatcttttttcaccagtcactaacagagactatcgacaataaaatcatttttaatatctctccaccctctctctctcagtctccccccctcccccttctctcgtactctcttcctctcagcacgtgaaactggtggatgacggcattggcataggcagcgggagatcggggacggagctagagtcgatgggtccgcggggtcgaaggccacgctggtgcctgcaggagcttggggttgtaggcagcactacttagaggcacagggcgagacggagagggcggcgaagggcaggaatggcacatctggccgactcatcatccctagaaagggaaatggggagggaggcgcacggggagacagatgcggctgggtggcgggacgagagctcgccatcctcatcttaactgcctccgccattgtctctatctccctagcagctgccaatctcggggtagcctccaacaaccctcaagcttagggtggcctgattaggtggctcccaagctcgtgatggtggtcggctgcttggatccgttgccccctagccagatccactccattgccccatccccctctatttctaatgaatgtgtagtgtgatgattgagatcacgacgtgttgtttctgatgaatgtgtattttggatgtttttgtgattgtgaattcgtgatgaagtttttgtgattgtgatgaatctggtgatgtttatgatctaaatattatcttcaaaatgtgattagtggggtggaacatatgcagggatgatgagcggtgaggaccgagcgcacagcgtgcaccatattttttgggttattcacacttgtgacgggtcacaaagatatttatttgattttttttttggtttatcacatcactagcaggctagaacttaggagtaatttgagagatagtttaccagtgacgggctagaacttagcgagaatgctcagtcttaggcgcccgatgtgagccaaaaatatcaggcgcccttccgcgtcgtcccattccgcgtgcgctgcatcttctcctctgtctccctcgctcgcgtcgcctcctcccccaagcttcctaccagcactgtctcctctccctcatgctctcttgcccacactaccctctcccccgttaacctcgcccacgccaccttctcttccccgggcgacctcgcacggctgctctcctgccccgtcgcgcggccctcctcttctggtccgccgtccgacggttcagggcggagtcgctgctgcttcctatcgagcgctgcagcggaggcgccggcaggacgcgagggggcggtggcagtcaccgccgtggcggtcaggggtctaggctgggccggtggatggtgcccccttccctcgtgtactccggcgtggtggctgacgcctagcgctcgacaggaaggccgtaccatataccatgtactatgtagatctaggttttcctcttgattttttatgtttcagtccatgtaccatgatgtttcatcagttagatttgaaacgttgcaatgttagttttcgattatgttccattctttttctggatgtaatatgtttcagtatattcggaaccgttgattcatacattgtagcaaaatatttcgttgtgtgatttgattgtgtttcaccactttcagcaccgaaacatttttaattcgatggtgtttcattctttttcttgatgtactcggatttgtttcatgtttcaatatattcgaaactgttatttcatatgttgtattaaaatatttcattgtatgatttgattgtgttttagctttttaaaagattaaaatattttcgatctacttggtgaaacagcgtccgatttttgacaaaaatatcaggcgtccgatttgtagacacctcgagaacttaggagccatatgagagatagataccagcgtcaatgaccagcgtagtgtccacttccaccattcctctaaagtcactctcaccacccttttatgcccttcatctgtctgttttctgccatagttcagacttcagacatacccagtcaacatggaagttattgccggcgttgctggtcagtcgtctcctgccatgtccctctgtctttctcatgcctctgcttggctggagctagaagacaacatgatggccctcagatcaattacaaattaggccgagtttagtcccaaactttttctttaaactttcaacttttctatcacatcaaaactttcctacacacacaaactttcaacttttccgtcacatcattccaatcttaaccaaacttccaattttagcgtgaactaaacacacccttaattactcgaaaagtctcagtcgactgcttattattagccaaggtgatgttagttaccttctagatcaaatacccgttccaaaaatacctcaacaacttgatctgtgcacttgtggacaatttctagtacttagaaacctactactacctttgttttaggttataagactttttagcattgcccacattca

SEQ ID NO: 44074 - DNA, 14506 bp, Oryza sativa
atatatataaatgtgggcaatgctaaaaagtcttataacctgaaatggaggaagtacaaaacagcaaatagggaagggcttatatgtgccggaaactctatagtcggcacatatgagacgtttttcaccttttaatacaataaaattaagaagcggcacctataaccacttattggtaccggttcataaaaaaaccagcaataatagttccccaagtcacaagtgccagttcttcttataaagcggcacgtaccgacattatataggcgacggttcttataataaatttgcacccactagtgtggcgcaaaatgtgctggtttttactgtgaactggcaactatggacttcacatatctggtttactatataaaccaacatctatgagtccttaggtacccgttgacaattaaaaccggcacctataatgacgctacttatatatatatacatatatatatatatacttatatatatatacatatatgtatatacatatatacatgtatatacatatatacatgtatatacatatatacatgtatatatatatatatatatatatatgtatatatatatatatatatgtatatatatatatatatatatatgtatatatacatatatatatatatatgtatgtatgtatgtatgtatgtatgtatgatttttacctaactttctcatatgaagttggataaatataaagtttgtatcaaatttgtagaggtcgacgagatatacaactttgtgtagttgatgacattttgatttgtggttgtcaggatgtctaaaaatgtactataagttctcaaacctatttggaaaagtggatatttaaaatttctaaacaatctccaaaggagagaaaatctatatgaaagttatagatctatatgagatctttgtaattgacaaaattttcatttgagcacgtctatggtgttaaatatggattataagttttggatgagagtagcctcaaaattatttgcttctaagacatgtgtttttaggtgagatcgtaaggaggcttccggaggagagggaggtcataggtttgaacccttcttaccccgtgcgtatggaaatagtgttaaaatcttgggacttgtgggacttgagggaggtcgcacgtttttttttattatgtttgctcccactaggggtaaataatgagctagctcggcttgttaaggcttggctattttgagtcgttaggctcgttaaagagatctattcattttctctactattataaaattaaagatgtttccactagaattttggtacgtcaaacttgtttgaatcggttttaattttatgtttttgtcaaatccttttcttttttcttgcgccagagtgtcactcttatctgagacgcacacgaattaattgggcccgcaccttttcatgcgccccttgccacacgcagcaaccgggcccacatctgagtccattttccacatgtccctttgctcgctgccgccattgggcccacaacggcatcgtgcacgtgatttttcatatgcccgattgggcccgcgatgtcctcgcgcgcgcaatttgcccttgccgcatgtttgatttgggagtgcgtcaccctcacccacgatttaaaaattatagatgttttgtggtatatcatccgcatccgatttccgtcacacgtaacattcattgtgaagtcacggctcacgagcaaactacaaaagagagtttgtgtgatgtggatagcaagcgaatgaaactcgcagagtccacgcagatatcacgtatgccgttgcccagttcatcaaatgctattcctttcatacggcacgattcatgggacatgttagcatgatttcaattcagtctccacaatgctcgtacgtactaccaggcatgccattacaataatccataagaatcggttttactttcgaaaagaacatgccaaccaaaaataaaagatgatcgaagatgctgattttgtctattatcaatacctacctgacttgagataaagctggacgaaaaatcaagcttgtgtttaaagacctcgttgtttggcttatgcttattcctataagccaaatattaaattttagaacataattttgaatttaacttttggttttttaacttactttattttaccatatttgcttttgagtcgctaagaacatgtatataaaaaatctgcatataaatagtcttttatttggtaataagcgattcggataagcacgtgaaaaaacgaaacaatagtatgtgattatttatctaccgacaaatatgtacaaattaaattggttttacccgttgcaacacacggatatttttttctagtcatattaataattttaaattaccattttatcataaattaacataataatggacactaaataatgaaaaaaatcacaaaatacaaatagttttgatataactaaaagagtactccttccgtcccgaaataactcaacctaggatgggtaacgaatctggacgattgacccatcctaggttgagttattttgggacggagggaatacacactaatgagcttcatggtttttgtctacccctagtttccaaaactaaaaaaacgggtgctcccctacatgtgccgattctaaattggaactggcaccaatggtcgttaacagtgttgcctgaacagtcattggttgtgaattcgacaccaaggactgattccgaaccgaaatcaaagtgcttttctgtagcagtatgcttcaacgtgatcgaccacactgaaatggagctttgggtggttgccagcttaccgggtagcttcagccttcagctgtgcctttctggacaaataatttcagacccaagtcatccgaatgccgagtgagaacgcacgctgacatatcttagggacaaattcgagttgggttcagacatattattagccaactacctaccataatatacaacttcacacaagtagtcaaaattgtaagactcttggagactaggagttacggggaccgatgatactagattacgtactgttgcaaaaggttgtcaagtcagacatgcctcgtgtcgattcagaccatgatggatcgttttttttggaggtcagggatgaaattaaggtcgtttttagatggggaaaatttttaatgtttggttgttatatgagatatacggacacacatttaaaatattaaacgtagtttaataataaaataaattatagatcctctcgaaaatctgcgagataaatttattaagcctaattaatccatcattagcaaatatttattgtagcaccatattatcaaatcatgacgcaattaggcttaaaagattcgtctctcaatttagacgcaaactgtgtaattgtttttttttcatatttaataatttatgcatatgccaaatatttgatgtgatgggtgaaaattttttgttttggaaactaaatagggcctaagtgtgtgttgagagggaaaatcccaggcgacaatcttttctcccccaagaagtcttctacttctacctgatgcacatcgtcttctctcccttgattgctctctatctttgactgaaactctgaaagaacgttaggtggacaatgatggaagaagaaaccagcgaggcaatctaacaaaccaataattaacgttaccaatatctatagcaaattgcgcattcaaaagtaatttgaaaggagataccgagttaggcaggtatcagcttatacctttcccttgtataaatgctgcgtgtctcactagctagagcaggcaacataggagtattagacaagaagcacacaacatgtgtgacagacaaagaagacctgtgcctcctttgggaactctccgatcctcgtggctcctaatcttggttgtccactcctgtctttcgagctttgcagtacaccctgctgctgctgctgcttcttcttcttctccatccaacaccgatttccaaaccctcctttgcctgaagctccatctctccaacgaccccggtggcttcctaggctcatggaagcagaacgattccatcggtttctgccgctggcccggtgtcacttgcagcaagacgaacacatctcgtgtcgttgcgctagacctcggatcatctggcctcaatggccaaataccaccatgcatcaccaacctcactctcctcgcaaggatccacttccctgacaaccagctcagtggccagattccacctgaacttgggcagctgagcaggttgggctaccttaacctcagttccaacagccttagtggttcgatcccaaacacgctgtcttccacttaccttgaggtgattgatctcgagagcaacaagctcactggaggtatccctggagagctcgggatgctccgcaatctttcggttctgaatcttgccggtaacagtttgacaggcaacattcccatttcgctcggaagcagcacgtcccttgtttctgtagtcctcgcaaacaatacactcacagggcctattccatccgtgcttgccaactgttcatcgcttcaggtgttgaacttggtatcaaacaacctcggtggaggcattcctccagccctgttcaacagcacatcgcttcgaagattaaatcttgggtggaacaactttactgggtccataccagatgtttcaaatgtcgactcgccattgcagtatcttaccttgtcggtgaatggtctgacaggcaccataccttcatctctgggcaacttttcttcccttcgcttgctgtatcttgcagctaaccatttccagggcagcatcccagtaagtataagtaaattgccaaacttgcaagagcttgatatatcttacaactatttgccaggtactgtcccaccctccatattcaacatttcttcactcacttaccttagtttagcagtcaatgatttcactaacacccttccatttggcatcgggtacacccttccaaacatccaaacattgattttgcagcaaggcaactttcaaggcaaaatccctgcttctctagccaacgcaaccaatcttgagtccattaacctgggggctaatgcattcaatggtattatcccttcttttgggtccctttataaattaaaacaactaattctggctagtaatcagctggaagctggagattggtctttcatgtcctcattggcaaattgcacacggttggaggtattgtcgttggcaacaaataaattgcaggggagtttgccgagttcaattggtagtcttgcaaacaccctaggggctttgtggctgcacgcaaatgagatatctggtcccataccaccagagacagggagtctcacaaaccttgtgtggcttagaatggagcagaattatattgttggaaatgtcccgggcacaataggtaatcttgcaaacctgaattccctagacttatcacgaaacaaactttcaggacagattccacattcaataggcaaactcggtcaactgaacgagctctttttgcaagacaataatttcagtggacccattcctagtgcattaggtgattgcaaaaaattagtcaatctcaacctttcatgtaacaccttgaatgggagcataccaaaagagcttttctcgctttattccctaacaacaggtttggatttgtcccacaaccagctgtctgcacagattccacaggaggttggtagcttgatcaatataggcctactaaatttttccaacaaccatatttctgggaaaattccaactactctaggtgcttgtgtccgcttagagtcccttcacctcgagggtaactttcttgatggcacaattcctgactctttcgtcaatttgaaaggtatttctgagattgatctctcccgaaacaacttgagtggggaaattccaaacttttttcaatccttcaattctttgaagcttctcaacttgtccttcaacaacctagaaggtcaaatgccagaaggggggatatttcaaaattctagtgaggtatttgtccaagggaacattatgttatgctctagctccccaatgttgcaattgccactttgcttagcatcatctagacaccggcacacttcccgcaatctaaagataattgggattagtgtggctcttgttttggtctctttgtcatgtgtagcatttattatcttgaagaggagtaagagatctaaacaatcagatcgccattcattcacggagatgaagaacttctcatatgctgacttagtcaaagcaacaaatggtttctcttcagacaacttgcttggctcagggacatatgggtcagtatataagggtatacttgactctgaagcaaatggaattgttgctatcaaagttttcaaccttgatgaacttggagcaccgaaaagctttgttgctgagtgcgaggcctttagaaacactcgtcatcgtaatcttgtgagggtgatttccgcatgctcgacatgggacaataaagggaatgatttcaaagctcttattattgaatatatggctaatggcaccctagagagctggatttattccgaaatgagagaaccgttgagtttagactccagagtaacaatagcagtggacatagctgcagcattggattatttacataaccgctgcatgccccctatagtccactgcgatttgaagcctagcaatgtgcttctagacaatgccatgggtgcccgtctcagtgactttgggttagcgaagttccttcccactcacaattccacaagtattactagctctacaagcttagggggaccaagaggctcaattggatatattgcaccaggtaaccacattttacatgatttgtctctcctcttgaacaggaaattattattttaataggtgcggtgtccaccagcaaattttcaacttttgggagtgttttccctccaaaagtcacttcgtgccgtgtcctaccgcaaaaaccgcgaagtcacagagtcttgtagcaaaatttaccctttttttttctttcatcctaagggctgtaatttttttctctactatatttaatgaaatagcacaatcttgtacggatttatttttaaaaaaaacttctgttatgtgcatagatgagctggtttttatcaagtctatggacttctcttgaaggggcatatatagtcaatggaaattccttcatttttgttgtcatctacaactgatgttcatttatcttcttataattgtttaaaatataagcacatatagacttaatttatttcataaataaagaaccacctcatacgatctagacatctatactagaaagttacatatcaaacatgattgagatgtcatgatggttctggttctcttgcataagggagagcagcatgcatcgcacttacgacacatggtaccagatgttgatgacaatatatagcatcaaaatatagatgaaggtgagccatggtggacaaacagtaaccagtcacacggagcactcccaaataccttatcaccctctcccagtggaggacttcgaggattatagttctggagacttgctctccgggtagccgatgcatactaacaggaaggataaagtagactactagcaactgtgtagcacagaggaggaggcaaaccctaggagagctaaggcccatactaaccagattttttgccatccatactaccacataatcgaaccgaataagttgtgcataacttatttgaaatttctgccaccctcacaatggagaatccaatgagtttgcaaacactgcattatgtagggaaacaaaactacaaaaaggaagctgtgtcggtgcaaatctccaagctaaacttgctcaaaacttgaacaatagactatgccttgaattgtaagttttctgcaagcaagtttcacgcaaagatttgactgatactaggccatcaatagcctacttctcagttagagcatataatttgtactccttggatttttaatgaatttcctatgggcttcactcaaaatttccatagattacgacaaacggttaagctcacataggtgtgttctttaaacaatgctctgtaggacaacatcttcgccaattaaagccagcaaaacccattatggcgtagccaacctaccttgcaactcatgagagtacatgcatattgatttagagaatatttaaaaagctactcttctcaagttaactaatgacttgttcttgccaagtcctaattcacaggatttatgatcacctaggttgggtttccaccatatatagtacaactcatatggcttttatacccatatcctttggtgtattgtcacattccgtgatagtccctttttgaagggatctaccattttctaatatttggatcttatcaaacattataactttggagtttctcaatgtcctaacagacttcaatcatctcttcatatatctagacaatttcatgttatccttgaaacgcttcaccttgtcaatgatagtatgattgtcataatttatgaggatagtcaacacaagttttttaaccacaagcggatccatcattagatcatgttgccagcctgcttccatagctaacctcgtcaaagtggtctgtttgcaagacctcaacaaaacagcatgcaccaccacctatatccactagtggcatttatctcatgaccattggagatccaattagaatcactatatccctccagtaccactgggtactggtacaatgaatccttgtgcgaaaatatatccactagtgagcacacggatgtgtttccctggttctctccacccctcattgctcaagtagctaaaagagcactcatcctttaaaggaggtttctctatcctagaagtagtaagatgatactaaaggtttacatgcatcccttcacttgagattgggtcttttatcattttttaggaattatttttcatatgggctaaggcttatactacaattccgacagttactgctagagtatatatcaaatttaagaaaagcgtaatcgtctgttttacttgctatatcggggaaagtattttcatctcccaaggatatcccctatttcttgtataccacctaaatagtttgtaacactgtgaaaatctagtgaagaaaaatcagtaaaattctgaactttttaaaacttttgcatcatgttgtgatctttgctaagttgtgtggaaactcacttttaaacaaaactatgcataattgaatcacgaaatccaccaagagacattataatttaattagagaacttaaaacaaagaatttggaaaaagataacacaaatttagagaaattaaataccaatttaatttctaatccaattatactacaaaagtgtgaccaagagcttaatctggcaacaaaaggtcatgaattaaagtacctatttaattctctattcctaatatactaatacaatacactcgagcaatatattaagaatacaaatatttatgaaaggtaagttaaaagtatttccaagtgcaacaaatatcatgcaattacaatgcaagaattatatttcactgtaatcagcatggaaggaggaccgggacttgtactattcttgactagacttacaacttttaatttaacttgggggttggggcatggatgggaatggataatgaatgatagaaccacataggatgacggtatgatccagtgacagaaatatggataaatgtgcctggaggtaaactgttccaagtgagacttggagaggtggccacaaccatcagtaaatggttaaacaagagaacataatgtagtgtttatttaaaagggctaggttataactttgtgaaaatatttataaaaaccggcttcgtccaaaaagaaccttgacctttcgtcaaccctatgtgcattaatcatattatagtgggggcttatgagtactctagtactcaccattgttattttcccctctttttagacataaaagcgtgagaagaggaaactctactggcatgattctgtacttaattagcacatgatcagaaggctgatcgagaactaggttgtgaccctagccatctgcctgtaggcatgtgagttggacctactactatttggtttcagctgttgtttgtctaataggacaagatcctatttgtcctagtaaaggtattaaactcctttggcttaaattcatctctatatatgttttgtattggttatcaatttgtatcagctgcttatctaggattggtacaagaaaacacatgaggttcccgatatccaaaatcgggagctgacatagtgatccaaaaattttaaaatagttgacaagatagattaatattacatacatcactatacaaactcaatttttaattttacaagttgtaacaaaaaaccaaatataactgtgaatttacattaactattttcagtttagtttgtattttattataacatgtagaagtgatatactccctctattacaaatagaagttgaaattgatgttatatgtgtgtgaactgatattactcagtatataatactgagttttaatctatctggtaaattctttaaaaaatgataaatatttttttagtaggcaaatatattaactggctttagaaaaaagcctagagaacaaagaagtgtcttacacagaaaaatgaaagtaaaaaaaaaagaaaggaaaacaacacagcaagtatcactacaagcacaggagggaccggccggaaagcctagcccccacacaaagggtacgtttaaagcgatgtgtaaagaatctgaaataatcgggagtcccggaccactataacccgtgtgcattgtatcagcagcagaagcctttgaaaaatcagccccatgcatgtgacggcagtgttggatggaatcttggcgcatgcacggcgtcggatggaaagagataacggtgggaaaaacaagaaaatgctagatgcacgcgcacaatgcaccaagaaatcctacccttccatcgatggccttgcccacggttacagccgaaatttatttatttttatttgagtacgattgacggaaattagtgaacaaacgagcaagagcatagtagtgaaaccaatattataaataactggggatagttttggttcgataaagcaaacacataaatagtactcccaccgttttagattataagacgttttgactttactcaaagtcaaactacttttaagtttaactaattttgtagaaaaaagtattaaaatggcaccacatgaagcattatatggaagaaaatgtaggtcactagtgtgttggtatgaaactggtgaaaataaattggtaggacctgaatttgttagaacaaaacaaagcactattgatataatcagagaaagactaaaaattgctcaaagtcgacagaagagctatgctgacgagcgaaggcgagaattggagtttaatgttggtgaattagtatatctgaaggtttcaccaaatcgtatgacaaaaagatttggaatacaaggaaaattaagtcctagatatattggacctttcaagattattggtagaaaaggagctgtggcttattagttgaaactgccagcaacactatctacagttcacaatatttttcatgtgtctcaacttcgtaaatgtctaaaagaacctgaagagaaaattaagcaggatcaagtgtagctgaaatctgatttgtcctatgatgagaggccaagtaaaattttagcagaagattggaaacaacttcgtaatagaactatcaaattctgtaaggtcaaatggaaaaatcattcagaaagagaggccacatgggagaaagaagagttgacgaagaattacccttatcttttcaggtataaatttcgtggtcgaaatttttttaaggggggtaggatgtaacgaccctaaaattttaatttgcttcgccgcactgttggcaacctagttatagtaaactcactgtgttgagctgaacgactagttgtgtcatgcgattggcttggatttttgcgttagaggatcgattcatatgcatatatcacagtagaaaacacaaattagacacataagtaaattctttatttcttcacatatacattatacagtgttgttgcatacatcaaacgcatctcatacattattcatctaaaatagaaataatgaaaattaaataaaaatgttggtgtgatctgtgaccacaccttattgctttaggagattttaaatataagatttaggcaaaagagaaaatttagagttgcttgatgtcacatattttgcaatcaaaccattttggggcacaaaattagtaacattagccatctcttagtagcttccaaaactatttatttcttaggtaaactgtgagtttttgggcaattgaaaatcagtccctaaactcaaagtaatctccatatttttaaagtctatggtactataatgcaaaagttacaaatatcatacttttcactagatttttatttaattgcaaatctgtgaaaaattatgctgagcctccaccgaataaaccatgcttaggtgtcaaacagggagaccaccagtaaaaccttagtaggtgagtcacctagtagtcaaccatgtccctgtgacaaaaaccatatcagtgtgaactccatcctgaccgagcctcgttttcctcgtagagaccaaaaccagtagcaagaagaaccaccataaccagagagttagagaagaaaagaaaaatacaagagggcaaaatcacccaacaacaggtggagcaggggctccagctccattaggaacaggtaccccagctgaaggaggagacgctgattcagtagaatcaaccaaccaatagaagctgcagtagaagcaaaagaggagttcaaccatatattttcacaaccactgaataatcaacaaagaagtaaactagtttaagatttaggaaagagtaaataatgtatatattatatttcctgatcacacgcattagcaatttcagatttttattcatgcaagcatcatccatggcatataatcatgattgaaatcagattatttacaaatcaagaatttagagaccatatcatttgcattacaaggttacagtggcacacatccaaccaatacttttattgtgagacattatgagaaatagaacagaaaaatagaagggggaaaagggatatggagttactggtgagggttgtggctgccgcagttgccattgaggtattggccgtctccacggcgaccaccacaggagttgagtaccaatagtcatgaaggacagcaatgctcagattacttgagagaggagaggtggtagtagaggatggaggtaaagcaggatatgagctcgtgggaactagggagaacaaatcactgcaggggcagctgctagggagatcgccggagtggggagtggcagccggcctgagggagagcgttggtgttgacggcactgtttggggatggcggcacaggagagaaggcgtgagggagagaaggagataacgagagaagaagatgagaagaaagaaagtgggctggttgggctttggttttgtgggctggactaaattgatcatatatagtctccaggaaattagatttagatttagaatagaatgtgagcaagtttatatagcatacaaattgatgattctaaatttttggcattagtgctaaaataaaatctgagcagagaaaaataaatttatataacagcacctgatcattatatttgccattcataatacacaattcatatgcattgcatgcggtaaattaagcgttcggaatatgtccttattcggacttcagtattttttttccgaagttcaagttcctgaggaatcattcatttcgactgaatctgagggtattcatggtgttttctatccaggcaagtccatctcttgatcatattgcttagttatttcaaatatttgcaacctatatatctctccccattgcatagaaaaccagaaatttatttttgaatgttaatattgtacatgtgaatctgtggatcagttctttggtgatcttgataattggcagtctgaacttagttgttgtgtggttcagctgtatatgcttaacatcataaggttaattaacaactgctgtaaggtatgcaagcgccgtagcgatcatgtcgaccatatgacctggaatgggacaggctggtttagtagttctttcttaatggctttatcctgcgggcttaaggacttccgcgaatcccgtgagcgtgggctagcgatgagggttgccgttgttgcggaatctgattagatgatgtggatcgccgttgttgcggaatccgatgattcgccgttgttgcagaaatcacccgcagagattattgccaaatggattgatgaaaagcttgtgaccttatccttgccggcatacaccatgaagtgtgcttaggcgctggcgtggtggctgtgtagcgcgggcgttaaaaggtttaaggcgtctatgggtatagcgacacacctctgcagagtgtatgaattgtgatatgtcactccctgtttcgggtagcaactgcgggctgcagga

SEQ ID NO: 44075 - DNA, 37080 bp, Oryza sativa
  unsure (1)..(37080): unsure at all n locations
ttgtcaaaaacattatgaattctttgaagaatcttggattctagagatagttgcattcacacatttcttgctattgatgggcttgttgagtaccatttgtactcatcccctatgttaattccttgtatatagatgttgaatcattagaatctgttgaacaagaatatatggctggaagtgaaggaactcacgttatggatgacaaccgggaaggactctacgatgatgctgagattgactatgataattagtgtataatatgcatggttcatatagttgatgtagtggtgatggtagtagcagtggcagcggtagtatttgtagtagtagcaataacgttaatatgagtagtagtaataactgtagcagcacttgtgaattttctagtgtgctgtatatttgctgagcttttggggtttgtatattattttgttgttatcgctcgaggcttgtcttgagctgtatctattgtactgtaataaccggaaccaatgcgatgtttctgctatgctactctgatgtgcatatctctgagtaaacgatgtctatgaagatatatgctatagacttatattctactcttgttgtggaatatgtgggtcgtttcaggtggtatcagagcattgttcgaccttaggccgtaagttagttggagacttgagaactctaggattggttgagattgccttgtaaaaaaacatagattactaaaattatgttgcaaaattttcttattctcttatccttacttgtgtactgtttttttaaaaaaatatagattcccttgattaactataagtgctaactagtttgttggactgggaaatggaggttcaggatattgaattgccaaggaccacactgactcaaactagacaggtcgacgactttcatagtacatgggttagataccttgcagaggttcaaaactccattggacaaactgagagaactcaattggagattcgcatgatttatgaggggcctggattgctgttttatgaagcacatctaactttagctcctatgcatggattttaactgcgtgagtttcatggttacaatagtgaggagagttctggaaatacttttgacaaggattattttccttccatgagagagcgacgtttgactgatactacagcaccagctcgtcgtagtgctcgactgcaagctagagagtctcagtaatgtggtagtgtaggaattagagggactgacttttgggaatggctggatattatagatggtttattaaagatttttccaagattgctagacctttaactcagttacttagaaaggatgttaaatttctatggacagaggactgtgaagagagtttccaagaacttaagaacttaagaggagactcacaaatgcaccaatgttgactttacctaggatgggtatgaatttcactgtgtactgtgatgcatctaaaacaggattaggttgtgtattgatgcaaaaccagaaagtaattgcttatgcttcaagacagcttcgacctcatgaagtgaattatcctactcatgatttggaattagtagctgtggtatttgctctcaagatatggcgacattatttatatggagcaaaatgtgaactgtacacagatcataaaagtttgaaatatatttttactcaaaaggatctgaatatgagacaacgacggtggttagaacttataaaggattatgatctagagattaattatcatcctgggaaagcaaatgttgtagctgatgctttaagtcgtaaagcacaagttacacagattgtaagagaggaaaacatgcctaaagaaaattttgctagtttaaaccggataaatgttgaggtaattcaaggtccagctacaacagtaataaacaatatgatactggaatgtgaattgagtagtcagattcaagataaacaacaagatgatgcatatattcgagaagaaattcaaagaattaaagctggaaaattttctgaattcaaacttgatgataaggaactgttatggtacaagggtagaatctgtgtgcctaatgttccaaagattaaggaattaattcttagagaagctcatcaaaccaatacactatgcatcctggaagtcctaagatgtatatggatttaaaggaaagattttggtggagaaatatgaagagagaaattgcaaaatttgtatctgaatgtgatgtgtgcaggagggttaaagcagagcatcaaaacccggcaggattattacaaccattacctattcctgagtggaagtgggaacaaattggtattgattttatcacgggtttaccgagaacaaagaagcataatgatgccatatgggtaattgctgatagacttaccaaatcagcacatttcataccaatacgacagaatatggatactgacaagttagcaaaactctacttagatcgaatagtaagccaacatggagttccaaaacgaatagtgtcatatagaggatatagaggatcagtgtttaccgcaacaacggcgaatcatcggatcccgcaacaacggcgatctacatcatctaatcggattccgcaacaacggcaaccctcatcactagcccacactcacaggattcgcggaagtccttaagcccgcaggataaagccattaagaaagaactactaaaccagcctgtcccattccaggtcatatggtcgacacgattgctacggcgcttgcataccttgcagtagttgttaattaaccttatgatgttaagcatatacagctgaaccacacaacaaccaagttcagactgccaattattaagatcaccaaagaactgatccacagatccacatattttaatttgaatttttgcaacaaatatttgtcaaaaacattatgaattctttgaagaatcttagattctagagatagttgcattcacacatttcttgctattgatgggcttgttgagtaccatttgtactcatcccctatgttaattccttgtatatagatgttgaatcattagaatctgttgaacaagaatatatggctggaagtgaaggaactcacgttatggatgacaaccaggaaggactctacgatgatgctgagattgactatgataattagtgtataatatgcatggttcatatagttgctgtagtggtgataatatttttaaaccaagactaatatattataaaatttatccaattatagatttaatgaaactatgctggtgttgtaaatattactatttttttctgtagagttagtcaaactcaaagtagtttgactttgaccaaagtcaaaacgtcttataaccttaaacggatggagtacgatacatatccatttcaacgatggattttaaaacctgaaagggcaccgttcaatacaaattaaaattaaagtacacacgtctacccgtcgtacacctggtttgcaatagcttcacggtaagccgacatagctgcctcgctgttgggtgagtcgtaccatgtgcgtaggggtggcgcctgtggcacatgggggtacccgttgtacaatgggtgatgtgtcataaagtggaggtcgttactatcaatcttaaagttgtgaagagcaaaagtagcaactataatctttgtctgagcatcagcctctccaaataaaggaattcccgtaagactctccactgactcttgatcatcccaaaaactctttcagttgtattacgcaagctgagtgcatgtagttaaaagtctcttcctttccaactgggggtggagctttgtcgttatcgaaatcatccaagtggtatagcacatgtggatacggcggtaggaaaccgtacctactgggataaccatagtcaacaagcagatattttcctggaaattgaagaaatacaagtgtacgcattgggcacaagtgcatatttgaacttaaattaaaatgcaaatgtcaaagtttgaaaagattactaacctcatgacaaccttggaaacgcgaagggataagatcgcacagcctctgatagcactctctagtcgtggactgaaccaggccatccagcacctacaaacgtaactcgttcatcccaaccaataacggtgagcacattccttgaagtctcgttgtgacggttcccgtgtacagttgaagttgaggaccgcacgagaagaggtatgtgcatctcatcaactgcaccaactgcatcacagaaaggaaggcaggcaggctcttgccctagacggtaatgttgagcgaagttgtttggatcaacacatttgatgatgtcggctgccattgcatgcacaacattcaataccttgtgaaaatatctatttaccgtggcattgcaacgaaccatcctattgttgatagccctcacgaaatagccacctgccatagagtacagaaacattccaattccttccatagggcatacctcataggtaccatgcagatggtacctgttggtgagtagattatagagagcatgaatctagtccactctcatgcgaaacatgttgtggcactgctatatatgggttgcccatctccacaatccattttgttccgtactactgagggacacgtcttggagctcttatatgcacattcctttgaaaagaagcagccaacaactcaataattgtttcatcctcttcaccagtgtatccatcttgagactctgaggtgttctttgaactgatactcatcctcctaattcatcaaataagcaaatagaggttgttatgcatgttatgatcagtgtcatataaaactagttcatttgctctaaaaaaagttaattagaaacacgtaaataattaaactgaagcaaacaataaatttaggttagaatagtaatgaagacaggaaatttggttagttcatgtctgcacaagttcagctcaaatgttaataaattacaaaatattaaatttatattaccataagcacaacaaataaattgtagcacaaatacagaactaaataaattattccattaaaccaagcaactcaaatatcaaatgcaatgtgtgccacattattcatacatacatacaaataaacatgcatacaacgtttatcacaagtgttgattttaaaatcgaacacattattcaactatcatcacgatggaataaaaaggttgcttgagcacacttgagctttagcctcctgcagcagcaaacatcagcttttgcacttaatagcagctagcactcaactgcaaactgcagctcacaacaacagcacacacctcacagcatcacacacagcacatagcagcacactcccatcagcttcggcatacaacacacagcacacaacgctcccagcagcagcaacactaccagctccatcccccatcagcacaatgttgcaccatcagctcccccagtgccatcatccccagggtcacccccatcgtccccatcaaaccctccaccaccaggtggaaaccaacctcctgagcatgatggtagagggaaaacctccaccattaggaaacttcatggcatagtggaagagaatgtaatactcacgcatctcctgagtaatggcatcaccaaggaataactcgtaaaagtaggggtcacacttgatcagcacaatgcaagccctagcactcctcacctcttactcccgctgcttttgtgctttgctctcactggacttaaccctaagatttgcgagcctctacaaagcctcacctgtggagtcactgtgggtctttttggaacccctagatccactactcggtgttgccacacttttgtccctacgcctgataagccttgatggtggctcagatgatggtggcgactccgacaagttgacaaggtgctaaacatcaatgacaccagggttggctggcagcagctgctattcaggttcagctacaggaacacttgaacggttgccgacaacagtcctccctctgaaaacagcatggtgttcataaatgaatctgacatgaccacgcataaatgatcttgcccctctcctcatctgcatgtgagaaaaagagatatataagaggttgaatatgaagcacaattgcaaatgtattgcataaatgactgccgccgacatttgcatatccaatagcataatggagcaaaattgtgttgcagcaagcaaggacaaagtagacataccaaagttgaaaaaaacatcaactacacagcagttgtgcatgtttcttttgcataaccagaacaaaactgaaggcacaaacatgaatcacccaacagcagcaagcaaatatgtgtaaataaaccatagaatccatattgttgaagcaacaagctcacagtagcagcatgtgcagtccatacacatatgcagtgtgcagaccatacacatatctctactacttaaaaaattcgtagtggtggtcttgattcctgacatagcagacgcatctgacagacacacgtaatctcaaccatccgattgccatatccaacggcgtcaatcttctccccatcacgcgctcgctcctctcttgaatcgatctcctccccacgcccactcctcctcctcccacgccgcgtccttcgccctcctccctgggcgacgctcgccccgccgccgcatcgcctcctcaccagccacgcccgccggcctcctccgcgatcgccgccgccctctccaacgcgcctccacctcgcatcggatcgatcatccaccttcgccctcctccctgcgtcgcctcctcgcctcctcaccttcacacctcgccaccgcatcgcctcctcagcagccccgtgccccgcgccccgcgtcccgcgccgccctcgaccgccgacgctgcgacccgcgccgtctcctcgctgccgtcgccgcgccccgagtcccgcgtcccgcgctgccctctaccgccgatgcgggagcaggaggtcacgccgcgtcaacaccgccgaggagccgcttcctcgccgccgtcgcgacgacccgcgccgccctcgactgccgccacctccgcagatcgccatcgcacgcctccgcctctcaaggtcacacgctcatcgccgcccgacaccccgccgattggggaccgaacgctgaccctgcatcgacgccacaacagtcgacagaggggagatgttgaagacctcactccaacgacggctgcgcgcggcgacactaccaggcactgagggagagaatgcggtgcgaggtgcggcggggttgttcgtccttgcccagatcaatgccgccgccgatccctcactcgcccctcgcccaagtcggcgccaagggcggggttcgccaatctgcttcccagccgcctcgcccgctccatgggagaggtgacacctgtgcccgcctccagcgctccatgcccccggataccatccgagcacgatccctccttagcttctgccggagaagggacgcatgcgccgaccttcagcactctacgcgccctgtggataattggttcgttctctttacgttgcaatccattcatttgtcaagaatcatcattgtgagtgccgagggttattacagattgcaggatcactaatgctcttttttgcccataaggtgttcaacgaaatgctgcttagccaatgtattaccagaaattgatttctctgtaagtgagaatgtcatattgtcatgtcccctatgttgttatttatactaatgattgcaggattctctctgttgttatttatgctatgaagtgctgggaagttgagagtgttgctaccaagcaaaaagattcaattgatctgttggagcaaactaatttggatctcgcagtctcaaaactaatctggttcttgattgtttcagagtggatgaaaataaaaaatggaatgatgcagtgaagattatgtaagcaatgttcgtgatatatcgatcctgaaattctcatagatggccattgcacaaatacaaaaatttgcaggttattaattagtgaactacatctctgtaaatctgcataacatatgttaaagctagcccaagaattaatatgttgtaaatctgctctacagttgacactgcttacattttctactattaataaccctcagctgtgatagatctgatacctgcttaaaaatttgagctgagttttcatacctagcagtaggactaacattttatgttgtattgttcagctcaagatgaacaaccacaccaaccccaagatcaccaactaagcctatcctgcttcatgattgttgctgcaaactccaacatgcttgctgctggtgcaatctgagccggctggtggcagatgggagcctgccctatgttgttagcagctttcttcactccaagtcatgcttgctgcctgtggtcttggtagtttcttttttgtgttgtcaatttaattattatgatttcccatgtgctcggctattggtgttcttgtttttatctgttttgtttcagggtgtcattactatggagtagatcatttttttcttattttttttaatgccttgtaaaataaccaactagcagggatgttcataaatttctcccttttgtttggtttttttcagacatatatatataatgaaggcatatatacacaaaaggaggagctgtttgagggtctaaaggacaatagctcaattgactgggaagctgttgtcatatgctgagagcaatctgctaaatgttaaagaggtgcatctaacttttgtacccagtgaactgcaaatctgcaccttcatttttgattaatagtttctttggattcagatcaaaatagctcaacatgggaatttttctagcagaggatgggcaattcttggaaaatactatatatttcttgtcgttgaatatgatcatgtcccattattttggcacttgctgccttgattctgttgcctgtcccagcccttcagctagctctctatcacacatgaatgcgtgacccttgatggttgtatgcagttgggatattttggtgagttcatcccccttccccaccccacctctctctctctctctcaaaaccatcatttatcttcactattgacttacaatttcacttctagctgatgatgatcaatcaaagctagctcatatgtattagtgagtttatgaaaaaaaggatcagatattcaataacagagtcagctccttccgaacgatggcaaaatggtacctttataattttacttctcaacacgcacacatttttttatgacgagtttgaacttttgttctccttgtcagattttatctgaagcaagtatcatatacttctgtattagaatatggacgcaatcatatatctcctaaggtttagtgcatactctcatatttggaagtgaataccaaacgtgtatgaaatagtgcattcgatttaatctattctctcttgggcatttattcgcaaatgcaaagatttttgtaatttgatcgtagcatagattatggcaaccttggctttgtggtttgccatgtcatgtactgatatatgaatgtgatgctttaattaacgttgaaaagccatgaattatgtattcgaacgaattgattggatgtgtcctgaaatcggttcagactttcgttctttgggtactggcgtgagacggggaaaaagacgctgaagacatcaagcataacatggagttgataaaacatcgtcgactgaatcatgatttgtagtttttttggattgccagatttttttcagtgttcaacaaattttcactcaataattatttaatatcttttcacttaatataatttgaaattgatatatagcatttcccgttgcaacgcacgggcaccttactagtgtcacaagaatgtacatatgccacaaagtcctaaagtgtaattaaatagggaggttatccattgacctatgttgcatttgcaaaaccaccccataatgaggagtgaaacaagatctaaacattgtgaaaagcattcaataatgcatagcatacagctagttacagcagcagctaacttaagaataaagtttgcaaagataaaatgcaagcagcagcaaacagcaagcaagcacacttcatggcatttctatatgacagtagaagaaaaacgaccaaaggcatgcaaaaattctttaggtgtactatgcataacaacaacagcagacaacaaatattgttcagtggtaatgcatttcaatattttaaagtgcatgtaccttgcatcagtaatatgtaatatggtttgtttgtattaaaaacatcacaagatggagatgtaaactaaagatatgaggttttttagccaatcacaaaatgctctaatagtcaatgacaataaaatataactatagctaaatatgggagcaaccactattgtaggcaaagaaggtgatagttaaaatataccatgttgggagtagcaggtgttgtacatgtgttcatgaccttgtataaattaattgagctcttgcatgtactctattgcataataattaattgaaagtagtgctacgtattattcaaaagaaaatttggatttgctaagttatgaagaccaattgtactctagttggaagtactatatcatatttcattaaaaaaaatagcaaatttatcatctatgatggctttaggttttgaactcatataaatgttttagttttatgtccttgtagattctcaaataatgctactttcatttatcataagcatctacatttttgtatgagacaacataaggaaacctatgagatcataatgtactaaccttggaaacacaatgtgatgtttccatcaatataattaccatgatctacgatgactttattcattgaaaaatccatatgtacttcctccaatgaattctacatttctcgatcacacatacctaacttaaaatttgattacatctaattaaactatgtattctactctgccacagccaaaaattagttaacagctacatttaatcctaggttgagagatccaaatatgatggttttttctacccttatgtgaaaatgagttgtcattacagcaaaaaggagtactgtgaggacttaccccttccattgattcccaccactctgggctggcgccgatgctgccagtgtaggggttccttcctagcccagttgccatagattccagccatgtccatgtctagaatcggcggcggcaaccatcctagaaattcttcacctgctgcctgctgcctagtgacctgctttcctaccttggccagcatctaagcttgcgagttggcatacccctgagctttggggcaagacgatgtgatgttgcgagctgcaatttcctccatgtagctctctaggaacgcttgcagttcgtccttagtccagtgagtgtgccctccgccagccatctaaccacacaagttgagcaaacagaaacaaacctcagaaactcaaatctaggtagtagttacctttcttagtttgtcggatttgaggaggtcccaatccaacgagcgcacaaccttctccggcgtgaggcagcggatgaactaacagactgcttcagggttgttggcagctacggatgagagcgcacgagcgatgagctccacatcgtcttctgcagtggctccagacacaacgtcgaagatgtacaacttgctagaatcttggctcgattccaggtcagctgaaacctctcccaacttgccggcgtcaatgggcgacactaaagagggggaggtacagaggagaggttgaggggatggacattttctcttgattcctcttgctgccatgatcaactacgaggggtctaaaataggcgtcggcggctcttcaatggcgcacacaaatattgaagccgcgcgtcgacgattttacctaggcaaattttgctataagacactgccaatgtgtggttttagccctaggacactgccaatgtgtggttttagccctaggacactgcccaaacttacttttggaggaaaacacttcataaacgtggtaatttgccaatggacaccgcaccaaataaaataataatttctggttgaagaggagagagaaatcgcgtgaaatgtcaaaaatgcccttgggcccacatgtcagctatcttctctctctttctttttctttctcctatcccttcttcttcctaccgatcgggaggacggccgggtcgctgctgggcgcgatgctgatagtgctcttcgtccgccgacgaggttctatccaaagttccaaaccaaaccaaaccatttcccccttgtagattcaatccagttcttaaaaccattcaagcccattctaattccactgcaagccaagcgaagaggagtagttcatgttgaggcggaaagtggtgacgcccgcgccgaacaccccgtcgggccccgtggccgtgcggcactggaactgcatcatctcgttgccgtcggcgccgtaccgcgcggccaccctacacccacaccagccgtcaccgccgcagccatcggacttgccggcccgccgtggccgctccaccctcgcccttccaccgccgccgccgccgtcggacctcgcctgcccacctacgatgccgtgctaatgctgctcgtgcgcgtgtcaccagtgaccgccgcggtctatcgcagctgcagcgtctcggcgtcgggctggcgctctgtagacgctggaaaggggatagagagtggagataagagagctgacatgtgggtccaagggcatttttgtcatttcacgcgatttctctctcctcttcaaccggaaattaattattttaatcggcgcggtgtccactagcaaattaccacgtttatggagtgttttcccccaaaagtgagtttgggcagtgtcctagggctaaaactacacattagcagtgtcctgtagtaaaatttgccttctacctactgtactacacgagatcagtgcagagatcgatcaaatcagctcacaaggctgcaaaaatgcagcaggaatcgctgccaggctgcagcaatggatgttggaatcgctgccggcaactgcgcacaccacgcccctttccacaggatgcggtctccgaggggctgctcacgagtcattgatgtcacccgcgtcatcgcccggctgcacgccactgatgacaacgagcaacgaattcagctccgcacggcacgctgacgctctcctcctctgcctcgacaatcgccagtcggtagtatgcactcttacgcgacgtgtggaaaggggaaaaaccggtggacaatggggtgagctgctccttgcgatgggatcacgagagagcgctagaaggagaagatgacgcggtgacgaaggtctgacgtaaacgtcatgctcacaacggcgttataacccacgtggacttttatagtatactttaagcccaacacaaaattctgctacagtaacgactcccctagcccatgtcagcccatccaactcgccactttagagcgcacccaaaagctagattgctccctagctgggatgacagctgaaaactcctgaacgacaaacagctggtcaccaacaacgccaacaaaacatgaaacatatagcacgaccactacaacagtcccaaatcatcaggcagccttcccaccatacgaagttgcttggccttctgcatctatttgttatagagcaaattcaaatgaagattgtcttttcttctttgaaaaggattctccatctttgcatcagcgtgatcaacatgtaaaccaacctgcagaggaggataaatattagtgacaaagaaatgagggatgtcaagattactagttaggtgactatttagggataaaaacccatatccgctgtatcgatgcactgattgtacgtcttctgccaagcgatcgaaggcagactcaatacgcaccttctggaatctaacgatgacattgaaaaaggataattaattggccatgatttgctttaggattttaatttgcaagaatacttgttagctgtaaccaaaactattgagcaagaaacacatgcgagaacgaaattgcaaagtgagagagtacacagaggtttttggtgctgcgtataacttgcaccatatggccttacatctgtggacagcatcttgtagcgacgaatatgcatgccatcccaggcgttagagaatcatgcccgcgtgatgctcttcccgtgcgaatgaatcgtgcatgtagagcccaacggcacacaatcgattcattcatgcacatgacttgaacagaaaatatgcaaaaagaaaggagatggggagattccaaagtaacagaattaacaaaacaagcacccaattaacttcattcctaacaatactcattagacgttagcataacaatgttgttttatgcatcagcattggtacgtagcaagaacatccagatcaatcattcatgttctccatctggcactaaacactttacatctaatcagccctaggccatgtgtctgtagcatccaatgagaaaacatgtggttgaatagtataggaggagagtacactgcgtaacgtggatacgctgtattgagcctcaaggggctggtatatataggagtacatgggaaggagataaggaaggattacagatatgcaaggaatccacacaaatcaatcctgtcctaatatgactctaactaccatatactctaacatccccccgtagtccaagcgtgagcaatgcggacacttggactggagaagaaacctgcaagagtactcaatatggatgatatccctttgtgccatagtcgatgtagccaaagcgaagggtgcgaggaagctgtggtcgatgaatccgtgcgtagagtagccatggttgatgttgttgaaatcgggtgtgctgatgttgaggtagccgagccgcatcgcccgcaaggggtgctaaggagtagtcatagacgcacaggagggcgtcgtggaccaaggtgcacgagaacacgctggagacgaagacggtgacacaatcgcggcagtcgttggggaagatgacgccgaagagtcgatgtcgttgaaccgtgaaggacaagacattacgccgggtttgctagacctgaggacaactcgagttgaatgcgtgcaacggtgttgccaatatcgcgtgggagatggtaggagaccaccatcaatctatgacaatgtcagaggagactagcagagaaggcctccgagacggttgcgacacgagaatggtgtagagggagaattgccggagcaacatgcagttgttagagaagagtgaattgtagtcgaggaagatacggcaacgttggcaatgagatatgctagacgaagaagaaggtgaagtagcaggaccaacagtatggaatgacaacctcggtagccgaagtaggggcggctgaaccactggcctagagtggcaacggtagcagcctggagatgcggcggcgaggctcgaagtaaatgaagaagaccctgagcggctgatgatgaccagtgcggacaacgaggttgtcaatgcgcgaacggtgatgaatatgacaaaagcagcgaagctgtggtccaaagggacaacacagttgcagctcttatgtcgatgcagcagcatgaactccactggcggtgaggccatgctgaggagggcgcctctcagcattccaatagccaatggaggtggaccacgggcgatggcactgcagcctgagggggggatgcagcggcaacctgaagcttgatagcgtagatgcgtgcttgatgacaatcggttgcagaagtcattgtagccgagcacttgaataggtgatcaagccgaacatgcgcggggcaggacgacatagaggaagccagagccgatgccgatgtcggagacgcgtagatatcgacgaggcggtggacgacacaaacccggtctctgatcgggagaaaaaaaaggtatatgcaacagcagtaccacagcaatcaacacggtagcaacctcctcacaatctgcactatagcagcctccccacacagttgatccagccaaccattggttaaaatccccaacttgccaccccttctctctactcgtgccgactgttgaggggtcaaagagaaaagagagcagggaggtggcgtggaggagagcaaaggtgttaacacaaaaatttggtaagccccgaagtcatcatcggcctagagtcagtatcggtttcagagtcctggaatcagccaatgggcactatcagtcgccagtagtcggattcttgatgggttcagttaaggaaattaatcaattaagggaagtttatccagaagagaccgagttcaaggaggatgtggcttggaagtttatctattaattaggaagagtctgttagtttccttttatctttagaaaagtgtgtttagtgtttgataaggactttatgttttccttttaacattaggaaacaaattctcttgtccaataagaactagtatctacccatgtgtataaatatgtacacccggggtcattgtaatttatctctcgatcaataaaaatactcttggcgcatcgccaccctcttttccgaggtttttacttatcaccagcgaaacttggcacctgatgcggggttgcatcagctttcgatctccggtgaagaggtaagtcctacgttccaccggccttggcaattgtatccactacattggtgttgttcaaggctacatcgctttgacctcttggatcgctctggttcggttgatatatttgcctacctacctatcacatattttagttaatctagtttgacagctcaatttacttgtatcggctgggatctgctttagggtttttgccggtatcggctaaattgctttgccatattggattagctaaggtatccaccactattaaaaatcagtcaagggcttgattgtttagatattatgtttattttcatactttgcacaacatcagacctagtcgtgtttagaaccataatctctaccctgctttttgattgccaataagggtttcatcgtggtttcaactgatgagttatctggatgttgcatcgattcacaaggattacatacaagttggatttagcatgcaacaaaggtttcattgtttatctaatcatttggatttaataacatcggaccttcagctgatgtatgctttaaccatcatatcacttattctatcatattattattagtcgattggtttctactggattatattattgttatattacattattatcagccgattgtctttatatcattatctacattggacatatagctgattggttaaaaccatatagccgattgtctttatacattatctacattggacatatagctgataacttattagccgatcgactcttcggtgatcaacatatttatctatcttatcagttgcaagatcaaactggctggcacgcccgcatctcatcaagttttggacttgcactagagctaagcagatctccgaggctgttgtgttcgtcgacttagttcgcaccaacacagatctggcatcatcgaattagcatgcatcccgccacctaattagtgtgtaattagcacatgtcagttattattgtgtactagtaatatgcctgtacaaatgctacggggtggcgtttgataactcaaactggcacaatgacgtttgacattttaaaggcatttcatttccgcatagaatggatgctattaaggttcaagcaaaaagttacataaagagttatgccagtgacaatcacgcaataccgcacatgtttcttctggcgtgttgtacaaaatcaatcaaatggtagttgtcagcaggatttgaatttgtaatttgtacaactcgggcactaccataatgattcgggaaggattttgaaaaaaaaacaggggggggggggggggttcatgagttatttgaccattggttgcttagacaagttacctacaatgttattcttatcaagttattggaaccaagacacaattttattcaatagtcgctaccatttcacatatatacagtctaaatctatgaccttaagaaaataatattggccccgcatatataaatgcatgaataatccaaatatatctaccctgcaaattacatataacatggtccaatgacatcctaaatgcagcaactaaattcagtttggatgtttcatcattaactacacaacttgggcactaccatataataagacagtcatatttattcacaaagaaggattctgaaaaaaaaaaaggtggttcatgagttatttaaccattggctgagacaagttacctacaatgttattcttatccagttactagaaccaagacacatttttattcaatagttgctaccattttccatgactgatttttattcaatagtcactaccatttcacatgtatacagtctaaatgtatgaccttaagaaaataatattggccccaaatatataaatgcatgaattatccaaatacatatacatttcagtgttctaaacttcagaccacccaatgtttattaaaaacaactgtgccatttatctatttccatttcagcacagaaatataaaggcttccccccttcaatttgactatatagcaattttattgcacacattactatgtgatcttaaaaatgtaagcacatgtacttgtataggaatataaaggaattttgcttaggaataaatttagacatggttttatttttgacaaaatgttgtcatgtacaatgtacaggagatatgcatggtcatatgcatatcagtagtacctttctcccaaaattcaatgaagaaccagaattggacaacgataattaaaaaaaaaatatcaaaacagattttcagattatcaaaagagcggtaccaggaagttccacatgcaatctaatttcaaaatgactggaagaattcaagcatgaatattaataaatgtcaaaatttgatatgacgacatcaatgcatgtcactaaatttgatatgccggcagtgatttgatataagtctttccccttcaatttgactacacagcaaatctgctccacagaaattagaaatgtactactgatataagtctttccccttcaattttggtatccgaccaggcctcggtgctagctacagttgcagcccctttattttccttgacgtatatctgcaagccatcgaaatgagtcagctatttctagcattctttgtatccctcgggaatgctaaaaatagctgatttgtgtgcgaaatagctgactcaatgggctatttctagccggtgtgcatcagtttcagtttacagtgcaggggcttgcgtgagctcgaggacaatgcaacaggtacgactgcaggattattgtctgaaatccagattattgtctgaacatgggcttgaaatatatcaaaattcagtgtagaactaaatataaaaagtactaaattattttcttatagagataaacaagaagcttgaaaggcaaaacaagagtgaaactcattcttacaagggaaatttcaagagcttggtgctccttcctgcagaactctgaagcataggcctgcacaataatacatgatgctgaacatgagtataatgcaacaattcagtgtcatgttcttcacttcaactgtcgaaaccgtaaatttaccttgattgcatagggatgggcttaagaagaatgtacctttatttccctgaacacgtcctttgtagcatatgataaaactaatcagatgtctgaatgaaatgagaatgaatagcacatgcagcaactacgaacattttacttttacctgactgcttgcaagaaggccgtctggaagaaatgcatggagcttcctcaattggtccaccatcatggaaagcgctggactcaacaccagcgtctgtccacgcaaaatcattgcaagcacctgaacaatagcaccattaacttttcaacacaaaactatataacctcgaaatctcattttttgcagaacatatgatagtagaaatttgtgtttatatcaatataatgaaagatggccatgctttgttgttcaaagggcatacagtgaacatacaattaagttgctgataactgtagcagtgtgcagaaactgcgtggtggcaggggtcgattgcggactgccaccatggacgttggttgtgcgggtcgacgatgctctggcggcggagatcggcgcggtgtgcgagaggaaaggggattagggcgtgggggagagagttgtgggtgaggtgcggcggcgcaggaagtgatcggcggaggcggcagcgcagggagcgatcccgtcgatcaggaggtggcgcagggagcggttgccggtgccgccgtggatgtttgttgcgcaggtcgacgacgctctggcggcggagattggcgcggcgtgcaagagggaaggggattagggcgtaggggagagaggtgtggccgtgtgggtgaggtgtggcagcgcagggagcgatccggaggtggaggaaggaagggagacggatgtgatacgttggatgattttcatccgctggatttgatgaatgaagtacgaaggatgtaaacatcagttggtgaattataggatagatagaatagatagatatagcatctggcaacgcaataaatataggcgttatttttccacgtccttatttttttcagatttcttttattcattagtcctttttcattgtttcttttaacggaaacttttttatatgaattatttcctttatacatgtatagtttctatgtgtagattttatatatgtaaagattgtatatgtagattttatgtatataaactttctatgtgtagactttatttatataaactttatatatataactaatataaatattcgtatttttccggttgtcacatctaatttcgtcagagttttcatccatacacaatccgattaggttagcaatattgatgtaaaaaaattgcaaaaattgcaaaaaaaaaaaatcggcggccgccgacgccaccaccgcccgccgttcgggccgccacccttcctgccccgccgggccgcagccgcctccatgccaccggatatggaggaggcaaggcccggcccgccgcctccacgccgtccgggtcatcgcctccacgccgtccgacccgccgcctccatgtcgtccaccaccaccgccgccgcacctcccctccccccgatctcgcggaggggagggcgtcgccggccctcccgccaccgccgcacagagagcgcgggggagaagtggagagagtgaggtgcgagggagggcgtcatggtgaagaaggctgccgtcgccgccgctagcggtgggagagggcaccgccgcgccgctcacgatgggggagagcgtcgccgtcgccgccgctgctcgtgatgggggaggtagccgccgccccacgtcggtcgcgagatctccggctgccgctgaggaagatgggaatcgcggtagggaggtagtcgccgccatagccgttgcagctcgcggtagggcaagtagccgccgccctgcctccgctgtgagatcgccggtcgccgccgccaccgctcgcggtgggagagggaggagaatgagtttagggttagggtttcaacatggaatatatatatatatatatatatatatatatatatatatatatatatatattgaatctattctacacccttcccctagaataactattctacaccccctcctcccatgggtcaaacccacctccccaccctccctagggcccaaaacccccctcccacctcggtcaaagcgtcctcccgccggtcaaacctgcccaccactccctcccccgcccaccactttgctgctctcgtcttacaggaatcgtgcagtaacaggacggtcatcctgcagtaacaagacagcattatcgcagtaacaacgtcaaaaagtagtcatgatggatctagtttcgttaagcgtttttttatgaacttcatggtgcaaacggattggaaatacaagatatgatgtgagagatattgctctctaaagattgtgatttatctcttttttagttctcgtctcactggaacagcgtagtaacacgatggccaatatatagtaacacgtctacttttcgcagtaacaacattaaaaaatatttatgatggttctagtttcgttaagcactttttttttacaaacaccatgatgcaaatgggttagaaaaataagacatgacgtgtacgttagtactctctaaagattgagatttaaaatactctagatctaaaaaacattactactataaggccactgttactatgcatgttctctgttactgtaaatttcgttatattgttactgccaaaagtgcagtaacaaactataaagtttacagtaacaacctatacatttttgcagtaacatataatgttactatccttttgagataatgttattgccgaatcatagtaacaaggtatgattgttacatgtatataactgatttattcataaatcatcatatggtgatttggtaagaagtgctcgccatgaaccatgagatcatgggttcaagtcttgaagttgagattgggggaggatcaggaggagggaggagcgacgggagagagagggtatttttaatttttctaaaaaagagagaataaggagggagataaaaaaaagaagaaaagttgatattgggggaggatgagaaatcgggaggaagagagaagaagagggagagaaaaaaaaagagagaagaagagggagagaaaaaaaagaagaaaagttgagattggggggaggatgagaaatcgggaggagaagagagaaggaggagggagagaaaaaaaagaaaagttgagattgtgggggaggatgagaaatcgggagaagggagaatcggagggaggagcgacgggagagaggagcgacagggaggaagggaggtggggacggagggggcgcgagagggagaggggggcgcgggaggagcgacgggtagggagggaggtggggacggagggggcgcgagagggagaggggggcgtgggagggagagaggagcgatgggaggggaggagcgacgggagggagggaggtgggagggggtatagaatagttattctaggggaggggtgtataatagagcttttatatatatatatatatatatatatatatatatatatatatatatatatatatatatatatatatatatatatatctcaagcgatcctaacgttcgattgaatccgacgcctcttagcgcatctaagccgacttgggccacatgggccatgtgcacttaacaggccaagttgtggaagacattcggcccatccttatgggcctaattgagttttatctattgagttgatttaaactatttctcccttaagaaacttaatattttcctatgtttagtttttctttcttcatgttaaattatttatatctaaatggagtcaacaagaaatgtaattgtatatcaattaaaaataaataatagaatttaaatttggactaaaaataaataatattaattattttttatatggactatagcctctttcggagaatattactctcttccaatattatttattttataattcataatgtcttagtccaaaatacaaaatgaaaaccaaaatacacaaaaaaaaagtttgcagtacaggagttcaattagcttttctttcccttttcgtccaggagtgtgggtctgccccgcttttcttttcgctatttttagcgttcccactacatgattttaaagatttctatcgcacactatatttaacctaaaacaaaattcagctctcacaagtacaatgcatagaaaatcgagtatattctcacaattacattatatagattacaagaaaatataatttccgcatgacgtgtattcagacgtgtcctttgggcaattccattcatgtcctttggtcaattccattcatttttcattaggattttgtactttaaaaatatttgatttttctattcatcacttaaatttttcatcaatcactttctacgcaaaagcaatcacttttgttgttcatcatttgttcctctcttgctataatcattgggcccacgcgtcagaagtgtcatccacaacacgcaaatgtaaagtagattaattgtcaaaaacaaatatgatttgtttatcactctacatatagccgatgtttataatcatactatggtgttttggtaaatcattaatatcgaactccagtcaccccgccaattcccggtgcaacgcacgggcattttgctagtagaatttatatgtctgcaattataaagtttagtgtattaattttaatagaaatataaatgttgatcatcacaggatattttttaaaaaataaaatagctacattactccaatccaagcaaacctcgtaagtcgtgacaagaaaacataaagacttattttaaccgaagaaacaaactaccgggacattagccattaaacaaatcatgatttaaacacgtaattaggcatgtaattagctatgaggaataaaagatgaaacggtaatcgcaaaattcgcgagattcctagctcgtatactagacctaccaatccgttcgcgtctcccgcaagttcgcgcgatagacttcccctaaattttacataggcttgacctcgaagcggccaacgattggtaagttcctccgctgaaatgaatcagctctccacttttcaaccttctggtccaggaagaactgtgctgtgtcatcaacgtgcaactcctcgagaaccatggcgttctccaccaggaacttggtgagatggaccggaaaactgtccatctccttggccgtgaattccatggtcaccttcctgacggttttctccaaacattcgattgccggctcgcttacgcgctgacgcttaagctcaagatcaccttcgtccttggaagaagaacttgagcttgactcgatcctcctcccaatggagttcccggatatccttcggttgaagcgctgttcttcggacacggggtggctgtggctgtcatccttcgttgttagcctgagccggagttcagaaacagctgggcaggattggagcagcttcgccattgctgacaacgatatgggcgtctgatagcggctgtgcaggtactgtgcttccaggtggaggaacgcgaggttggggaagacggggagggcgccgccgccgccgtcgtcgagaatgtcgtcgacgcagtacacgcgcagcgtcatggccctcatcgtcgtggtgtcgccgccgccgaggctgcggaggacgcggcacaccggctcgtacttccaggtgaagaaggaaggtcggctgatgtccacgtcgacgagcgcgaggttcgccggcggtggtgccagcgagatcgccatcgggtgcccgccgtacgagaaggagaccaggctcggcgcgtcgagctggagtgcttcgatccttgacgtcacggcgacgagcacgagcgtcgtcaccgtcgggcagcggaggcggaggacggcggtctcctccttcgtcttcgccgccgagatcaggagatggacacggtccagtctgagcatggcgagcctcggcgcggcgtcgacgatggtctggaggaggtgaccacccttggacagcgacagcatgcatctggtcatcgctagatccgtcagggacgggaacgccgccacgacggacggcggcgacgagtagcagcagcagcacgcgaggtgcagcacccgcagcgtggcggcgcacggcagcgacgctagccgcagcttgtacatgccgatggtgtcgccggcgtcgccggcgccggcgaccggtagacaatcgacgcggaggtcctgcagcccggccgcggcgcggtgggagaggattgcgccgatcctgctgtcgaagttggagagaacagggcgtgccgcagccgagtccacggcgagcgagagcttcttgagggctgggtcgtcgccacggcggaggacggcggcgagggcgccgtcggcgaagcggaagaaggcattgtgtgtggggaggaagggttcggagtagaggttgaggacgcaggtccggcgccacaggggacgccacctgcgtgagaggacggtggtggcggcggcgtccttggtgtgcagggaggagaggatgtgcaggagtaggtcgtcggagagttcagagatgcgatccacggcggccatggatgatgttctcggctgggcaacagcgagaggctagatcgatccgttagggtttcttcgaggaaacgaggaggaatatcatatatatatatatatatatatatatatatatatatatatatatatatatatatatatatatatatatatatatatatatatagccacacacactagcaaaagtgcccgtgcgttgcaccgggaagcgcacagatcaaaaaaatatgcaattaattaaaatacaaattcactgaaatatttggtatttttaaataggtatgtgtataattaaatatatttacaagtaaagcaagtgtgagaaataaaatgacattgttaaatttaattttattaaattctccatgattagttacgctctttggaattttattggaattttcagaacttaattgctaattttaataatacaaacatcatttaataattatttaattggaaaaagaaagaaaatccttccggttaggtttgcttagaaataaacacattcaataaatataattgtaaatgcttatgaagaaatgaagcactaaaaatgaacttctctttttttttcggcccgagggacctaatatagacttatttccggcccgagggacctaaaatagacttatttccgttccttccgatcggcccacggccttatcaaaaccctaaccctaaccctaaccctaaccctccccacccgcccccccccccaaactcattctcctccctctcccaccgcgagtcggcgaatggcggcggcggcgaccggctatctcgcggccgaggcgaggcggcggcatacctgccctaccgcgggcagcgactggtggcgggggaggcaggcggctagggggagggggcggcgccgccggaggggagggggaaggaaagcggcgccgatggcgggggagacggccggctgggggtaggggggagaggcggnntcngagaaccgacggcggatctgccgcgggagggaggctagagggccgccgcttcccctccccctcccctctggcggcgccgccccctttccccctcctcccaaccggcggcttcccccgtcaccggcgccgcttcccttcccatctccctcctttctcgccggctcggtgcggcaacggcggggttcggcggagacggcgccgtcccaacggcggcgacgacggcgtccgcggcggcctcgctccctctccccctctccttcccgtctcgccgacttggcgcagcgacggcggggtgcggcggaaacggcagcgacgaccgtccctccccctctctctctccccccgtcggcctcgacggtgacggcgccctcccaacggccgcgatggcgtcggcttcatccgcgtgcggatccggcagcggcaatggcgaccgcgggcggatcaggcggcagcggctccctccggcagcggtggtggtatcggcggccgtcgattttttttttttttttttttttgcaattttttccatgactattgctaaccgaatcggattgtgcatggacaaaagatggacgaaaattagatgtgacgatcagcaaaatacgaatatttatattagttatagatatagatatatacgctcaaagaggattatacgtgaattacagttagattagatgagatggtaaaagataagggcccatattttcactttgggcccatcctggcccttcttgacccttcatttctcctacttgcggaataagttcactttgaatcccttaatcagtgactgaagttgatttgtatcccaggaccataataccggatatttcgacgccccccaactatcctaagtggttttggaggacgggttcgctgacgtggcgcctagtggcagtgttgactcgatcttcattccacatggagttgacgcagttttttaattctaatgcactaagcatcacgttgactccacatggaacgaagaccgagtcaacaccactaaatagacgccatatcagtgaaaccgacctccaaaaccatcgagggagtcaaattccaccggtttaatagtttggggggtgggtcgaaatatccggtatcatggttcagggatacgaatcagagagtcataatgaacttattcccctacttgcagttgacgaagtcaccacaggcgtctcgctgtcgagaggtacggcacctaccactgaaagcacaacgccattaaatcctagaaaattcgctcccatggggagttgaacccaggacctcaggtgctactgaggctcttgtaaccactaggctacaaggtttatcatatttgcacaagtaattccttttttttaacacgcaggagatctgcgtatcctttctttaataaggagaaagaaaggtactcgtgagaatgctagagtttaaaacccaatgcaccaccactaaggttttataactcataccaccatgaatttcagaggtacatttatctacaaaataaactaaaagtgttggtttctagggcactttaccgctgaatgatttcctctaataaaatggtatgggtatgtttcataacaatgacaatgaaattgtatttcataaatatctttaaaacaggatcaacaatccaaatatcgacacaatactgaaattcacccaacagatatattctcaactgtaccgaggatatagaacacctattagcaattcaaacttcaaaggataataaacaaacagtacaaacaaataaggagtataaatcaaggcacagaatgaatgtataattggtgagaaacgatagtataaagtgagcaattataacgacaatattttactcctaccattttataatttatacattaacgaataacgggagtgacaagttttggtaatcaacaatatcaaggtgttaaaatggcaagctttggtcatacttttgttggaagatggagaaagcaggtttgagtgtctacagtttttcaaatgtatttgccaaatcaggttatgcagaaactgtaagtttaagaataaaaaaattgaattgggacatgaacgtattagcatgttttttctcccgaagatagctcgtggtacagtcccttttaagaaaagactgattcaagaggataaatatcctgaccgtatgcctcagtggtgactactgttagtgatatgccctagaggcaatcatagagatgattgtatcacatactatgtttacatatttatccgatattgttccttgaaatagataactccttattggttaatgaatatataattttttcatgagactctttatgttgtttgttactatttctaaaggatccctgatcaaatatcatatgtgaaacaaatatgtttatatgatcagcacatgtattaattaatgatcatgtctcatggatcatggtatagagataccaaattaataatgtgtacacatgttagtgaacatgttgttggatagatccaacatgagacactgcaagagccatatgtgttgtgtcatcagtaatctcatttagtgttggtgttgaatccttagacctgagattatcatggttttcaatatatgtagcaacttacttagggactgctaaacgctactccgtaaatgggtagctataaaagtagtattcggatatgctatgaaacatgtagtgggatatgaataatcaagatgggatttgcccctcctatggagagatatctctgggtccctcgatgttgtagattatggaagtgtatggccatgccaaaagtgattgaggagtcaatcacaagatatataatctatcaacagattcgagtgaatgattgagttattagaggatggcacatatctagccttgagcttaatcgatatcgtgaggcaaaggggttcatacaagtatacactagaggttcagccgatatgatctttatgtatgcccggtgggtcaatacattctgctaggggccgctgttgacgcgtggaccgaaaaggagttttcgggttacagccgagtatatatgaacctacaaggtcgcacgcttaatgggccagaataaggggattggatagagatccaatatgagcttaattcggatagggatccgaataggagtcctacgggccttggaggcccgagtaatggattctatatattcgtgagaggcgtgactggcggaggcattgcatcacgtgagaaaccctagccgtcacttccgtcctcgagcaaaaccctagccgcacacgggtgctagcacatctgcgcgtggcgtttcgtccctgtacgtgtggataccggtagagacgccactggtttgcagtgctgatcggcgtgggagtacggcgaggagaacgcacgaggaggagaaggtcgagccggtgcgatcgactacttcctctacatcgatgcgcgctacttcgcgatagttccttcgacttctcagcgtcttcttccgctgtgcagcgcgtcgagtggtaacgatctatgatctaatgcttgcatggttcctggtttacgcgatagaaaattttaatttatgctatcgtagcccacgcgtatcccaacaactacatgggtcatcatgctctgttgctccttggagaaacaatcccagaacatttgctccattggacagtcgaccatgtacaaggttttcagcgagctaagctcctcagcctgctgcaattccgagcagtcctgcgcaagtaagagttgcaacttagaaagattggatatcctcctcaagcttttattgttcttgaccttgagccagacgattccgggatggtagacgatttcctgcaggctgtgcacaccttctataagaacccttcgtaggttaacaattctgtgcagatcttcggggagagctctcagttttgggcaatttatcagctgcaggtacctgatgcatggcataagaaagactgatcgtgagatggtttccgatgtgccatcagacaagctttctgtgctaaccgaccaactctgccagttgtacatgtcaacgatctcaagcagctcaagctttggaaatataatggtatgtgttggagacactacccctttaccaaagagttcatggccaatgctcacaactgcatcagcccctttgacatgaagaacctgcaacattggtagctggcctgcaggcggaagctctggacaagatattcagtggttgaagtgcaaatgagccaggttcggcagtgtgtcctgcggctctgaagataaccattttggaaacgcgtcaccagggaacccatctataaagatgtactgcaattttcgtgatggacagagcttgttgtagatctcctcgatgttcttcacttcactgtcctcgtagctggttcgacaatcagcttcttcacccattgtacaggtaaggccgagctctttgaggtgacgcttgttgcacaacacgggtgaagctggcggtgaggctttctccagcttgatcagcaagaggcgccgtatcttggagagactatctagttcatccaatcggaacccgccagtaccatcttggaaaactgatcgaagattatccatgcatcggaaattaccgatccctttgggaacttggggtcagtgctgtgccacctatattgaggaagcttatcgtggacagcgtcatcagactcgccggcagcgatgccaatttttcgcaaccagacactgagaggtgttcaaggcaggtaaggtttccgatggatcccggaagttgcttgatttcttcattacagctgacatccagcagcctcaacagcaccaggtgcccaactgactctggtatgctctggaggcctgctccaactagaattaagatgcgaagatgctccagcttcctgtaaatgtccctcttgactgatctgcatgcgtcgtggtgatacactaggaggcaccgtaggtttttctggtcttgtataccaggtatttcctcaacggcgttgccaaccgctaaacgccgaacatttggaggggtttcgtcctcatccatgaacacggctacgtctcttgtcaagtattggccaagcaaccttagtagatcatgcatggtagaaattcccttgtctatgtactctggtcttgcctgcagtagatttctcatgattagctcgtggtagtaatcttcagctacctcctgtatcggtctgctgccctctttcttcacaaagccttcagcaatccagaagtaagtgacatctcggtgaatatggaaattttgaggcatcaaggcacaccagaggaaacagctcttaagctgtggggataagtcattgtaacttaaatacaaggggccttgtatttcttctggaagtccttcataacaccatctgctctccaggactctagcccattcttccttcgttgccttcgaggacaggacacctgcaacggccttgatggcaagaggaagcccatcacatttcttgacaatctgtgatccaatatcaccgaatacatttatttcgtcttcggttcggaatgatctgaagaagttccaggccatcatgttccttcagcttgtgcacttcgtgaacatgtatcgcgttcatctgtgacaaaacatcacggctccttgtggtaacaagtacatgggcatccgcacatctctctattggggaccgaagaagatcaatccagatatgtgaacttgtcatattatccaacacaaggaagatactttgtccagtgatacaatttagtagagcttgtagaagttgatccttactcttgccctgataagactgtcctcctgccttttcaatggcctccttcagcaagtcagtctctgagatgctctcagaaattgacagccatataaggacatggtgaaacctctcccttatccttcgatcattgtatatcttctgagctaaagttgtcttgccaattcctcccatccctaggatcccgtaaactgatatggtgctctgatggccacatccaatgatcatttgaaccatatcatcagtagtttccttgatttctcttccgacaacatcaagttcatcaaccaaagcagccacatacctactaacaccgtttctttggagagtttgaggactcctcattgccagtggaacaaacatcttgctgttcattgtgatttgcacaagcctttcatttacatatttgattcttctggcaatcctgtaatcaagtggaagttgtgccagcctagagaacaggacacgatcacaacatcgctgcttgtacgagtgagctctcaaaaaatctacaatgtcgtcaacatcatacataacatccttcacatcactccaccatgttcctgtcactctattttccaaggccaaagcatcggcatcttcacgaacagaatcaaagtacttcagagattcacggagcctcctgatatctcttctcacaaataatgtcttcacaaattcctcccgcagtatcccaaccagcttttctaaacatttggatgacaaacacactaaaattgtccccatcgtctatgcttgtggcctgatctacagaacaaatttagaggtcttataaattgcagataccaatgcaagtcctggaaacacatttagatcgaacgccagtacctgaaaatggagatggctggaggtgttgaagcactttgagtgagcttgcgttgacctgcagcatagagtgttcaggcaggggaggtaaagcgaccctggattgctggaacaaggaaattgttgaggcacatgttgcaacactttctgtatgtctctgtgtgtgtgtgtgtggcaactatgattcctgataaggcctgagaaccctgacaacctggtttgtcacccccttgccaatattatattttgaaacaagacaggctgcagggcacaatgacttaagttcaccaaaacttgttaaagtaaatggagcaagaagcatattagcagagtatgtccacatgcaatgctatcaacaaaaataaataattgtgatatgtgttttaaaactaagtattttttttctatgtccacactaacctaacacgttacttattgcaattgattagttgtcaacaccagtagtaaataatatattcctagttaataaagaaaggctaggagctattgttgatttggacaagtcaccaacatgcagatcatttttctattgttgattattgctagcaacagtacatcattgactttctttgcagatcattttgactgttgcactgttgccgtctggttcctttctctccagaactttggtaattagtacacatggtttctaccactggcaacaaaccatgcaaaaccttatcaaaatgatgttgttactctcgaatatgaatcgttgtgtaatgaacatgtagttaaaatagcttgttaaagctagcaatccaagtatacataatttgttaaagcagcttgcttgcaaagatttattctagcgaaggcattcttaatgtggcagttaactaatctacatttgctatcattgttgtaggtatttgatgtggcatgcttgccgatgtgacagtggcctgatttttcaaatgaggtgcagccaaggctttggtaaagcacaaagtttgtgaggcagactaccaacagaacgatcggtgatgccagaacactcactacatcctgctcattgatgttatcaactgtaatgtgcagttgagcttaccatgagggcctgcaactgaagaaacaaataagaacggtaattgcaatttgaaatttcagatagagactgagcacaatgaaattgaacaagtagtaatagtcgttctatttgaatcaagcaaagcaatgagtagctatagggccttgaacaatgaagcaatcatttcacgatcgattaccttgaagaaacaatttgtcaacctgaaaataaaacctgatatgtacatgacacttaggatgaggttttgaggagaaaaggaatgccgggccctaaagactctacaggatacaaggcttatcagcctgagtgaaggtgatgcaacaccgttttcctaacatatgtggactacttcaacagttgaggttgactctgatggattttgaaatggcgtgcaaaatattagggcaacaccctgaatggttcagtctgaacctacccaagttgcaggactagcaacatctagtgaccgagattgaaaagaagagccaatatataatagcttgctgaagtactatatcatttatttgatcaagtaggcatgaacaattgaacacctcgaagagtgggactgagataaataatgttgcttcatgatcttgtgaagactttcacattatacacacagaccactgagaaatttcagcactacgatatggtaaataaaacagcgaccagacaccagagtatctgtagtgctgggtttagccaatgaacaggaaggtggtattgttgtcacaaatacattgtagtgaggcttacagaaaggtagactcaaactactggtctactgcagacaagaggagcattcacatttatctgtaaaacgttgttttcatgaaagggaagggtagtcattttttaagattctgataataaagcaatacctgcaaaagggtgctcgtattggccacagaaggatcataggcctgctagcttcattttgatggatctgggctaaaagaaatagtatcaacccattgatcaaatcaacacatggagttcagtagagattattctaaaatcaaatgtaaatggtataattgctatacctcaagaacaatccattgatctgttcatttcgaaagcagcaaaccaggaaacaaagagcagaagcagagcaaaagcaaaagaagaaagcatgagtacaagcaaaggaattacatatacaggcaccttatgataaaatcacaactggaagatttaaacagaaagagaaaaaacaatcggtcaaaaaaaatctgcaccagcatatacatccaattcaggtcgagatggcaaactgattaagcataacgcgtgaaacacatgtagcaaaagaaacataagtaatccctcaattcatgatcctcataaattagagctcaaaaataaaaaggcaaatatttcatcattggataattatgagaagaataaagagggaatagagtatggatccaaaacatgacaaaaaaatttgctcggtgaagttatttttatatctacaatgatcaggtacctgcctgttaaacaaagtttgcaagacagtcaatgtatcaaatacacataagaagcttggttaaaaacttctcagggttcctcctaactacagtaaattagcaacatgaattagaagagagcatcaacataatctactgcacaaaaaaaaattgctaatatccggaatttagtgaagatgagcatttaaattgtttccagtgcatagttaatgtaaacaagttaagagataaataacataaatgttctgctatgttttgaaagtaatcacattttacctactactgtaaagaagttgactgatttattacctgggattgctccttcctcttttgattgtagtcacatattctgaagaagtctcctcctggtcagagttcaaggaagcatgagcccctaaattaaacatcggcagcacttaaattttctttgaatttgccatgttatgtctgcaactacgggaaagcttttcacattcggctttgtatttgcaatcgaattacctcgaggcgaagtgcctggcactgggtaacggcggggtgagatcagcgctcaactcgagaggagcgagcagagaggcgcgcatcatccgcggcgaatcagcccttcccctacttgatggttgatgcgcggtgtgggcggcggcggcggcgcctacaacaacaatgccaattaagcttccgccgcgggtctcgcgctcccgaatcccgatccgattcattccccccatttgtttcccagaacgagttgttgaggcaaatgctcgtgatgatcgatcgatcgctcgctcctcgccatccacgatcaatctggcgtctcaatttggggaggggattgatggagctccgccgcgtccagacgcataggggcactcgatccagtgtagaggggatcgacgccgatgagcagcagcagtggcagtgcatggctctgacggggctgcagga

SEQ ID NO: 44076 - DNA, 10877 bp, Oryza sativa
gggctgacaatggggcccacttgccagttgacggaatagaaaagcagctagaaagaaaagtggtgttttgttttgtgaaattaaatgcctctgaaccagtagtttaccattaaaactaaaaatattactatctccgttttttaatagatgacgccttgactttttcttacatgtttgacctttcgtcttattcaaaaattttatgcaaatgtataagatataaatcacacttaaagtaatatgagtgataaaacaacccataacaaaataaattataattacgtaaattttttgaataagacgaacggtcaacagccttatcggatggcctaataagccaaagaaaaagccaaatttaaaattttcaagcttaattttaagattgattttaacatattttcaacgtagttttttttcaacgttggcttttaagtcacaaataacacatttataaaagttttatccataaattcatttttattttctaataagccattttgccttattaggaaataagccaaacgatggggacccaaacatgtgagaaaaagttaacggcgtcatctattaaaaaatggagggagtacgtagtataacttaccaaaagtttatctcctggagtaacttttatgcataagagattacattgctggcatgaacatcacttgcacgttggaactaatctccaatacacataaaacagagtagctcattagcatacaattaattaactattaggtattttttaaaaaaaataaattaatatgattttttaaagcaactttcctataatttttttaaaaaaaatacaccgcttagccgtttgaacagtgtgcacgcgtaaaaagaaagaggtgagttgggaacctcaacttagccttaattatattgggagtacatatattggcatttaataaagtaggaatattctaatgtttttgttttttattggaatgtgtgcggtggatttaaaaataaacttattttgtgatagaggtagtaggccttttctttatgctggaatggatatatataataaacattacatgcacaatgtacgggatgtttaatccactggaaatcatggtggacaacatgtcttaactcaagacatcaagatgtcatgtactacccacttttcagaatagtttgataatgaatgtacaggtaacaaataaaatgtttttttctacagtttgtacgtgtttagcttataaatagccagaaatgaaaagcaagtttgaagaatatatactaacgtgagcctctcatgccgtgtgataagattcaagtagagtactacaaacaaacttatccatctcaagaaaaaaatatatcattcatgttatagctttggatggcatcatgttttcatgtgatgatcaattttccttatcaacacagttctgacaactacccagggcttgggaggcatatgggatctacatacaaccctgatccgaaatactcggggcacatagttatagctcggttacgatgacgcgattgaatgttatgagatgtttagaacaccgctggaataatctttctgtacagctccaagcattggcaccgattctacaatttatgatgcttccaacgtacttttctccagtgttttatttgatgtgccaaatttgagctgatgtaggattacaatgtccgcctttcaccaaataaggtagttttgcatcgtctctatagcctgttagggcatcggttaccgcaagggacatgatgcatagttgcggatgcagagaacactgcaaaggctgtgttcggtggtgggtgttagaaacccatcatccacgcacgaaaaaggagcggtccattagcacgtgattaattaagtattagctaattttttttcaaaaatagatcaatatgatttttttaaacaactttcgtatataaactttttgcaaaaacacaccgtttaaaagtttgaaaagcgtgcgtgcgaaaaatgagagggggagatgggggaaatttaactatttgccactcttgtgacctggcaattaataatttgccacatcctgtcaatgacatgtgggccctcatgtgtctatgatatgtgggcctagtggcaaatcgttaagcaacatccgtaagagtggcaaatagttaaaatccccagagttgggaactcccggtaccgaacacagccaaaatgtgcacaataacaaactacaatgttgctttgaatctgtgtgataaccttttctttaacactagcgaaacacctgtacgttgcaacaaggtataatgatattagatgatctaattaagactaaaccatcactcttggactctaattaactaagagtgaattaaaataaataaatagattattcggtaagtgtgttctacatgaaacaaattgagattccaacatagtactaccaccgcatggccactgccatattggtcaacaagaggtgactgatctatggtccccatttatctacgtccatcaccattgcctttttttttaagattgtatagatatagattagtagaacgtattggcatcagtcgacgctgagagttaaaacaacaaaatttgggcatgaatttgccatggttatccgtatggcaaaacctagttactttcatgaaaaacaatcatggcttagataatactggcaggatttcaaagtacaggctattttggtttgatgccaaaatgtgccctgttaaattgatggcattttgaatagtagtttggctagtgcttagtttgctaccaaaatatgccaataaaacacataagttgccaaaacatttggcactaccaaaatttacctatggtttagcattgataatattttagcatggtagcaaaccaaacaagctctacatgttgcaacatgcaaagtatggtgcaccaatgagacataaaatgcacatctcgcaataaagtacatggatttatgatatattctagtagaagcacttatacagcacttataaagtcaataacacatggcccatttattcaagcacagggacctcaggcattcctgctcactcgtgatccaaagttggtgtgaaactgtcctgggtgattgtattatttacagctgataagttgaagatgtaaagattgaatatttcagatataggacccggtgttaaatgtgtcacggtttattcatctttaagagaaatcaggggtatgtggaagaaccatatacatatgacttgtgaacatgtctatctctgtatgaggctgcacagatagagacagagataagttgccattcatgcatctttagcaagcacgccaggttgcttcatttgtcaaatttcaagcaagaagtttgctcaaagttttaggattgacaggcgtcagtaatagcggtaatcagcttagtttggtcggccactatattttctggacgaatctgggggaaaatcgattcatctgaactcatccccctataccctggttttgtatggggagaagacatcctaggatcatccgataatcacagaagactagtatagtagccaatttcaccatggctgagaaacattgctgcaaaggaaggttttcttggtccataaaaatttgatcaggactttgaaatgtaagacattcagaaccaaaatgggcaaaactttctacagtatctagacaatatatacttggcaatgaatgcataagcaaacaaaccagtattgggcgcaaggataccatagtattcgagcaatcggaagcaatcgggtaccttattcttaataaggtaggcaatttggctaagggaggttcgcccaataacctgagcgtttggatttgctacgatggtgttcccgaaacgagtttacattggtgacctgcactctgatggtatctctgtgcaattgcctgactatccatccagctttccttctagtacactgttgacaagagcaagttgatggagacatcgatcattttagtgccacaaaatatctgaaaagaacaaacactatcattttagtgccacaagtccacaatacatgaaaagaaccgacacaatcgttttagtgccataaaacatctcaaaagaaccaagaacaaagtaaggaaaacaagattggcatgctgatgaataccttctcaatatttggattaaaacaaactgtaattagagtgtggatatacgggtataggaagacttctctaaaatatgtataaaccagcaaagcaaggtaacaatgaattgttataggtcatggttccattgttgcttcacaaacatcctcctaaactctttcagctcacaagaaaatgtgctgcaattcaatttgcaaaatacattacatgaaactgtcccaccattcaacgcaatggcctttaatgtaggaagtagttatatggactggtttagatgcctgaatcagtacttttggtagctccaagaacatatgttgcaactcgcaatgcaattagcaaacacgtgatcagaatatctgatataccacaagtacctcaggaattccacattcctatgtcctttatgtacaatactgtgtggatttcatgtccaactgtaagcttgttctaatctgcactcaacatgcaatggatgtgcatgcgttgcaggaatttaaaaagggtttgtttacttctgtcatattgtattgtaacacagtgatctgttcatcatctacatggctgaaccaaaactatctcccttcacatgttattacgattttgttctagtttataagggaagaaaaggattttacacaaagaaacatggcataagaaaacagaggtacttgcatattacccaaaataactcattatacatgctcagcggaaaatgtttctgaagaatctgaattaagcagcctttctgcttcgtcattagcctcagcttgtatacgccattgctaaataagtattagaagcaactgttagtccttacgaaacattttctgttgaatgtaagctgatgaacataggatatacttgcctcttcaagactatcaatctccattagttgctgtatttgttctgatatcctttcctggaatcaggacactgattattagtaatcatacttcatccacatgatgcataaataggatagctaaataacttgaacttactgcactacttgctgcttcagcaacaataacatctgagtccatctcaacttcaatttcaatcatagaacacaactgcagtggcatatccaacatttcactatttagctataataaacgtgagttatacataccatatataaaatttgctctattacttttgcataactttccatcagctcaatctttgccaggagtgtactttccaagctttcaagtaccctcttcactctacctcgacgagcactggaaataagtttgatcaaaacttcattattttcaaaaagaaaaaaactctgtagtagaacaagttctaacaaacaaccatgttatataagtatatttgtgaatagataaagttaaactagaacaataaaataaactgttggaactgtatgaaattaccgatatgatggttcacctactgctaatatcttgttctctagttgagacattcttgccagcatccacacctttgaaaataaatttaggagtttaggagttcatgattttcaggactttacttttagcagaaaataaactaattagagattacagattttaacctccttttcggaaagttgtttcagatcctttagacgagtctgaagcatgtcgtactgagataaaagttgctgccgaacagcaattatatctactgtcttttgtggaagctgaaaataacatcgaatttaggtcagagagaatataatggacaacgtagcttctaaccaaaaactactaataagataataagatattgtctaaaatatgaatatttggatatataaaaaattgagtaaacatgtgaaaaaaatacttttataaaatgcacaatgataaaattttgtggtcaaagtgcatcttgttggctttgcaaatttgaaaatagcatgtccttttaactatggaagtataaggcactaggtttctctaaaaaagtactgataaaaaaatatttttgaaattatagtccctcttatccaatatataagacattttagatttctcaactcttaccaaaaatattttttaggaacctttgtctcttttcttcctgatttgccattgctatataaatgctagtactctcatcaatattttttgtagataatggatagaaatccagcctctatatccacaattggatatacacagccaagtctttccattgggagtatgattgaagagaaacaaagtaaattagatactctagctatgtaatggcatgccatagggtaagcttgatcgaacaaggaagcaaaacagagcaggctatagacagttgcttgcatgatctattgttggtacaagactccagcaccatacgttggtattacatgaccctattagcattccgactacctgcccatagttttcaagtttcctcctagtgaagaatgctaatccttgagtttacttacctttcgaatctctggcaggatcacttgatttagtgctgttccaacagcagctgatgcaaaagcagttgctgtaataaatctagggaggcttgggtcgatgaatgcagaagcagcatctccagaggcaagaagagcaagagcaccgaccaacaaatatggattaaagacgaatggtccctcgttctttgatggagctcttagcaatcttgagacttgtctgttgatgtgattggtgagagacatgggttctcctggtctaaacccttgtgagcgtgcagaaatcttaaggggacccatttcacgataaacatttgatggggcagccaaggaaatggtcactctttctccttcttgagcaggcagttctacagtctgcgtagcaaatctatgggtacgggctgttcctgaaggtgtgcgaatctgcaaaataaataacttacaatttacatgaatatggctcatgttctgaacaacattgtcaacagattataagaactgtgtgatatcacaaaaaatagattcagctgaatttcgtcgtggaatgttttgttggagcactctagaggaaaatttggatagccaatccctggcccaactatcttaaggggggagtgagaaatgacagagaaatgttggtgatcaaatttagcattaatggattgaacgatatttggaaagaaacacatgaagaattctcgatgactgtttggtcctaagtcaacagttgccaaatattcaaactaaaatgtgaatgtgttgacctcagttagcaagtgttcgacttgttcccagaattttggcaaaatactatacatgctgctaatgtggggccaaggttcaaaccaaacatgtgataacgcttggtcatttttggagttttccacagattttgtgaaaatatatcatgtttactttcaaaaaacttctatgaaaaaacacttctgcctcacatggtgcatggggaagcatcttcttggttgccaagacctgaagcatcatactcttaaactctgggaaatttggaaaaagtacaacaaaagatttttttaaggaaggcagctgtaatcacatatggatacactgcttggcgtgatggcatctggtagtgcaagaataacctctaagatgataaacatgtccatgtgtgtaattcccttctaccattgatgaacaagcagttatcctacttgtcataaagaggaacatttttttacctcaattgttgaacagaaaacagggagagttttacctttcagttctattatatggagtacatctagtttaatgtgaggcatcttcatatcttgatatccatcaagagcaacgatgatttattcaaaaatttgaaaagtaaagatctttgaaataaatgatggcacagttaagatctattgtgcggtttttgaaagggaaactaccacaatagagtgcacagcagctggaagaccgtcttttatcacatttataaatcgcaatgccttgtccaaagctgaaatgtccatgctgcgttcggcaggaggagatccttagagaagtaatattagaagcagtgtcatatatggaaccattgagaaagtaatagaggtgtgcaaaaatatcttctgatataacagatgaaaacaatatcaatcaagttacttcagataaactacaaaatagtacaaagttgcataatcattggaatgtaataaaccatttctgtgagagagttatacagaaggacaatgtgtacctatcaaacactaaaataaattatgtataaatctttttgacatcacagaaacccaataatctgcagagtaatacctaagcactcaggataagcagttcatagacctatataatagccaatcgtaccactggatctaaaggaaacattagaaagtataagtcgaacgatgagatcacagacatggctaattagtcaaagctaactgatatatcaattattttaattgttctaatgtttactttttagatgtcactccctccatcccattttaagtgcagttatggatttccatgtccaacgtttgattgtttgtcttatctgaaattttttttatgattagtatttttgttgttattagatgataaaatatgaatagtactttatgcgtgacttatttttattttttttataagacgggctgtcaaatgttggacacggaaactcacaactgcacttaaaatggaacggagggagtatcttctaagttctaacaaaataagttagtactggagtccctccacagttaatggcaggacacctgttttagaagaacattgctccaaaagttactagaaacaacaccataatccatagctacaaatataaccgaaaaaagaataagatcatggcatagcattgacagtttacaactccaagcaactgctccaagaactaacctaacttcttcagactcgatgctcatgatatctccagaaaatagttcgtactgatatcggcattttgaacaagaaacagtctgtaaagtaataaaataatgctaagatttccattacagcattaaaaataatctatattttcctaagatgtcatctctaaaaatttgctcaaactgtaaaattttgtttcataaatcgcatcatgcgagctaagtgagtagcttaaacaattagattagaggtacaagatacttgtacagcatcaaacctgagttccatgctggggctgtgcaactgcgactgctaccatgcagcttggacagcgaataatcatcccaaatgggacctgtaacaagtaaaatctatcatttagaagtgtagtgacattcattcactgtgttttcctttagaagtgtctcaagttttctctacatcaaatatacttccattcaacaagacactcttatgtaaatttttaaaattaaagtatgatgcaccagaattatcaatactttgagacaggatcagaaccataaggattgttgccaggcttgtggatattaatgggactagattattcaaagttatatgttacatcaaaccaaaagggagtttcgttggaggggcactgatattgctatggcaagactatccttgttgggaccttttgcactaattgttttgataataaataggatttccgtagatgaactgattgtacttacctatctccagaaatctacgtttagtactattcctctgcaaattcggttctagttagaattaagcttgaattgccttggacaaatgaaaccagtaattggacaaatgatgaggtaccggtaggtgacaaatcatgtttgcagatcaaggttttaaagcaagaataaaaagcttccatcatttgtcaaatgccactaaaacatccaaacatcatgcatgcaaaccaaacagcaaagcaccatacacatcgtcagacatgctagtctgcgacgccaaagctcacctcctctgccgaagaaatgcctgcgcgagatacataatcgattatcctaagagcatcagaaacacgcagagcagctgccaatcgctggacaagcaatgcgtacgtccgcacgtctggcctcgcccacctccaggccccagctgcaagccggcactccacaccacagggactcagtacgctcaatccaaaacataattcactacatttcgtgataaaagaaaaaacgtaaggagtgatacgatgccctcacctcgtgcaaagccggatcgcatcgcctcgaacaccgagagcgctagctccacgttgccccggtcaagcgccgccgcgacgatcgcgttacagtcggacgcgtccagaccgcccgtgcctcccgccgactccgcgacgatgtccagcgcctcgccggcgtccgcggcgccggcgacacgcctgagcaagtcggcgtcgagggaggtggcccccgacgcttctggctcgcttgcgccgcccgcggagctggccctccgcaaggagcaagagccggaggacggaggggaggagcagagggggaagaaggaggaaccgatgctggtggccgaggcggcgcgcccgagcggcggggagctgatggggcgcggcagacggtgggcactcgctgatgagggggagaggagggcgagcgccatggccgacgcgcgtcgtctcacgggcaaaccgtcgaacacatgtcgggcacctggtgtggattaggcgcgggtggcggggagcgtgggaggcggacgtttagccgacctggcggccacctgtggactgtggtctgccgtctgcgtctgagagcaagtgagcaactttaggctgtgtttagttcagcgcctagtttggattttggttgaaattagaaatgatgtgactgaaaagttgtgtgtatatgacaggttgatgtgatggaaaaggac

SEQ ID NO: 44077 - DNA, 44090 bp, Oryza sativa
  unsure (1)..(44090): unsure at all n locations
ccaaactagacgctgaactaaacacagccttaactaattgctatacttaggagaggagcaggatcggacgtccagtcccagtccaaacaccgggcagtcagggccggtcctgacttttcagggccccgatgcgaaactaaatatagaggcccttatcatactatgtaatagtaattagtatatacatataatttatatataaattattgcgtaaatattaaaattgtattaaaaaattatatagaaaacattatagtacatgttacctcaacaaatttgtgccttcgtcggtttgtccaattatcggaacaactaaattaacctaacataggaccatacatcaatacacagcaaaaaccaacacacgagattacatgttaacaaataaaatcacaatgttacaaaaatttcaatttttcatttggcgatggcaaattagcaatgatgtattggtgttacactcaccttaatagaatgcttgttgcttgatcactgatcagacaaatacagtattcagattcagtgacccccgtcggcggtcggcccatccttctcgagtagtcctcgtcaagacatccagtactctaggggctagggcagtcggtggcaagcatcaagccatcaagcaagcaagcagcggctgccgccgtgcccgtgcagcgcctggccggtagcacctacacctgatgcaaagcctgactcctgagcacctcgtgtcctcgtcgatcgttggcagtcggctggtcctcgagtcctcgtgcggattgcggaacaagcggtgcgcggtgggcgtgaggagaagagaggagacgacgtgggcgacaggcggcgccaatctcgcgagtcgcgtattcggcgtctgttcgccttcgccctaacaccgcatcgtctgttgggccaggcctgattcctcggacgcgtcgtgccgcgccagaggggggaggggggttgggtttgttggtgcggggcccctgcgatttgggggcccagagcgaccgcaccgctcgcccccctccagggccggccctgcgggcagtgtttcaccacatgaaaaaaatgtttaagatgtttcaccaatcagtaaacaatgtttcaaagaaaatatttcagatgttccattactcaatgaaaaatgtttcatcactttacaaaatttgtttcaccaaagatgcaatatgaaaaacaacttattgcaacactgaaatgctgttgtgtgcgacaacaaagaaaatacagcatgcattgtgtgcaacatccgactaaaaaagagtgaaacacttcattataataatttgaaacaaagatagataatagactgcaacaaagcatgtgctagtagctgaactcgccttgaagtagccgttctgatgagcgttgagcgcggcggcgccggtgccagtgtcgatgctgatgccgatgctgttgttcacgggcaagaggccgaatcacttcgcacaggacagctcgaagcgtggagagggacgccgacctggatgcgttcatgcgcgcgcgccgcctcgtgttgtcgtcgtggggaggccgtcgccggcgacctccgcacgtaccttcaattcgggagatcgaggcggtcgccggcccgtggttcaacggggctgtgagcagggccactccgggtgggaggcgtcggggcaagcgcggacggaggagaggagcgtgtagaggggaggaagagcgggagcagggcttggaggaggcggaggaggaagggcggcgacgggcaggccgggtccgggcggagggaggcgatgagcgccgcgatatccgtctgatatttcgcgtgggagagggcggaggagcgagagagaaggtagttggagttttggataaggatgaagccgtccgatatttcgcgtgcgctcggacgtaggatgggaagcattttcactatacttacatagttacattattggtattattgattattgagtaaattgtgtaacaataatttggcaaccatcaatttgttacagcgacaaatatctaggaaaaataaaaattaagtagaagtaatgagtaccacaacctgattagaatgtgtttttaggggaaaagaagttttctatatgcatgctctaactgagcaagaacaggagatgcaccgtgtgagagtgagttgttgtatcgcgtaagtagtaatgcgtaccacaacaatgcaacacatataaattaagaaactttacacatatctaataagagcagccgcaatgtatatgcatgaactcggtagtagtgtggggctaattagcaagcagtagtagttctggatagacaccacaatgtttctatgtggccctaggaactagggtggggtccacttaagaaaaggcattgattcccagcttcccgtgattggatagccctataatattgtaacaaattattccttgtttactgatattaagcatatgacccaattgttgttatttactaccgattattgctatttactacttctacaatgtttcttactaggtagtaagaccccattgaatgtcctaaggaacaaagttgtctaacaacacgattagacgttgcaagtaattgtatagcttcatgcaatgcatacctctccaactacgccaccgatgtggctgaaaatttttcacaatgcctcatttaattaaaaaaagtctcatttaactaagttgctaaccatatctatatatcaaaatctttttacacgatgtaatttactttagattttttaggttattattatatgatagatggcgttcggcacttgagttatataatagcgagacccattgagttatcacgggaaaattactatatcattaaagcgctattaaattgttttagtttgtattacatgacttggctctataataatattatacatgtattataagtctataattttttaattcgactccacttcaaattattattcagcctctaccttaatataagagaaacataaagttatgccttcgaatgtaaattgcgaatgtaggtatggattttttacataaagttttccaatattgtggccatgtgctaagagtttgcaaggtatttaaaaaaatgctaaaatcaaaagtttagtacaaaagtagtttattcttggatatataatattgatatttatactatacgagatcaatggatcatttatatgtacccatgtagaacgaccgtaaacttttactaaagatcatgtaaaaaacatgtgtatgcctacatatatcaaggcagaaaaactttaagggagtgggggaaggcgggggcgcacatcctgccatagtgacactgtcattacatgtagtagtgacgtgtaggcttgtaaaagggtaggacccctaaaattgatggttgtaatggcagcactattatggcggaggatccttagtcggtaggtgacatagagatacaatgccttagaaaaaataaactctttaaacgagaaatgtgtgtgtcttttccataaaaaaaatcttgatgatccttctttgattttttattggtgtaaaacttttagctatatgaaatttacgtaatgcatgcatatggagaggatgaagtccaaactaaaaatggaaaaatatatcctcaaaatataaaaaaaatgttcctcatctatatagcataagttagcatgcactcctagatagagagcgtatttataaaaaaaaatacaaacatgaaatctagactttttcgcacatcttcagatgcgaaagaagccctctgaccctctctctctctcccccccccaaatacctatgtctctttcttgcactaattaatgtgtctggcctactctttccaatgcctccttccttaccgctaacacgcagctttccatctatctcttcgggtgcttcttcttccgacttcttccctcttttcactccaagtacctgagccaaatccatgctctgagaaaacaagcggttctcgaatgctttgagagttggaaaggaaataaggcggcgggtaaggtataattcaaaattttgttggtgggtggtactacgcgggtgactgatgtccattgctaccaatctacgctaaaaccaacaaataaatttaaacatcggctaaaaaagcttcaatcctatttgtaacaaattagatgtggcaaggcattgcaagtgcaccataatatgtgcaaactgcaaccaaatagactaattttaaatggtaagtttaacttagtttatttattaaaatttgttgaaaataatcaaacaataaatgatgatttattacaaattctgttttaaagataattgacttgtacaaaataaggtcacaaaatagtactagcatataggcactagtggctctggttcaataacaaattggacttccatctcctacattcctttatattagtcatgtatagaagtccatatacatgtaatattgctcaccacacttacctcacagtaattgacgtgtttgatgataagcttttaaactgctctaaacttacctgcacaactgatgtggtataattaacttgacacacccggtaaaataactcccaccatagaatatacttcccttgggttagctcaattatatgagatctcgtcaaattcaaactcaattatacattttgtgtgtgcacaatgctagtcaatcgaatggtaaaatatagaaggccattctttgcacaatatcaaaatatcaataaagaagtttaacaagaaaaaaatatcggaatatgcaaataatatcatgcaaacatgatatattattttttattgtatttttagaactcaatataaaagtatgtaaaaactattatatatatctactaattttataatacataacatatatttatacatatatccgcagtaaaataaggagtatcatcattgttgcctttgatgagtccgcagtatcacccgttgaggtgttgatccaacatttgggctgcgttcgggaggagctcctccctggcacgcaaaacgaagcacgcattattgcatgattaattaagtattagctattttttttttaaattagattaatttgattttgatatagaaggccattctttgcacaatatcaaaatatcaataaagaagtttaacaagaaaaaaatatcgaaatatgcaagtaatatcatgcaaacatgacatatcatttacaattttgttgtatttttagaactcaatataaaagtattatatatatctactatttttataatacataacatatatttatacatatatccacagtaaaataaggagtatcgtcattgttgcctttgatgagtccgcagtatcacctccaacatttaggctgcgttcgggaggagctcctccccggtacgtaaaacggagcatgcattattgtatgattaattaagtattagctatttttttttgaaattggattaatttgatttttttaagcaactttcgtatataattttttttaaaaaaattcaccgtttagcagtttgaaaagcgtgcgtgcgaaaaacgaggtaagaacacagccttagagcacccgcaatggtaaagtaaggtgctatctataaaacatgtacatctcagcaatagactacattaatagtaaaccatctcaatagtatgtctacatgggtatctatagctctctaatacattgcctcgtttttctctatagactatctctaggttagtagatagctttgctctctctcttcatttaatctcttccaagtagaaaaatatgctgacatggatctcttctagagagtctatagataaccattgtgggtgcccttagagcacccgcaatggtaaagtaaggtgctctctataaaacatgtacatctcagcaatagactagattaatagtaaaccacctcaatagtatgtctacatgggtatctatagctctctaatgcattgcctcgtttttctctatagactatctctaggttagtagatagctttgctctctctcttttcatttaatctcttccaagtgaaaaatatactgacatggatctcttatagagaacctatagataaccattatgggtgtccttagccttttactaccagtctactggacgaagacggcacgcggctttccccgtctgaccagaccaccgccgtccccctcacccgcaggccccagcagctcgcgacttcgcgagggggaaagcggcagcgcggcgcggaaccgagtagcccccatatctccttctcccgccgcctcgtgatcctcctcctccccctcctccaccttccagaaccttctcgaccctcccgcccccgaagaaccccaaggcggcgaccccacgtcgctctccccctccctctcccctctcaacctcctgcggtagcctcgccgccccgttccactggtgggctccgggaggaggagcagcgggaaccctagggggcggccgcccccagccgcccggctgctccgcatgtccccgggggtctagaattctcggggaaccctaattagagcgcgaccttggggggcgttggagagtgagagagagggggagataccttccgccaaaccctagggggacttgggtggggggcgatggcgggggagctagggcagcagacggtggagctaggcgcggtggtgcggcgggcggcggaggattcgtacctggcgctgcgggagctcgtggagaagtcgcgggtggaggccgaggggaagaacgggcagcagaggtcggacaccgagaagaagatcgacctgctcaagttcatcgaccgcacccgccagcgcatgctccggctccatgtcctcgccaagtggtgccagcaggtttgcaactgtccattgatccccttttatagcttcctttttctgtccgatttcgcgaaaaagctatcatttaattagagactgagaggtgtggctataggataggtccgccaaagtttagatttgcggcgtctaaaccggctgctaatttagttcaaaccaattgtatgtattaattgtaacggaccttatttgttcaataagaactttaatttaactgtagtactgtgtcctgaagcattgttttaaagatttagcccntnngnnnnantnnttggttccacgcnatactgaggtgttgtctaccttatcggagctaaaagtgaaggcggcaccttttagagtgttgttgtatccgggaagaaaatcctactgtagtaggaaataattgtccataacttattccggactattaaaaatttaagaatccttgtgtgccttttattgtttaatagccttcttcgtgttcctagtctattccattaaaagttggctaggaagtatttaactctcaagagagtttagtaaccagcagaggcttttacaaattacagttttaccttttgagttgttatgttctgtgcattcaagtaactagttgtgtgtgcacactttgctgcaggtcctgattaatattaatttcccgtgttctgtgaaatgcttagaatcatgttgttttacagtgtgcgagctttaagcttaaactcaaaatcagaacaaactgacaaaaaaaagtattccggagattggacactgcagttaatctggtgcagtgattttactaactcttatgacacttgcacattgcacctgatatcctcaatcagtaggaaaaaaattgttcaccctagatgcttcagctcccacacataacagctgtctttgcaataggatagactggtgtgtgtgcgcgtgcgtccagagtgcattacaggggctcacgcaccaacgttcataggtattcagctacccatatattttgtgcgtcttttatgtagtgaagaaggtgatttttgctgtattggttaggccatgcatatgctttaatcattaggttgtgggttcgattcccaagctttatctttgtattctctctctctctctctttctcacctggtagggtttgagaaacttgtcatattttgtaagacttgcatcagtactttccaaaaaaggccattcttgaactaaagaaagagtaaattgcactttgtgccaggtaaaatgtactttatttcgcgttacaccagatttagcgtatattttctctttacaccagggtgtattgaaataaatttcacacactgggacacatcatcgaacccctagaaatttcataagatctgaatgaaactttgtgaagcatatgtcctaaactcaagaagccccgtaagttttcttcattcacattttacaggattttcctccgattataccatgcaacccagttcacgctgaaacttatttcaaaataccatagtagtgagatatactaaacctggtgcaaagtgaaacacggtacattctatacggtgcaaaatgcaatttactcttaaaaaacttgcatcttttgtactagcgacattaatttttttctttaaataccactatgtatgcatgtcttgaacatccatcgcaaaaatcctgcgtctgccacttctgcattacatagcgtgtaataatttcagccaagtatcataagaataggtattatctgttaaacaagtaatacaatagaaaactatagcttcatgcgcatgccatccgaatgtcatatttcctgaatttcatgattgcgatcattgctgtttcttgcaggttcctttggttcattattgccagcaacttgcatcaaccctctctagccatgagacatgcttcacccaaacagccgattcgctgttctttatgcatgaagggttgcaacaggcccgcgctcccatttttgatgttccatctgctatagaagtcctacacacagggagttataggagagtgccaaaatgtgttgaggaaattggtactcagaacacactttttcaagatgaacaaaagcctactttgaagaaattaagcacccttgtacgggctaagttacttgaaatctcacttcctaaggaaatatctgaggtttcggtgactgatggaatagccaatgttcaggtagatggagaatttaaagttcttattacattaggttaccgtgggcatttctcactatggaggatattgcacatggagttacttgttggtgagaaggctgggccaattaagcttgaagagacaaggagatatgctcttggtgatgatattgaacggagaatggctgtggctgacaatcctttcatgattttgtatacaatactccatgaactatgtatttcacttgttatggatactgtaattagacagacaaatgttctacgacagggcaggtggaaagatgcgataaaatctgaacttatctcagatatcggcacaggacaaggtggaagtaatgctgtaatgcagcttggtcaagatggggagcttgattcaagtgggtctaggatacctggtctgaaaattaattactggctagaggaaaaaaacaatgcttcagctgaatcagattcatctccatatattaaaattgaggcagggcaagatatgcagataaagtgtcagcacagctctttcgtattggatccatttacagataaagaagctgatctttctattgatctgagttgcattgatgttgaagctctaattttgaaagcaattgcttgcaataggcacacacgtcttctggaaattcaaagggaattgatgaaaaatgttcagatgtcacaatcatccactgaggttatcctgaagcgagaagttcatggagagggctttcagaaggtaccttgtgggctgttctaattaagggtattactgcagccaccttgtgtttttgatatttgatgcactgactatattcataaattgtgtagagagtacatagaagagactccaatgattgttgtacaaatgaaatgcttcaagttagggcatatggacaatcatatattgaccttggaataaatatcaggtttgttaattgtttatttatttcttctccatgtttatactttatatcttaatttttcttgaccttacatccgcatgatgttatataattttgttttatttcgtgtactctgttaatgtagcttaaccgtgactttattgtttctctagcaatacattagtaaaagttccaaacattctacattatgaaagtattgtaatcttggtaagtgtgttgacacagtctccatatggtaaatcaagatacctgtattgtcataaatatattaacggccatagtttaaaataattgacaacaacataagataaataccatggcatcatgaggttctatttgcacatcttgatacatcgtgaactcttacagattagagcgggtacaataattggcgacaatagttccatgtagaaattttggatgacatggaagagagagggaaagagagaggaaaccagcgggcgactaatttgtcgcccggctccacgcgttgccgatgtcgtgggccccgtagatggaggagcaacccaacgcctcctgtatccgccatggctgctcctctcgcctgcgttcgctgggccaacgccctcgccaccccgaccgtcgccgttgccttgtgtccaccaaatcgctgctcgccgtccatcgtggctgacgctgtctctcgcgtctgtcgtattgtggtcctcgaccaccctagccttcatcgtctcctgcgtctaccggaccatggccgtcatcctccctgacctccgcttgtgtgccgctcatacatcccagcctctgacggtgtccatcgcggccggcgccccaacaagcgaggtccaatctttcctccgccaccatccacccctgcagccagctagccactgcccttgcgctctgttggtcgctgacttcaccgattaatcaagaagaaaagtgaaaggggaagaagaccagaaggaatgggaggaagatatctgtagaagaccttgttcctggagccattgaaaaggaaagagaaagaacactggaaggaaaggaagtgggaggaagaaagagagaacatggtgggccccacaaaaataataaagttatgttgcagtaaatataacatttctctattgtatatattagctatagtgttaactatatatgacatgtctaataattggagccagtagttggctgtgttaaaaaaccgtgcttaaccttaaatccttaatcttctctccttgccatggatgtggctaattgacggcaggaggcagccgacaagtgtggctgtgtgggaggttgatgctggtacaggagacgaccagcaggcaggaggagtgctgaaggttgagcacggttgtcagtgctggcgaggaggccaccgatgagtgcagaaggtgacggcgagtaagaggcagtgagtgagtgtgggaggttgacgctgggagtgggcggtggctggcttctgtctccattgctgttagccatcgacgcgtagaaaaatcagttggtcatcggaaaatgctactagtcgactgggcttcacagcaatgcttgctccgccactgtggctggcatgaataggaggtcgacaccattgggtgggagatgggtataaccgtataagaaggggaagggagcaaaggtgtttgatggcaagatgcatcagtcgggcttaaatggcagtacaaggggaatggaagaggagaaagaaacagggaaaaatgtggcgtagtattatagatgggaagttttggtccaatctgtggtgtgaattggtccctcagaattttgtggaattctttgaaattggcaaatcattgttctatggatgaaacgatcttcttttctcttcccttaatttcctacctcgtatcttctctccctttgccaaaccataggctccccttgcaagaagctgaatttcattgctggcaacctcctcttccttcctcagttcctctctcctctcctcctgtcccctttcccttctctctcgccctcatccttataaagccctagtacctcttcttgatatgctgtatatgtgggtgctcttattgtctccagccactggtcatctcctccctcaagatctccttcgtttatcaagccacaatctgcccatgagggctgtggaaggatacaacggcaaacttttgacagtgatagaaatggaggaccatcaacagtggttagggtgcatctcatctcgatttgcctttcttccaaacctccatccccatcaagcacacacacatgagatggagccttctggtgattgctgcctgccaattaggtgtgtaggtaacgccattacagttatggttaaataccttaacaatgtgtcatggtaagtggtaacgatgtcaatgtggatatcagtatgacttttaaggagcatatatgacttgatttgtagtgaaaggtctattttcctgctgtcctgcaaggtgcagtgatgacttctttttattccaatttctaccgatattaggagggagtcatatgcggttaagagttcccttcaataggtgtagcatgcatcaatgtgttcattttttcacaaaaatagagagcacattaatctgtaggcataagccattttgggcacgatattatgaaggtgggaataataagatattttgtgaactgtatctaatccctatatttattccatggtcagtttcctttccaaatcatgtagcttttttgtttctacataggaatggtcgctttctcctccagtcactggggaatatattgccaccttcagcagtgttagactcagaggaagctctgaacaaggggagtacaacagcaactgatgtttttgtgagtttaaggaccagaagcatcctccacttatttgctgccactggaagttctttgggcctaaaggttgtctcattaacttgccttgttattccttccccttgtattttcacttttcagctcttagagtttatttctacgttcttctttaatactgaaaatttagagcatgggcgattcagataatcttgcacacgattaaatttaaacactttctaaatacaaacaatcatttctgttatgaataaattattgaacagagttcctatgagatatatgctgtcatacttagtcttgcattaatcattttctcaagcccagcaatttgttgatttggctaaactattttcttaaaatactttctggattgaatctagtcttcatatccacatctgaatcagtctatccaaattcattgaaattttacatttggtagtaaaatgtaccaaaaatcttggcccaattactaggtcaaagtctactactcccctcaactctttcggaaattcagttttcacccctcaactctgaatctggataaaaatcgatccctcaaatttcaataccaatagattattatttatacccccgagtccaatacgcaagatgattttgttccatgtcaacatagtggataagccactcaccaagtcaccatccttgtcacggctatgcgtttaggtatttggggcagaagagtgggtgttagaacttcaatggttactctcattgagaagaggatggcactcagagtggggcaattttctggttttcttcattcacaaactcaaaagccatacctacccgagggaggttggatacatatatatagccatagctggctgctagcctattgctgcaccctcctagtctaaaattcgaaatttaaatgggatgctgtcctagagggcatccaaacttaataaagcataaaggaggcataaaggagatgctaactgctgctgtcctactaaccgcagctgtcctagcaactgaaaaatatgctaaaggggtagatgctgtcctgaaaaggtgaaactacccaaaagcaaaaagaagaatcacgaccaaggaccacaaagacttatccaacattctccccctaagtcttgtgcgtcgtcttgtggggaagttgggccatcccgatcctggagcagagctcgaggaacttgatcctcccaagaggcttggtgagcaagtccgcaagctggtccttggtgttgatgtagctcgccttgatgctcccttcctccaagtagcttcggatgaagtggtacctcacccggatgtgcttgctccgttcgtgaaaaacggggttctttgccagggccagagcgaacttgctatccaccctgagctccaccgctccagtgtctctgccgaggagatcactaagcagtcgagcaagccagagcgcctgggtcgaagcggcggaggccgccatgtactcggcctcgcagctggacagggccaccacttgctgcttgaccgactgccagctaacgaggcactcgccgaggaagaagagaatcccgctcgtgctcttgctggtgtcgatgtcgtcggcgtggtcgctgtcgctgtacccgacgaagtgtgccttgccaggacacctcgggtagtagagaccgtggtcgagagtccccgcaacgtagcggatgatcctcttcacagcccgctggtgctccgtcgtcggtcgctgcatgaaccgactgacgtagttgacggagaaggccaagtccggccgtgtgtgggtgaggtagcgaaggctccccacaagacgccggtactgtgtagcatccacttcctccgtcgtgctatcgcggctcagcttcagtctcctccatcggagtgagagctaggttgcaatcggtgagcccagccagctcaacgacgcgcttggcgtaggtggtccgtcgaagcgtgatcccggagtcgtcctggtgcacctcgatccctaggtagaaggagagaggccctagatcactcatctggaaggtggccttcatctcctcgaacgccgcgacctccgcatccttggtgccggtgatcaccaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccatagagggccttgtgcaggcgtagcaccttgccctccttgccggggatcacaaatcccggcggctggtgcacgtagacctccttcaagtcgccgttcagaaacgccgacttgacgtccatgtgatggacgccccagccttcctgaggagccagcgcaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgtggtgaccacgagggagatcaacaagctcccaggtgcggttctcctgaaccgcgtccatctccgactgcatcgcggcacgccatgccgcgtgtttctcggcctctgcgaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcgtggtacgcgtcgatgcgctccccgtcgtgggagagcggagtagcgaactccaccgggctgcgctcaacacgagctggcgtcggagtagacgtgctcggaggagtggttgttggtgctggggcgcgtggggttgccgactatggtggtgtcggcgaagagctcgtcgcagtcgaagccgtggcccgagggtatgttggtgtcggagtcggtggaggctcggggactggggtagatacgcttggtgaagaagagctgcctacttccccagctccctcgaagtggacgtactcgacggtgaagtcgtcgtacgtcggagtcgaaccatcgtccaccgccttgtcccatacccaccctcgcccttcgtcgaacactacgtcgcgcgcacacgctgtctccgggttgaggatgtgataggccttcgagccctccgcgtagccgatgaacacccctggggtgctcctgtcgtcgagcttgccgatggggccaagctccttgacgaacacgaggcagccgaagacccgcaggtgggagacccccggcttgcgcccatgccaagcctcgtacggtgtcctgccatcgagggccttggtaggcgagcggttgaggatgtagacggccgtcaccaccgcctctccccagaagatggctggcatccccctctgcttgaggagagccctagccatccccacaaccgtctggttgcgccgctcgacgacgccgttctgttgcgggctgtacggcgtggtgtagtggcgctgaatgccctcatcagcgcagtacgacgcgaattcagccgccgtgaattcgccgccgttgtcggtgcgcagcacgcgcagcttgcggccgcagtccgcctctgcagcagcctgcgcgcgccggatggcgtccgcagcctctcccttgctgccgaggaccatcacccacatgtagcgggaaaggtcatcgacgagcagcaggaagtaacgtcgtcctcctggtgtggccggtgtcactgggccacacaagtccccgtgcacgagctcgagccgctccttggctcggaaactcgtctgctggggaaaggggagccgcctctgcttcgttaggatgcagacgtcgcagagctgctccacgtggtcaaggcatggcaggcctcgcaccatctccttggcactgagccgcttcagggcctcaaagtggaggtgcccgaaacgctcgtgccactgccacgcttcgtcgtcccgacgagcggtgaggcaaactggttgtgcgacctgcgcgttgaggatgtagagtcgattagtgcctctggttactttggcaagaaggcgacggcggcgatcccaaatcctcatgactccgtgctcgaccaacacgcgtgagccgttctcatccagctgtcccacgctgatgatagagtttctcaacgcggggatgtagtagactccggtgagcagcctgtgctcaccggacttggcggtgaaggtgacggagccgacgcccttgatctccacgctgcaggcatccccaaacttgacggagcctcggacgctggagtcaagctcggtgaacaactcccgttggccagtcatgtgatgggtggcgccggtgtcgaggtaccacccatcagccttgtcgttgctggagctgttgccgaggaggcgtgtaccttcggctcctcgaggtggaggaaagccgttgcggccggtgccgctgaagatagctcgatgctggcgtgtgccaggagcaaagccggctcttcctccacctgtgcgacgtgggcctggccgcgtcgtggctgtcgacagtctttggcccaatggccaagcttgccacagttgcggcaggcgtagtctcgtgccggcttgtggttgccagcggcgccgccctgggcgcctctgcgagcgccaccctcggcgcgtcttcacgcccaccgcagctggacgcctccgcgcgccttgcgcggcttgcggccgcctatcaagggagaggactcccccttcctcccgtcaccctggctggcctctcactgctcccgagtgagatggagcttcccgccaatggtgataggccccgagagaggctgtggctcatcgccgtcgacgaccttgaggcgacctaacgcctcctcgatcgacatcgtggagaggtccagcagagactcgagcgatctgcctgtacttctctgggacgcagcgaaagagcttctcctcgtcgtaggtgtcgtcgccgtactgcaccatcttctgcaaaagagtgttgagacggagggcaaagtcatcaacatcctcacctggcttgaaggccaggttctcccactccttgcggagtgcctgtagtgtggacttgcgggcgcggtcgctgccgatgcgtgccgcagcgatggcgtcccaggcctccttttcagtccgcttctgggaaagcgagaactgcatctcgggcgggactgcagcgatgagggcatccagtgctcgccgatccttgtcgtagtcgacgtcgccgtaccggactgcctcccacatgtgccgcacctggagcctcaccctcatcaccgcggcccactcgatgtagttggttttggtgagggtaggccacccaccgccaggaccaaagtccctgaccaccgtctggacgccgtggtggccatggcgccggtcaggggagggagagccgcgctgcctgcgagggttcccgtcggcgggcgcgcggtcccttgggccgccgccgccgccttggaggtgggctgctgcccaccgctctgcccgctcccgtgccctacctcttgccagctcctcaagctccctgtcggcggtgatgtcgccggcgatggagccgttgatgctactgcgcaaggtctcaacctctacctccgccgcacatgccgcatcttccgccgcctctgcttccgcctccgccctggctgctgccaactctgctgccgccagtctagccgccctcgctgctgctgcagcggtctgagccgttgctcgcctgcgctcttctgcgctcttctgctgcggcgagctcggcgtcctgctgacgtcgagtgctcgaggcgattgaacgccgagaccgaacgtcggacatggcgcacctccggggggctgctgcgtggagagggggaagggaaaggggaaggaggagcagtcggtgctgctactgctgctggctgagagctcaaccgagcttgggaaggggtggaacaagagatgtttagcctacaggaaagtgtggctctgataccagatgttagaacttcaatggttactctcattgagaagaggatggcactcagagtggggcaattttctggttttcttcattcacaaactcaaaagccatacctacccgagggaggttggatacatatatatagccatagctggctgctagcctattgctgcaccctcctagtctaaaattcgaaatttgaatgggatgctgtcctagagggcatccaaactgaataaagcataaaggaggcataaaggagatgctaactgctgctgtcctactaaccgcagctgtcctagcaactgaaaaatatgctaaaggggtagatgctgtcctgaaaaggtgaaattacccaaaagcaaaaagaagaatcatgaccaaggatcacaaagacttatccaacagtgggaagagaaaatgggagagggagagaaacagttatgagtgcctacccctgtgctggcatggtgttagggccactgtggcagtgaattttgtgcaaaccgtctttttggctctgggtgtgattttctggtattaaaataggtggttcctttatccagtttaaggattgagcagtgaatagtaaactatgggaagagatgagggggcataaagtagatttttcctgtgtgaaaaatattgtagagcttcttttgtcttattttattaattattgaatagttttctcgttaacagttttatactgagggcatagcttataggatgtctccgtgagatgctactcattgtgtcagcacaacgatctcgatgtcataattctttttggaggtcacctgaggctaggggccagccccttgctcaggccactgatctgatatttcccacccaggcagctgcctagttcgtctcatgttatttacaccttgcaattagaaccattttgctatatgtactgggagcatgatctagggcaacatatgttgacagtcttgccttgagaacaattttgcaatgagaacaattatagcagtaacttgaatatactgggctgcaaatctctggacagaggtttttgattagatgaaattaggtgtcactgttcagtttcagtctggccttctgcaccgtgtcataatggttcctgttcatcttaaaccagagaaagattgcggtagtctctagttggtgttaaaatatgtgggattatgtggaaaatattactacattctgtagttctgtgaggcaagtatacctattgttaagtgcattctcttcaacttatagtatggtctaaagtcaatgcttcatacgcaccattcttagcgaaatttgatgtacaagtgaacgtggatgtggcagattggcagttaagcgtcttcaatattttagaactttttccttttatgtcccacacttccactacatattgtaaatcttataatctggcatccctgttgagcaattgttagaattttcttaaatttttcttgctatgccagtcgaagatacatctctggtcactaaggagttctgtttcaggatacacagtagatttgtgctctggaatctttgtctatcgtagattaatatctgtatgtgtgcatgaaggtgatgtggatttgtccaaaacatcattctttgtgactggagggagaactaaattatacttttctgatggttattccaggtttactctcagtcgcaagttactctgaagattgcgaagtcaatactatgtggctcagaattcatggtcatgggatttcctcaatgcgcaaatgcctattatctgttgatgcaacttgataagagctttaagcctgttttttgtttgcttgagatacaaagtaatgaaggtgacaataataatgctgatgcaactactgatgctaaagaagctataaggtttatcaggattgacattaacaaattaaaaatagatgaagatgtgcaaattggcaatttttttgataaagataaattactggcgctacaaaatgtggaagatagacctcaaagacaaagtggagctgatgagcctcttcctgcacgaccttcatttttttccattgttgatgaagtatttcgatgtgacagaggttctccaataacagaaagtcaacgactcccacccaatagtttaccctctagtcattcgagttatcaagttggtcttcatgggtttagtggtggagctggctcacctgatcaagattatgggtctctacaatctaacattaatgctgcaaaagttacttctggtactggtttgaacaattatctgctcagtaattcaaagaatgcacaaagtacaagtgccttctctggttcagttcctgcaggtaatttatacaagttgccaccttgtaaatttggtcatgaacatggtaccaaatagaccagaaactatcatcccgtgcccctaataaataaagatagagtttgtttttcctaaatattgaagtagctatttatgcaattatttaataatgaggtagcattcttattgtatgtttttccatggaaattggcaggtttgggtaatgtctccagttcacgctctgaaggtgcatataaaaagcgttctctttctgagttcttgcaaaatatcccatcgtcaaagcaatctataattggtgatgggccaggtaagagaagaaagctgtcagaatttatgctggatggccttcctttgaaggctaattcacccaacatgcaacctaggacgtccctcacctatggaaaattacttgaagaagtaaataattgcattacagcgaatatttattcctctgtgcttcttcatgtcataaagcactgttcaatttgcattaaatatgctcagttgactgctcagatggattctcgtaatattccacatgtagaagaagtgggcatgccgacatcatcctctaatctttggttgcgcttaccttttgctcacgatgcttcctggaaacatatttgcttacaccttggtaaagctggaagtatgtcttgggatgttcggatcaatgatccacactatggtgcactgtggaaactccatggtggtagcactactacagaatggggttctggtgttcgtgttgcaaacacatctgaggtggattcacatatctcttttgatgatgatggggtcctcttgacttacaacactgttgaggctgatagtatacagaggcttgtctcagatttacaacgcctctcacatgctcgtgcattttcttgtggaatgcggagattgatcggtgtaaaattagatggcaagctagctgagcatcagacagctgcagagacaaaattacactctagaagaaaagctagcagggacaggttatctgaacagatgaggaaaacttttagaattgaggctgttggtttgatgagcttgtggttcagttatggtgctgtgcctatggtttactttgtcgttgaatgggagaccggtaagagtggttgcacaatgcgagtttctccagatcaactatggccacacacgaaggttgggttttgacatctatatttactgcctactttgcatgtgctagtatttaggacaacttttttgaaaatttgctgcccgacttttttttatttgacattgataaaagatagtgagtattgatgtccttgttacactgtttgatgtgctaaccgtgtattgttgtactgcatttgctttgtgatgtatatagatgttttcatccaactgaatcatacagctactttctgctaaatacattactgtacttttactgataaatatgtttgaagtttgactttatttggaacaaactagtgttgatactcaaccaaagcatgcttcttttgtaacctgagttgccaaatgcagtttattaaaggggcagtttcttttgctaacctatcaaagttctggtggtatggtaggaaagaaaacattgtatcaaaactacaccaaactaaaattttggcagtaccacattggcataatttgtcaccaaaccagacatcaatctatatctacctcaccaaaatttggcaatatcaaaattttgagactaccaaattttggtaaggtagagaactaaactgactccaaattttcctcatctgtattgtgccggtgtttggttaataaacaaagttgtgatcaatttcaagtgatctctcagtcaaatcagttttgatatgtcaaaatttagctagcaaaagagtgaaaccccaatcagcatgttgcaccaaaacacttgtactttgctactgaggcatttgaaattttaaatttcaaatacagtattcattttttttctactaaagaattgatatttacatgaaattttgctctttgttgtaaccatgttaacataatgcagtttttggaagattttgtgaatggggatgagatagcatcattcttggattgcatcaggctcacagcaggacctttacttgcccttggcggcgctattcgtcctgcaaagatgcctgtaactgttcctgccggttacagtgctctaccaaagcaaaacaatattcttacaacagcgggatcagcaaacagtctatcatcaagtactgtgcacaatatgtctgtcccgcagggtgctgcagtagcacattcaaacagccagcttcagacttcttccatgctgtctgttgcaggacggactgctcctggactagttcctagctccttgctaccttttgatgtttctgttgtgctccgtgggccttactggatacgtattatataccgcaacaagttctctgttgacatgcgctgctttgctggggatcaggtctggcttcagccagcaacacctcctaaaggtggaccttcagttggtggatcattaccttgcccacaatttcgacctttcataatggaacatgttgcacagggtctaaatgctctggagccaaatctgctgaatgctagacatactggtccaccgttgaatgccagtgccaacactgtttctggaaaccaacaattagcttctgctcctaaccgttttggtggtgctcctggggtagctaggccaacttcaactgttgctaaccaggtagcaagtagtttgagtcgtgcaggcaatgccatgatgccttcgggatttgcttcaggaattgctggagctcctgcgcacctttctcctggaaacgttcctgctcatatgaaaggagagttgaacacagcttttattgggcttggtgatgatggtggctatggtggtggctgggttcctcttgctgctcttaagaaggttttgcgaggcatccttaagtaccttggagttctatggttgtttgcgcagttgcctgatctcctgaaggaaatactgggttcagttttgaaagataatgaaggcgcacttctaaatttagatcatgagcaaccggcattgcgcttcttcgtggggtaagatttattgtattgatattgtcatcatattcacagaaatctaaaatatcttaatctttgaaactactgtaagccatgccttccacaatggagtaacactctacagatggaatgttctcgcaatgcaattcagaatctgcttaataattttgcacactaatatttgttttaatgccgtgtagttttttttaggcggttacaaatagggagagagtttaattaactttagttaaaacgatgaggccataaattagcgtgatgaagttttgaaaggtaaagacttgatatatattattgcttaatagaaactgtgaaacaccaaatcctcttgctcttccctgacaaatcctaccatagaaaacatctgccagccacgaaagccttcttcctttagaagctagtctctctatctgaaccaacaaaatagtacttctccgtttcatcttataagactttttagcattgcccacattcatatatatgctaatgaatctagacatatatgtgtgcctagattcattaacatctgtatgaatgtgggcaatgttagaaagtcttataacctgaaacggagtacatttcaaaggctagggtgtatcctgaaagtttctgaggtgaaacctccataaaacccttttgtttttttggaatgcctccatttcttgagtgagtttgggggccaatttgtgttttcgaccaggcgatttgcacatgcgtttaatgccagttagattgaatcccttgcatttgctgtggtgtatttgatgtatgtgctacattacctgcactactatagataaggtagtacacgctacattatccattcataccaattcctttttttggtctttgtgttgatcacatctttgaaatgagcttgtttgattatccttttgcgtttttgaattgataaatcaggcaggaaatatattcttaggcacacaaacatttattttggtgagaattgatagttactgggctcccttgtagggaacagaactgttgaaaagtttgaacttatgttgtatatgtaatatgtctagaaagtcatgcgtggtctggtgggatcactagaggttctgaagtcaaccacaacattgtatcattcaataaaaaaatccaattcagttcaaaacttgtggatgaaaattttcaagaaatcactgcatttttctctgaatatactgcacaaattatttttttattgcctgacctatttttgatagaacatactgtttttactatcaaacaaaccagcaagagctatgttctgtgtatagtggtaggattgaatgccaggggatgccatatgcgtttagctctgatttgtgctaaaccattgtttactgagaaatgtagatatatgccactgcagaccgcctatactactaaattttcctttatattcaactaaagtttttctgttttctcaatatctgttgatttctcaaaaaaaaaaaaaaaactgtctgattatcttcattttccattctgcagtggttatgtatttgctgttagtgttcatagagttcaactgctgcttcaagttctcaatgtgaaacggtttcaccatcagcaacaacagcaacagcaaactcctcagaacaatggccaggaagagctaacagttcctgagataagcgagatctgtgactatttcagcagacgtgttgcctctgaaccctatgatgcttctagggttgcatcttttatcactttgcttactttgcctatttcagttcttcgagaatttataaaactaattgcatggaagaaaagtttgccccaagctcatgcggacaatgctactacacacagggcacggattgagatctgtttggaaaagcaccctagattggtttcagatgattacactgcaagctcttcatcatcaaagagcaatattcatcatgatagagccaacaattcagtagattttgccctaacttttgtacttgatcaggcccttgtaccccacatgagcatatctggtggagctgcttggttgccatattgtgtttctgtgagagtaaggtacacctttggagaagatagtcacattgcattccttgcaatggatgggagccatagcggcagggcttgttggttacaacatgaggattgggagaggtgtaaacagagggtttccagagcagtggagactatgaatgggtccgcagcagttggagatatgagccagggaagactgaggatggttgctgagatggttcaaaagcaactgcaactcagcctattgcagcttagagatagcccagtctctactggctctgccgcatcatgaaatgaatatttagatctcaacggcgtttatactttggataacatggccatgccgaacgtggtgttcagtactgaacggatgcaaagatgtctatatttcaaggcaatgtctgatagtgaattttttcagccaatattcataattctagtgccataattttattgccaggcgaacatctcataattttgtacagtaatattggtaactagtgtggtgctgacctcagttcaccctgcatcttccagaaccatgttaaagcatgccatagcatctcaggaactagtcatgacaggctaggcagtataacgtagcagctcgtgactaactggagcagctctttgatggtatttcattgacaaagcatctgaactgggagtcgtttggttggtgatctcggaacttaacctggtctacaactacaactctacatttgtcttgcaggcaggaaggaactcaatacaatatttgtatttatacttgagctccctccaactcataatagtggtatttctaaacgcaacctgtaaaagggcgcaacaattttgagcatcgcatgcagcatgcatcatgggagcttatcaaatgatgatacccattgatctatggttgattttgagaaattgtagagaaagataaaagcattgtaatctgaaatttggtgcttgtggatttggatttaaagagatgacaaacaaaatagtcgggcaatgcttgtgctgctgaatggttcaaaatgatgctcgtgtactagttgggatatggtttgtgctattgatttatgagggggcatattgcacattgacatttagcactgtagtattagaatcaaagatgtctgaaagaaaattgcgttctgtctgtaaaattaagaaaccgtagttacttagaataaccttggctattaattagtgttgaaatcacgacttttatcccttgcagttagtgaaatacttgttttgattttttttacttaagtttgatcaaatttatagaaaaaattgataatatttttaacacaaaataaatatattattaaaatatattaaatactattaattttagtagaaatttggtgttgtacacattgcaaatttttctgtaaacttgattaacttaaagaagtttgaaaaaaagaaagtcaaaaatgagtttttaatatgaaagggtagtagtaatggttgcagaagtttgttttccaatgcgctgtgggtacaactaaattgctttgatggtgtaggaagggttatgccacaagccttcttttctcttttccttttacccttttggctcgggcagcaaaatttgtgttaaaaaaaagtcatcttttcttttatatcaatcaattacaatcatccctatctctccgaaagaactcttgcgtttggtaattattactagcatcacaacaagtgacatgccgtccgagaaatttactcgtgtgttatttgtctactccctaacacatggattaacattgctgtcgcattaacctgactaatggccagcgcaaagctagcataagaaataccttcaaaagttgcccagatatactcaagacggaaaatcatagagaagggaaacgaaggattttgaatggttaatcgacgagtttatgttccattattactgcaagggggctaatcgatcagtgttcatcatgaggcgatcgagcgaacgaactagcaacgtaaaaagtaaaaactcgggtcacagccagctatccgggaggccgatgttctggaacctgaatgagcggtcgtcggagtcgtccttgccgctgagcacgatctccggcccgtcgccgtcgaaggcgacctcgtcggtggactcgtcggccgcgtcccctcctccctcctcgtcgccctgcacgatcatctgcacggtcggcctggcggcggcgccgcccctgatgacggcggcgggcgggaggcgctcccacatgaggaagtggagggtgacggggcggagcgcgtggcggtgcagcgacagccgctggctgagcgagacggtgtcgaagcagcggatgtcgccggcggtggaggtggcccaggggagcaccttgtcgtcgccgacgcgggagacgacgaggagcttcgacgcccgccgcgcgcgccggtacagctccagaagccccgaccgcgtcgacgccacccccggcgtgctctcctccgccaccgacgacacgtagatgaacccctgcttaattcaccggcaacaaaagaaattgtggtcagccagctactctctactcgcttaatttacttccatttcgctgtccacacacttttagagatacaaactcctccgtaatatttggtacacccttcattttaaaatataagccattccagcacttaaaaaatctttatactacaagacggtatcctgttcggatgggataatacctatgaagtatcaccaacttcagaggtatcattccgtacgaatgggataccatcatgtagcattcccctttcgcataacgtttcaccatttgtcttattcaaaaagattatataaatataatttattttgttgtgacttttttattatcaaataaaatataatcttaacttatacttttatatgtttatattaaatttttaaataagatgaacgatgaaatgtcacgaaaagtcaacgacgcaataatattttgaaaatgaggtagtaacatttaatgacacggatttgtatttgaaatgcgtgcctgatgacatgatttgatatgatagttgttgataatcaatcatatattttgaaaatgaggtagtaatatttaatcacactatatgcaggtagtataccaatggatttgtatttgaaatgcgtggcttatgactacttttgtccagatttgttgttctaggagaggtcacatccctatcctagattgagttttttttttgggacagagagagtatgcccaagaaatggtgtaacaatgacaacaaaatggaagcagtactggttcagccgttcaggtcatgattaattcaacagttcaacattcacatggtagagtaggtatgccctactatagcatgtatgaaaactgggtattttctgaaggatttgctacctcttcagtgcggctgatggcaaaacccagcctggtgtcgcccggttgcagtttgatctccagtgccatctcccctgcaaaaggagcataccatagccggatcgccctgacgacgccaatgtcgacgccatggtagtcctcaaacccgtagaggctcaccgttgccatgtttgcaaggtcacctagggagttcatgttcaccgttgacgatgccacgtccccacatatctgaatcagacaaccaaacaaccatcccaacccttcatttcagttccataaagtagttaagactcaagttataattgtttgccatcctccaatttttaacatcatttttggaaatcgttaagtcactcctctgtctgcttaacaactacaactagcatcatggtactatagtgcagaaaggcaatataaaaaaacaaaatctaaacgaattttggtagatttgaataatttaggctaaattcacaaaaaatgaaaaaaaaggacctggctagcatggttgatgaggatgtcttattaccttggtgagaagtgcttctgtctgcacattcatggggacaattgggacacctgacatctgggaggacatgagccaggactcagccctggccagtgtgtcctccagggagtggaacttggtctgggtctcgtcggtcgcccgaggcagaagcagcagggacaggaagccgctggcgccggccacctgcagaagatccctcatcttcctctcccatgggaatgcctcgtaggagtggctgagcttggcgtttcgcagcgctgcggctgcccccttgacattcttggactctttgcaagcatggttgggattggattgcatatgatgagatgtcatggaagtatatggaaactgaatataccgcgaacaatatgtgcatacgttatcaccctagtagtatattccaagtgtggagaagtttaagaacttggggatccagtggatcggagtactctttgttgccctatgcttgatgacaatttttttaagggggggtattaagttgccacttaattcatgggcgatgtaaagaagtgacatttgaagaaaagaataggaattatgcaagctttggatcgaggaacatgcatcaaatcactacaactagtgagcattgtttacaggaaatgatgcagtcttggattttgattctttgagcttccgaaggtcacaaagctcaagatgcacatgcgagtggtcctcttttcattccttcgtttttgttgccgaaaatcattgtttttttttaaaaaagcgaaaaatcaatgtttttttttttgacaaaaggccttcaagacatgggtctacctatatagtctctagtatcttcttggttccatttaagcgaaagtgcttcccgttaaagatttatacagcaaagtttcatgtagtaattttatcagaaagaattaaacattttcctatgagaaacagaaaataattcctccactacaaataagtcatagttgttgatgatccaaatttaatcaggttggtggtgaatggcttgaaatatgcaattatgaatgcatgatatatacatgcgcattcatgtctaagtagtgggatgataccatattgcacgactgaattgcgtggttctatatgtgccatgtatcatatctgatgatttatctatctcttcgcacaaaaatataaagagatcgagagaagaagatgatttatctatctagcctgtgacatactaatgacctataaaaaacattatgttttagcctgcgacatactgtttgtgggtcaggtccatagcgtaaattattcactattagtttaccaatataatatatatgaaagcataatgttagccttagttttaatttgcaactgccttttggctgaggatgcttgaagagaccgattctattttttaatagaggattaattaaaacccagcctttacacaaccaagggtgtaaacggctaaaagagagacgatctcggtatcttcagagcaagtcggaactgtagattcacctatatatagggttgtgaaatatatattttaaaatttttaagtcattttcatgttacttagaaaattgagggaatgtcccctctcggattaaaagagtatttccatttataagttatttttcaggtgttgacacttggggcctcttcggttcacatgattttcaaatcacaggaatagaaaaacacaaaaataatgtaggaatgcacgtgctaacacaaaggattggaacacaataatttttcctatactgagctgaacaaaagaggatggagtggatgttttcattcctatgaaattattacattttggatgattttggaggattggtatagtattcctatggaaaactttcctttgaatcctatgaatcgaatacatgaatagtgtttattccaaaggaattgatatttcatttaggaatccttcaaggccatagactgtcatttgttaatccaatgccgattataagcagaatggcttattagaaaaaaatagtttacgggtataactttttatatatatatatatatgtgtgtgttcttagcgatttaaaatccaatgctagaaaataagtttcaattaataaacataaacaaaaaatcaggtttttaaaacttaaattttggcaacggcttataaactttgatgagaaaacatcaaaatcaacattttaatgtttgctagctaccatgtaattaagatttataataacaaaattgacattttgctccctctttctcctcttttatttatttatttattgttgaactgacatgaaggccaacaccaactaaccatgcaacttgaacttataaaagaagtggcattgaatgaaccgatattcatatgaatctgtagaaacaacataaacactaataacgatgatgattaaagaacatccctcttggagaaaacaattgccctatggttttcttgtctagtattatgggtgcataggctccttaccgttcgttccaagccactaaaaaaaatataaaattaaaaatggacaaaaaataacgtcaacatacatatgaccgaccataaacttgcatggctaacaacattagttatttccaaatatagtctttcagttataaattgaaaactaaaacgattttttatgtaagactcagctgtctgttattaatttttctatagtcatctgctcgtccactctccagtcgtcctgccgctaaaaaaatattctgtagctaaattgatctacttatattatttgtaaatctttatatatttctcaagttccatgctctttggcagtggtgccgctaccggtgcaggttacatggcaagaacccatctgacctcatcttttgagactgcacgtaccgtaaaatcatctaatgttcaacccattgtcctttccagtgtctatattatgtccatttatatatatcttctgaaaattggaagttcatccctaaaaaatataattttagtttttttaagagaagggtaatctttatctgacctctatatccaaccggatatatgcaaactttaaaattgggaacttagcttctcaaaaactcaaacaacccaatctgaaattcggagatttgaatccaaaaccataggatgttactcaggtcactgtaaccactaagctatatgccctttcacaattgaattttagttagtgggataaaattctataattgttgtcttggtgaccatattagattttttttaatttacaaaagatgcacgtcaagcatgcaatcaggcaatagctagagaacatttcattagttatatatatataaaagagagcatttcattactgtcttgaaaattaacttaagtcgtttggttgcgaaatgcaatttgcttgctgtaatgctgttccatcctagccacaaactacacactttgactaagattgtttattgatgtatgcagcaattagcgagagagagagagtgagagagagagagagagagagagttcagaccttgtagctctaggctgtcacgactagaaaggtcgccttcgacggagctgtcgcccttgcgccccttcctcccgctgctcccgccggtggacgacgacgacgaccggctgaggtcctgcgctgcggccgccgccgcctcgtcgtcgccggattgctcaccacccccagaggaagcgcccgccggcgcgtggtggtcgccgcgcttgaacgccgacttgagcagcttctgcatgccccgcttcttggccgccttgctaccgccggtcacttctccacccgccggcatcagcggcggcggcggtggaggaggggttgtgtggagctgctgcagctgcaacggaggctccaccgccgccgccgccgcagcagcagcagaagcaggcagctgcgggcggctacggacagggctggccttgggcttcgccggcgtctgggaatgcatggcgcgccggcgatcgcgagaggaggaaggaatgtagttagtggccggccggggtgggtatatatacgcgtgtatcgattgggtagattgcgacctcggaatcccgtggcgactttggaatttggaatcggggcgtcgattctggagaaggaaagaaattaaagaaagggacgttgaaattgattatggctgaggatgattttttattggatgcacccttagtcgtgtactcgcatcactctcttgcacgcgcttccgcagcttaatcttctatatacaaactcgccggaaatggctgctctgggcggcgatttacgctgtcgtggcccttgccgttgcttggcacgtcatccagccggagcccaggggtggatttggagcgcggtcgttgcgcgcgttctccgccgttggatgaccatcgtgcgtcggtgcgtttggcatgccacattttcctttttctcgtccgctggttctctgcgttgcgtccgccacgtgttgttccctgtgtggtggcctcatttggttggtttgtgtgcggtgcattgcgccgcgcgcagggtagggtgggtgtccttgccattgttttctccggtgttatgcgttgcgtggtgcatttctttgttttttgaggtagccatggtccacagattgcctgtggctgccgtgtgggccgcatggcctctgcctgttcgtacctaacgtggaacaggtctatgctgtttgccttagctgctgtgtcagattgctttggtcgcttggtgcgcgtgtgcgctgtgtccatggcacagtttctctctggccggtgggtctgctttattctgaacctgtgtgttacggtctaggaccatatgctgttggagaccgcgcctgtagtgggattactctgtgatggcttctccgctattggtgcgtttgcgtgggttgtcaatatcaggcatcgctgtggtcctggtgtatgcgccccgttcctctgcgtcctgggccatgtccaatccgcttggatgcttggttcattcggcttggtccatgcagtcttcttcttctgcagcctatgctgttaggctgtgttcggctccatccattcccagcgcgcacagtgaacacggaaaacggagcgatccattagcgcgtgattaattaagtattagctaaattttttttcaaaaatggattaatttgatttttttaagcaacttttgtatagaaactttttataaaaaattgcaccatgtagtagtttgaaaagcgtgcacggaggaaaagtactgtgcgcgttcccagctccctcagccgaacacagctaatctctggtcaggttttcttgggttgtagctaggtgcgctgcacttatatcgctgataggtggggcagtgtcatctcagctagccatttgtttggttcctatttgtgggtgtttggtgtgcaggtgtacatgattgtttgcttccttgctgcagctcggcggagaaccccttctatctttgtctgtatatattactacttgcgtttctctttctttcttcccttcggtttctcctcctctcgtcggtttcttcgctccactgttctgttccttgctcgagaaactcccactcgttttgctcctgttcaacttttcgttatggcgtggtaaggcctggatcaatgcgtgtggttctcctgtccgttctgtcatttgggttttatgtttgttctctcttgtttgtttgcttatgactgcgcggctgttcttgctagcattgaccctgcaccttttgttccatttaggggaggcgatctgcatgggctgcaatggacctttaaaggttcctgatcatcttccattgcacgtgtgcgggctgcttctaagacctagcaggtacttttggttgttgctggtttcattggccttgtgttatgctttgcttcctacattcttattcactgatcatgctccgttctctgcagctctgttccgtcttcttccttgcctctgttcacagcttgtgtgttcgcttcgtggtgcgttttagtggattctgcctgtcgacgagcatattccttgctaaaggtattcccgcgctattaatctttctgtcctttatttatggttgattggtttagtattttgtttctattgcctgcattcatcgctgtctaaatctgcatgtggttgctccagagctttcggtcgttttatattgttcgttcactgtatctgtgtggtttgagccactttttttgcccgtgttctttgcttcattcttttcttgcctctgtaaaattatgatggcagttagaaacgcatgctatggatagagtgcgtagggtacgtgccagccggcagagaagggccacaaatgttctgtcccaacagagtgcaatgcatatagaacatgctatcgttccgctagggcagccccatcaggaaagtcggtgcaagaggaaatgttcgttgatggattttgcacctcagctggcaaagttaaataggcaaaggcgttccctcctgcgttcaaagatggatccgtccgttcctttggccaatgtggatggtatgctctttttgttgtctgtgatggtaggcttgttttttttcgtgcagtttaggttcataggccgttttactgtctttgttcgcagcaaatcgcactgcacgagccaacggtagttcctcccggacagacaaggagtatatctgattgctaaagggttcggccgctgttctgaatacgtgcacgtaatgtattgtttttttacacgagactatttttgacattgtccagcgcttttgtggcagcatcatacccagacagatcatactatggccctccgacgtatgaatgcccgtattgtcgtgccatgttctggtaccaggagagggtcaagagtgcatctgctatttcaaaaagaaaaataatttacaatctatgttgcaaaggaggacgcatacaattgccaaaactgcgtgcccctcctgagccactagcatcattattgaactataatggtgatgcacgttcgaaaatttttttgaggcaaatacgatcgtataattcgatgtttgctttcagctcaatgggtgcagctattgataaatcgattaacactggaaatgcaccttatgtattcaagatcaatggagttgtgcaccataggattggtactcttgtgccatcctgtggctcacctcccaaatttgcgcaattatatgtgtatgatccagaaaatgaattacaaaaccgattaaatatatttgaaaacgacggtgataattcagataaagcagatcctgagataattcgtgccctatcatcgatgcttgatgctgaaaatactcttgtccagagctttaggtatgctagagaacgtgttattcagcatggcaatcagcaagtgacacttcgccttttaggttgcaatgcaaaagacgatgtgcaatacaatttaccaacgaacagtgaaatagctgctattatagtaggtgatttttctgcgaaagaatacaaatttgatgtgcttgtctacgataaaggtcgtggcctgcgccagatttctcccttgcatccatcttatatggcattgcaatatcctttgttatttccatatggtgaacgcggattccatttaggcattaaatacagtaactatgatggaattggcaaaaagtatgtcacgatgccggaatattatagatatgaaatgcattacagactaaatgaatcaaatcctttcacatgctatggtcgcttgagcgatcaaatcgatgttgatatattttctactattgaaacaaataggctacagtacttcatcgatcatcaaaaagagctgcgctctgagtctgtagatggaattgttgatgcgattgataaaggtgtcactgatggagattcagttggcaagcgtgtcatacttcctgctagcttcactggaggaagaagatatatggtcatgaattatcaagatgcgatggcaatatgtcgtgtctatgggcctcctgacctttttgtcacatacacatgtaattccaaatggcaagaaattgcagatgcgattcgatttgagcctggccaacaaccatctgatagagctgatattattgtgcgtgtgtttaacatgaaagttaatgaatttataactgatattagggaaggcagaacttttggtaaagttcttgcaggtatggtcacaattttgttagttcatagcgtattaaggccattggtgtggcactcatcaacctttgttcttaatgattacagtgttgtacactgttgaattccagaagcgtggccttccacacatacattgcttagtttggcttgctgctgccactgccgatgtctcagcctctataatagatgggtttatctgtgctgaaatacctgactatgacaccgaccggctaggatatgaattggttagcgagtttatgatgcatggtccttgcggtgatgcgaacaagaagtgtccttgtatgaaaaacgataaatgttcaaaacattatcctaaagatttccaagatgaaaccattgttgatgaatctgggtttacaatctatagacgaagaaatgatggacgatctatcatgaagaatgggatccttttagacaatagatcagttgtaccctacaacatggctttactgaaaaaatatgaggcacacataaatgttgagtggtgtaacaaatcaaatttgataaagtatttatttaaatatattacaaaaggccatgaccgagctaggatctattttgaaacaacaggaaaaacacaaaatgcatcaccaaatcatgaccttgctccacgcaatgaaatattagaatacatggatgcaagatttctctcaacctgtgaggcacttcatcgattatttgaatttgatatacattatagagtgccacctgttgagcgattggttgtccatctgcctgggaaaaactttgtgagatacgagaagggagctgacctacgggcagtccttgagagtcctggtgcaaaacggtctatgcttactgaatggtttgaaactaacaaaaaaaattctaaggcccattcattgacatactgtgagtttcctaaggaatggacatgggagccatcatctaaaacttggcacgagcgaacacctgctcctaaaattggcagaatttattatgtgcatccaactgcaggcgagctttactatcttaggatgttgttaatgattgtcaaaggtgctcaaagctatgctgatgttcgcacatacgatggtgttgtttatggcacgtatagagaggcatgtgaggcacgagggcttcttgaaggagataatgaatggcatctcctttttgatgaggccatagtgactgcgtcttcagcgcagcttagacaactttttgtgacagtccttctttactgttctgttggtgatgttcgttcattgtttgataaatactggctatacatgactgatgacatacataacaggctaaaaaaggcccttgacaatccacactgtgtgattccacatgaccacttgcttaacatgctactacatgagcttattgctgtatttgcaaatagcggtggtaatatcaaagattttaacctgccacatccatcatctgttccacatgttcttggtactaatagattaatcgatgaagaaatcacaattgacccacttatgcttgctatgcatgcagactctttcgtacagcagttgaataatgaccagataactgtttttaacactatttgttctcgtgctatcgctaatgaacctggtttcttttttgtgtctggtcatggtggaactggcaagacatttctctggaatacaataattgcaaaacttagatcacaaaacaagattgttcttgctgtcgcttcatcaggggtagcatctctcctattgcctagaggtaggacaactcattctcggtttaaaataccaattgacattgatgaaacaagcatctgtaatataaaacgaggcacaatgcttgctgagcttttagctgaaactgcattgatcatatgggatgaggctccaatgacacataggcgatgctttgaagcattagatcgaacgctacgagatattttatcagagacatgcccttcaaattctattataccttttggaggaaagcctattgtcctaggtggtgatttcaaacaaatactcccagttattcctaaaggatcccgtcaggctataatcaatgcatctatcacgaactcagaactatggaaacatgtagcgctactcagcctgaatataaacatgagattactcaatccaatgttaccagacaatcaaaaaaaagaattgcatgattttagtcaatgggttttagctataggcaatggcactttacctatgacagcaaaggaaggtgagaattatcctgcatggatcacaattcccgatgatttacttgttatgactagcggtgacaaaatagctgctattgttcatgaggtttactcagatttccttacgtgctacagagacattgaatatctggcttctcgtgcaattgtttgtcctactaatacaacggttgatgaaataaacgattatattattggtttagtgccaggagattctagagtatacctaagctgtgataccatatcaaaaagctctgagcaaattccagatttcgatctgttataccccccagagtttctgaattcaataaatgctactaactttccaacgcataaacttgttcttaaagaaggtgttgtcgtaatgctgctacgaaatcttaatcaatcaattgggttatgcaatggaacaaggctattagtcacagttttaggagacagaattttacagtgtatagtactgactggatcaaacattggtgaaactgtttacatacctcgaatcacacttggcaccacaaagatgaaatggccttttacactgcagagaaggcagttccctgttcgagtttgctattcaatgaccatcaataaaagccaaggtcaaacactccagcgggttggcgtatatcttaggaagcctgtcttcacacatgggcaattatacgttgctatttcaagagtaacaagccgatcagggctaaaaatattaattgaaaatgatgatggatcatgtggtacacagacaaaaaatatagtttactctgaagtgctcagcgctacagtccaagcggtgatttcccgcacgttatatcttttttttttgcttttcatcacttcgttgtattttcagcagagtaatgtgcatgtgttactattgcaggctccgccgcttgatgcttgaaattttttaccacagtaatacccaaatttgtacatatattttggaataaatgtctttcagcctcaagtactatagactatgtgtatggtacatagtatattgccttttgtcatgtatagtatcctgccaagcaatcttttgactgttatatcttatccaaccattttacccattctaaaatagttctatgctcattgcaggtccaagatggcacatgtgctcatttcacagctgtcctgtggagacttaaacacaaggatccttgcaagagtttctaggttatgggatttctgcgatctcaacggcagtggcaatattttccacactgatcttgtgctgctcgatcagatggtaatgatgtgactatgacatttattcatcgatgcctattaggctatagtgccaactctcttgataacattatttactttaaaaatgcagggaaacagcattcacgctcagatttatccacctgcaattgacagcctgaggcctttgcttaaggaacaaaaggtttactatattgactcctttactgtgaggtatgcgaataggacatacaggccagtcgacaatagcctaatgattgtgttcagtaaatggacaacatttgaagaatacattgagcccgctgctgatttccctggcataactttttcattgacaccattcagtgatatccccaatttagtggacaagaccatcttctatgttggtaacgagattcttctacacagctatatttgttgtatcaataatccatactatctcatcattaattaggcttatatggcatgcaaccagatgtcatgggtgtcatcactgaggttggttcgccaaccgttgtgcggccgaagtcaaggaatgctgatagcttaaaaagaacaatacagatatgtgatgcaaggtgtctttgctcagactgaatatccctatgtttaattgcaatttttaccttttcctttgatgcatgcatagattcttagtacgctgctgctttcttaaattacactcacactgtttccttttttctattcatggaaaaacaatagcaattcaacaatgcctgttacactctggggagaaagggctgatgcttttgacgctaatagtgtatacaatgctggccaaactcaggcccaagttattgtctttgttgggacacttgtcaaagattacacaggattaggttcgttttcactacgcattttcacttctatgttgtttattctagccatctaacgctatgcttttatttggttcatgctatacaggtcttacagtgactggtagttcgccgtgcaaatggtatctaaaccttgatattcctgaagtgctagaactcaaagagaggtgaggctgcctacttgaactcatgtttataatccattgccatcatgtgttctcactccttgtgaaacagttagttaactttcaacgtgatataactatgtagcttcagtgcaaactttcgtccagtcagctgggttgataacccagcaacaggttacaaccaggacactgcagaggaaaaaactattcaagaaatacttgccctcaatcctcacaaaaacagggtacctccttgccagttttttgttcaatacatcgctgcacattttctcactttcaataatagtgatatcatttctgttctttgctttttcagagtacacgtttcattgtcaatgtcactgttaggaggatatgcagcgaaaattcctggtggtacaattcatgccgattatgctatagaacttctaagccatacggttctagctacaaatgctcaagctgttctaacataggaataccagatccaaggttcataccacacctcattccagatttttccatgcttactaattgtgctgcacacattaatatacacatgtatattacccatgtagatataaagtagtgctcatcgccggtgatgccagctccaatgctacatttatcctttttggaagagttgcacaccgcctcataaaaaaatcagtggaatctctcattgaggacaatccaccagatagtgattacattccagctgagatcgcagcgcttgttgatagcacatttacatggaatgtcagctttacacgtgatactgtcaaaagaagccaagaatctctccaggttaacagcattgtttcctctggcccttcaaatgagccactgctgcttatgccaccgggttcttcccaggaaccatcagctattgcatccgcaagctccagcagttctgtccaaacagggccccagcaaagccaaacaagctctgaatcacaacagctcgtccagcaagggcacagcacttcaaccccaacaaagtcacctattggtactcccacacagagcacaccaaccagcaaaccaagttcttcaacaccagggaaaaaaaacatcgttgtttcaatgtgccacatgcagcctcttagcaccaatgttgacactgctattaaggtacaacacttgtcattacctttcctgcccatattgttcttcctgcaccctatttaggttttcaccccatacataatcttgcaaggccaatcgttgtgcgcaggatgaggtcaaacatccagagcatgctcctgaaacaactgttgtcactaattctcctgagtccaaggtattcctgcttttctttcctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44078 - DNA, 756 bp, Oryza sativa
cctgcagccccggtttagggtgtaattcatactcattcaatactccatgggggtaattcgtacttttttttcttttactgttaacttaattaactaattaaaagacatagtaatcctctctagccaatttattctagactgttgtccttggattgaatgctgattatagatcgttcctcgtgttcgataccctagaatactctaaggggaagtgctataacggtgtggttaagtacttatctgtgatcttaagactaccaacaatacctaccctcattaactaactatatttatttctcaggccaatccaagtatgtacggattcactatgtggtccaacaatgccagtccgaattatcatggccaaaaaataactaaggctaaaacacacaaatagagtacatgcgaatgaagcagcaggaaatttcaatacgcgctgaagaacatagaaggggctggtaggcaagatcaggctcgagttgtcgtcacagatatactcgtatcgttcatctatgagacattttagctctattatcatatccttctaatggtttctgctactgtatgggtcatgaatagaaaactaatgtatctatttcattttccctcaattacctaatataatgatgtgatgtggtgagaacgccgccagcctcagttgagaagagacgtggcgttgacatgttaggttgatttatcggtttattagtgccgataaaattagagaaaggaaaatctacctttttttctttccta

SEQ ID NO: 44079 - DNA, 2825 bp, Oryza sativa
  unsure (1)..(2825): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccaatacaacaaagaagtttacttacaacaatgggagcatgctcaggtgtcttggctcgtcccgaggattcagctcgtcccgaggacacggggcaacctgaatatgatagcttgctggtaaaaagcacttaatcccacgaggccttagctctaattagggtcccgaggatgccccaggcaacccttggaagatcccgtgccggtaacaaacacttaatcccgtgaagcatgggtgtcctcatcatcggtcctcatggcctacctgtattggctacaccagctaacggatgggcccggggactattgggacaaagacttttaactcccctctccatttgtcaggtgtgcctgtcacatccgactagctagcttggagggataatgactagactaagcatatcaaatttcgagttgtaggccccactcttgcatgtatgcaactgtattgtggactccccttcacgtataaaagaggatccataccacctagaaaggggttcacaccctgatataatctaggttagattaaaatccaatgagcaagcaattaacttcacctactcacttagttttcatttccacatcactttgtaattccatgtaacatccatatctaccacacatgaataggatataacgcatctgttcaacatgaacttgtataatcacttgtgtttcatctcttccacacacaatcaaaaactcgggctcaaaacttgtaccccggtcgaacttttctatggggagtacctatcttccatgctagagtagtcccataatccgacagcaacgaaatcggcggcgcacgtgtcacgcctgtaaattcacaactaatatgtgtattaaaccctcgttcaggaatcggtctcttgctctctcttgactttctcgctctttctctctcagaggagtcgcttggcagtggcgcttgcccctcgatggagtgtggcagaggctcgctctcgtgcggatctggcggagcgcggtggacgcccgagcttgcgcggatccgacggcgtgacgttggaggacgtacgtggcgacgatcgtcagtgtgaagatggggccacctaatctgtatgcctagaggtcaagggccactggatctagccgcttcgagccttcatggcgatggtttgggaggtgcgacaacaacgacgggtttggaggtgcgatggcgtcagcggttggtagatcctcctcttttgcctccctctcgtgattcttgtgattgttgatgcttattcatgtttgtttgtctcggtattgatcttgaggatcgagatgtgttgtttgtagttcatgtgttgatgtgttcatggatttggggcatcatttttgggatttgggttatcatttaggatctagggatttcgaggatatgcagactcgatgcattgagctgttttttttttggctcgtgtgcatctcaaaggtgccggttgtggaaccaacaacagtgcatgatccggggtcattagtaccacctctaggatgctaattaggaaatccagcacctatggaggtttcccagccagcatcgatgactcttttttaagtagtgagggctacttttgaaatgacactgagaaggtcatcactgcacgtacagcaagtgagaaggtcatcaccgaggatgttctctgttgaccttgaggctatggaggtaactaaatgcaaagatgtgtgtgaactacttatccatgtgagctcccttggttgcctactttaccagcatgtgtaattcattgtgaaagacggggcaaggttcactactacaaaacatcaaaataggtgtcgccactatatgtgctggtactactaaaaccagcacctataagccttttcccacctccacaggttgaaattgtaaaaaaccggcaccttttaagtaattataggtgtcggttctaaataaaaaccagcacctattatattttgtatcgattttttttaaaaaaggcacctataatatattataggggtcggttaattaaaaaccgacaccttttagatattataggtgccggtttttttcaaaacatcccaaaaatcgagccgagacggagccgagccggcgggcccaccacgataggcaacgcgaggggataaggtcgagggctcgaggctcagtctctcttctccgtcttttctaccttcgcctcttcttcgtctctcgtctcgcctctctccctcccttctctcccgctgccggcggctggacagcggaggcggcagtggcgaccacgccctcccctccgccagatccggtgagaggggcggcggcggcggcggcaggaggggaggcgatggcggggtcggcggggttggcggcgggcggggaggctcgatgtggggaggcagcggtgggctcgctggcggggaggagcccttccctccgccagatctagcgggaggggaggcagctgcaggggcagcgggctcaccggggctaggtggcggcagctcgcggaggagacgcggtggcggccgacagtggatccaggcgtcgtcgccatcgtcgtcgcggccgtcattgttgtcccggccagcggtcgatctgcgcgctcgaggctagttggtggtggatccagattttgtcgtctttacggtcggc

SEQ ID NO: 44080 - DNA, 12696 bp, Oryza sativa
cctgtcgatagttaccatgcatgttatttggtgtcccacagttaataatatatgttctttggatatcctacagtaaagatggtaaactttaagtgtactatcgcaaattttaccttaagataaggcagattacaatgtttcggtgttaaaaattggaatcagaaaaaagtattacaatgtctgagcacaacatgcgacaacaaagcttctgaagcaaactattaattatggagttatatcatgtggataacgataggggattacaaatatagagatatgcatgtgttaatttcaccacacagtactactcgatcacctctgttgtccggtgcctctcatgattcatccatgtcttgtgtgccccatatttagttgaaatcgctgcccagccaaagattacgacgcagggccaatatgtaattagcgttcgaataaggagaacacgtgcaataactggcaatacctgatttcccttcctaacatacatcgctattgcaacacggggtgcatgcaatggctccgtgaataagcatagagatgcaatcatcatcattacacagattgcaattgcagtccatcgagccactggagccagtaccaaatacatacctagcataaaagcagcacccaaacttatcaccgaactgaaggccaggaataaagatatgttgaagtgccggcgacggaggggccaactaaccatagccattccggagtacatgaggtggatgatggctaaagttgagcaaatgaatgctattgtgttggccatggtgaatgcatcgaatatataccttccagcaagtgttggtgtaccgccattgtaatggtcgtcggctttatatcctccaggtatggctaaaattgcgccaaatgtgacagtaacaattagtactgatccgatgcctagagtttgtgttgaagttgtcagtttctctgattccttcgcttcgtctgcctgttttttctgaaagtgatctgcccgacggcaaccaccacttgcattgcaatgtgttaatgccagcaatatcaatttttctgggttctgcaaagaaaacatatggatctgtaattcaaaactacttaattattttgctttgtttgtactggaaagtggaaacacaaaaagagtgagaagtgtattacccatacatagtaaaacccttcatgaatcttactgtctgctatttctaaaggagtctgcccctgattatttagtatatttaagtttactttcctgttccttagtaaaatacaaaaaatgtacttatttccattccgcactgctatatgcattgcggtgttgccatcattgtcttgcatattgaaaatcctagccaatgatcgagtacggtgagcatactcaactatattccttctgcccctttcaacagcgacatgaaggaaagtcctccccttaaaatctacaagaccagcgatctcatcaggttgctcctcaattaaatatttgatagtccgaatggcacctgaggatgcagcaacgtgtatcggatacaatccttcagaatcttgctggtacaactgaactgggttggctagcagtactggaatgagcggagtgcgtgacatccacgttattacagtatattcactaagtgatgcagcgaagtctttacaaagtgatgcagcgaagtgaagtggcgtgcttcgatttttgtcaacttgttctgtgaggtccttgttccaattcagtaacatttcagtcatctctgcatatgtggtgttcaagtcaaactaggttgtggcatacaaactttgcagtagctaagaagaggaattgaacataaatatatttctacataatccacttctacagtacgaaaattagaccatttttggttaatttctccttaaggggattgaaggtaattcagagaggaatattccacacttattgaggtgtgaaattaatcttcctcaatccccttcaatcttttcctcttaggccttgttcggttgtcccgggaacggccgggattgggctacaatccccatggatcaacccggtgcggattaaatcccggcttgcaagaaagtgtgcgttcagttaagcccagtttggattatatcacaacccatcccggcctttccgcgtcaccccggtccgggaagaaatcatcgacccaagaggtgtggaaaaaaatcctcgagacgatgcgcagtgcatgggaggtgactcggtggcggcggcgatgcgaccgaggggcgatgggagaccgcaagattgggaagggatggcaatggcgactcagcgccttacccttgtccactccagtggctagttctcacttctcaccggtgcacatatatctctttcttcctctctcctctcctgggtggcagtgttataaggtttcttggagcaagggttcctaagtcatcgcttgcgctcctcattgccaccacgactatcctcgcagcaatatattgagaacgggccagtgccgcaacccaagcccgatagcatgcccgatgtgtgtcaaactaaatatggtggaggagaaccttggtctttctgctttgagatttgctccggtctaacaaaaaataccttgaggtaccgttatctcacgataccaaatcgttttcgatagttggatctagcaacgcccatcctgtctagctaaattcaacgatcggaaacaatttaataccatgagataccggtatctcgaggtattttttactggaccagagcatatctcttctgctatagatctccagtatcttaacaattgagtcaacggagtgctacaatgaagcgtgtgaatgctgttcaacttgattattttctgttttgtcaacttttgccatgcgtgtgatgcctcttgaatcacggccatagccgccgacagccgcgcgtcatcgccgtcccgtcgctattcccgctctccgcgcgcgtcatctcgcgtcgcgtcgcaccatcgccgtcgccatcgcatcgccgcgtcccgtcgaccgtgacctcgctgacgcctcgccaccacagcgtcgtcgtgtcgctatcccatccaccccggaatcccgctgaagaagctagccagctacacgtgaattcgcggaggctagccgccagctcgccgctgcatcccgccaaaccctcaccgcctataaaagggccccaagctcccccattcttccccacaccatcaccatcccaacccatctctctctcctctctctttctctcgatttcactctctgtgccgccgcctagagccgccgcgctccgtcttctagcgccgccgtcgccggaggagctccgccggaggccgccgccccttccccggccgccggtcgccgagccgggcctcgccgccgcgacgcgccctcaggccgagccgagcagagcgcgaggaagacgaagaaaccgagccgagccactgccaggccggccccgcgcctcgttccctccaagagccgctgacagccggggcccacaccttttcccctccaacagttgccgacaggtgggacccttcttttgctgtcaaccctagcggaatattcccttgccgtccaataaataaaatcccagaaaatattttatcttttgaaaatccgtagaaaatcaaccataattccgattgaccccattcaagtttctaaatttttctaaaattgagatctacacagtggcactgttatttctctgatttaagatagttttattgccttttcttatttagatttgttttcgcgtttagagcccgagtacgaggaagctccggacgccgctttcgagggaaaagaccccaaccctgtgcaaggcaagcctctttgatcacattgcccctatattttcaataatatgttgtttgcaaaaatgcattgcttagtatacacgattaacatgtttaggcctcggattgtttatacaactgacggaccaacctaggagtcgcacttatatttcataggttgatgtttccatacctttgatagctccacaaatatttgcgccggtattgttgtacgaataccgagatagtttcgcttagccatgcttatgttgtttgccaaatacatgtttaaaagtccggtacgttgtaccgaggtgttgtgaaataaaatgtgttgtgaaagtggtgatgatgcggagtcatgcctttgtggtttggctacgtattgtcgttaaggaacgattcctttgggaaatccatccaaacacattacagtgcgaccacacgggtatttatgggatgcctctggctaagtaaattgctatcacatgggagttggtgtgccaatggttgtggaatgccgaggatgaggagacgaagtttttacctttttgcccatcatgggtgttattttgcctctattgtggtgtacgaaatcagtaggagacatcctcggtatttcctggcgtgcgaactttcgttgccgacgggtaaacgatgtcagtttcgtgtcgtgtgggtaaaacgtgcaacctttgcagagattaatgaactgtccgaacagccgtgcccacggtcaagggcgagtgtaaggtgtttctcatagcgtagatttgtttgacaaatgtttgtgaagtggttatttgggaagggtaacgttaccagagtccgcctgtgtggcagacggctaacctatgtggttaggaacaggtctgtgtgacctggggtgtcgtccgacaccgaggtgttgttagggccatgatggcgttgttgtgctgagataactgtgtggactatgtgttgttgtgagaagaaactaatagaggaaacaaattaattgttgttcgttaatcgtgataagttgttgcaaagcaacttgtggaatgggtcgaggcgtgagcctcctcctgacaactaaacacttgactcactcactaggagttttgtgaaataaatcactttgccaaaaaggcagctttcgcaaataaaaccatagcctccttgtttaagccaaacatgtcattctttcctctggcttgctgagtacgttaagtactcacccttgccccttataataatctatagagtatgaagatgaagacgtcgacccgaccgccgaggagtatctccaggagcaagctgagtatgaagacttctagatgttttgtccctagccccaagcctcgcttgtggaataagttagttgcctaggttcatagcctagagcatagttgcttagtcgcttagtctctccgcgtgttcgcttttatgtttttctgtgctattgtgttgctcatccatgggcctgtccatgatagcaacttatgtaatgactgctacccagtgatgtaataatgcagtttactttgatttcacatttattctgtgtgtaccagctagtgtatcctgggactggtactatatcacaggtaatgcataacaccctgatgtaagttagctatgtttatggctaacgaatgtcggggcgttacaggcatgatgtctaggaggctttgttgttgcaggtccgggttgaggaggagtaccacatggtagcggatgcggtctaccacaaacgcaatcgctcgagatcctccgggagtgctgccgatactggaggccaaggaagaggtagctgccaccggatctggtgtgtgtgtgtgtgtgtgtgtgtgtgtgtgtgtgtgtgtttgtgtgtgtgacctgccgctggccttggctgctgcttgccaagacctaccccattgacgccacaccatagtctctacattaatatcgccgccacgctgtggaccaagcccaccaacctctactactcagggttcctgttcgcaaaaacacaagcgctagagcttatgtgccttcgccatccatataagcgtcaagcaccgtcttgaataagacagaagtgagcagtgtggggaaaggttgtggctgagttgtagggtctacaagaggcaaaatggactttttcacaccacccatgctggcaatcctacttgtcacaccacttaggtggaagtggcaaaatattaggaaaccttctctctccgatggaaaaaacataggaccaaatctaacagtggcatttagaaaggagccacttattaatagtggactagcactgataacagaattggtaactgaatgtgaaaaaatattgtaggagatccaagaccgatgacaataatgaggcatgatatttgttagagaggtatttcaaccgaaccctacatcctggggcattgtgttgctctccaaactagtataactataatataccacggtaccaatatccctccagcagctaagacaactagtcattccctcgcctaagttcttaggtggtggctagagagtttaggattagagttcgacattacttctatcctaaacacatcctccgaaccctacatcctgagacactgtgtgttgctccccaaactactacaactataatataccacagtaccaccaataaccctcgagcaactaaaacagctagtcattccctcgcctaagttattaggtggtgcgtagagagtttaggacaagagttcgacattacttctaatcctaaacacatcctccctctataaaaagtaattctggctacaaatctagacatagttagaatttcttttgttacataggagtcttataataacttcttctttccaactgacattgtatgtatatttgaagcaaacttaatcggcaatgtttgcagtcattgcctatttattatcatagggcaaacttcggaaagtaggtcgctaggctaggtacaagctccctcaatgctgattattaattgtaaggcatattttgttattatattttggaatattatataatacttcttcagttataaatatttgatgtttatgacaaaatttagtaaaacttctgaaattcttaccatcgatgattctcagaacaaggaatggtataccatcatggtattataaaattattagatttataaacatatcctaattaatatatatataacattgatgcttgggattttaaagaagtttgaccaaaacttgtcctaagcataaaaattaatgattagaaggatttaaaataagtatgaagtaccgtacaaaattaacatgaaatgaaaaggtatatatatcaattgcacacgtacctttgccttggagaaccgctgcatgcaatgcgttctgtccacttaggcccgaatatgaaagattctctggactcatttgatgcaataactttgcgatgtcactacgttgtagcacgatagctaggtacaacggtgaaattcctgcttcatccgtaggggaactagccaattctggatcgaattcaagaagcttggtgatcatttccttgtttccgatgcggattgcatcatgcaagggaagaaaggccgtcccctttctcagaacttccttcaatctagccgctacctgcagatttgacctcggattattagccagatcaattagaaaagaaaccatttgggaatggccagccctgacagcgcagtgcaaaggcgtgccgcctttgttgttctgcaccagcaggagatgcggggccttgctgcagatgatctccacactcctcaggtagctccagccatcaccagaggtggccaaaacatgcagtgccgtgtcgccttcaatggtgaccccctccaggtccaggcatgactgatgcccatcatcaccagaagcttgctgcgtcgccatggtaggaattgcagggttagcttggtccaggggcgacgagtctgcagagggtgcaggacgatgacaagcaccttcctctttagcagccttctgttgcgtcgcagcttccatgttcagaagaatgtgatcggttatcccatcacaatcacctcgcgatgcaaggagtagcaaccatggattcatgggaggctttgcggtgtcctcctttgttttggccaccgtcagtttggatttgactgccgatgccatgatgggcggtggaggagcaccgaggctagctagcggcagttggcatctgggggcttgcggtgggtgctggtgctggtgcagcggcactaccactactcgacaatattgtggttaatcaaggagggtcacttgcagttgcagctaataatttgctgggcactgttgtgatctgcctacgtataatccacgttaatttataggttcattgatcggggagtatattgtttgccttcggcaacacgcgacaaaccacgagcaacaacattgttcgacacaaaaatatatcatgtgtacatgtgattgtgctttttttttttttaccttgatgctggggacggtgcatctgtcgcgcgactaccagccataaaagctctcagtcgccgtctgctgtctgctggcagggagagatatccacggtgtgttggagtttctaattcaagatcttcttactttagccaataaacaatcatcttctcttaattataatcaattcactgacctacgtttgaagccatcaatgattcctctgatttttcacttttcctttctttcttcttctctgtttcttcttcattttgttttttcttcttcttcaagaaccccttttagggcccctttaaatcgtaggaatgaaaaagcagaggaataggaaaaacacaggattctgataggaatataattgtaaaacagaggattgcaaaacacatgaaaaacataggaatagctgtttgattggactacaggaaaaacgcaggaatcagatgagagagatagactcaaaggaaatattacaagaggttagacctcttgctaactttcctccaaaatgtgcataggattacacattccataggaattttaaaggattggataggattcaatcctttgtttcaaaggttttcataggatttttttccataggattgaaatcctccaaaattcctatatttttcctacaaatcaaaggggcccttagtgcctagatcgaacgggcgattgtattaggattttaagattagagagagtttgactgtgacctctgccattgtttatatgacgatactagtggggctcaggggtattatctccaactaaaattgagtccttattttaccgatcacaaaaaaaaaaatctcttatttggtttcttgttgggaaatgaaaacgatgggattttatccctttcctaactaactggcattagccgataaaatcaaccaacacggtgatcaatctgtcatcgtttattttcctttttggatttagtccttttgcgattgtgttgttgccagatgattatatcgcttacctaatgtgccgcatgttaattaatcatcatactttctaacttttcttaatgagtaaatttcacaaaactacatatgcttgtgatggttgattttattgactcactgtcgataaggattaggaaagagattaaccaccaatttccttcccaatcaagaaagaaaaaaaataagcgattagattttgttttgtctgatcggtgtaaaacagaattccaaactaattggagataaacccccgagccccaccagtgtcgatatatatgagaaataggaggagacgcagatgtgacgccgaatctctccctgaaccctaaaccaattgtctgatcggttagacactggaaggggttcgtgagacatctctagacgaagaagaagaaagaagagaaacagagaagaaggaaaagcaagaatcaagcataaatttcaatggcttcatctcaggtcagctagatcaattaatttccgcataatcagaaggtgatcatgtttaggctaagactcaaattaattaattagattaaattacaacagcttggaccaaattttcacaaaactacaaatttaaatatgtgtatcacaaaactatagatttagtgtcaaacatttcacggaactacagatttaatgcaccattcacaaaactacatatgtagtgataaagttatcaaagaattacatattttagagtttatccatagcacgattatttatgtaaagttacaaaatctatagttttgtgaaaaatagttgttaaatctatagttttgttacataatacttttaatatgtagtttcgtgataaatttggcagtaaaactgtagttttatgaaacacattcttaaatatgcagttttatgatagtttgatcaaaaaatctgtagttttgtaaaatttactctttcttaatcttgactttttaagttgttggagttatatgggccttgtccatgtaataatagaacaatcaaaggcttacctaatgtaatagttgcatgcatgtgaacttcagtgccattctgttgatctactaagaataaatatcagtgtataaggaataatacattcttctcgctacttcaagaataatactatcagtttataaggaacagtgcgctcttcttgctacttaaatcatgtggttacgagagaacttgagtaacacacgctctcacatgtggcttagtcctggtaagcggataagggctcctagcttgttacatcattttagctataatatcaaatttatatatataataaatgtgcgcttatattttcaacacgacttatcagattaataaagtagcttcaacgaccaaagaatgaaagaaagaacctacacattgcttggcatttggaaacacgttaacttttgccgcatgcaacatttgcagcttttttatttttaattctgtggtgactatgttcttttcctcttcggacaaatcgaatgtcggtatcatgcctgcaggaactgattcctttccagctgtacaatgtgtagtgaagattgagcttttgcttttgttcaaagattgctggaaattaatttcatcccttccggacactagcacgcaaacactacatcaataacgactactcacatttataacgattaaaccaaccttacaacccaatagttacagacatagagactcatatgtaacggcactaaaaaacgtggagctgttacaggtgtgaaaattcaacttaaaaaaagaaaaattaggctcataagctatcacagatctgaaaattcccaataataataataataataataaagaaaaatcaccctgtctccatcccccctcctagcatcctacctaggggtgaaaacgcggtatgcaaagttcccgaccgtaccgataccgtttccgcaaaactaatataataataatatttttactgatgttaccgttttcaaaatttagtttttttaatttctgtcagcgtagcattgaagttggcactaaatagatgaattcataaatatggaaatttcccgaccgtttcattcattttcgaaaaaaataataaaataatgtaccatttccgaccgtttccgaccgtttcatccctaatcctaccaccgatggccgttgcacgatggtgcgaacgggtgtgtggggggagggaaggaaggatggtgcggccatggctggggcgcgcgacgagggcgtctatgtaggatcgagatgtcgactagagggggtgaataggtgatttaaactagatgagacctaatcaaaactaacctaagttgttaggcttggtgagggacaatgtaaactaagcaactaagttaagttttgcaaacctcgggtgatatgggctcaagtatatcactatgaaagtaaataacacgctaagttagttttgcaatcctagagtgatatgggctcaaatatatctatatgaaagtaaattgcacaaatgtacatgcaaaaggtaaatgagacaagagacaaggagtttttcacccgaggttcagaacctcgccggtttcttaatccccgttgaggcgagcccaacttcatcactcaaaaccacgaagccactacaagccctcttcatcaatgtagcacccatattttatcgcgcacatgtcttgttgcccgccttcttccgggaagccaccgagctcgcgcctccctctctctcgcgttccatcgccaccgcgcgtgacgtcgcccacgtcacctcgctctgagaactctaccgcccaaatcccggccgtagccatcatcggtcacgcgtcacccatgttccaccgccgttcctgctctccgcgcgtcacctcatgtcgcgtcgccgtcgttttcaccgtcgaattgccaccagtgtgtgacgccactccatcacatcaccgtcctctcaccccggaatcccgccctagctgctagccgtctacccccgaaatgccgtgtctagactgccagctcgccaccgcatcacccgcctataaaaggggaacccgagccccttccttgccatcaccatctccatctctctctcctctttccctctctcgttcacctctttgtgccgccgcctagagccaccgcgccccgccttcatgtgccgccatcgccggcggagctccgccgaaggtagtcgccgccttccccggccgccggtcgtggagccgcacctcgccgccgcggcgtgccgcctgtgccccggctgggtcgagcatagcgagaggaggaagaagagaagccgagccgagccactgccaagccggtcccacctccctttcctctctcctgtcactgatagccgggccccgcacctccctctatccctcaagcagcagacaagcctgggcccgcgcatcattccttccatctatcattgacaggtgggccaaccccttgccgtccgcctttagcgatgaatattccacggaatattccttttccgtttaatattttgatttccaaatattctagaaaatccatttatcctttgaaaatccatag

SEQ ID NO: 44081 - DNA, 7019 bp, Oryza sativa
ttgaaaatccatagtaaatcaaccccgattgaccccgttcaagttcctaattttttttaaaaaaattgagatctacacagtggcatcattgtttctctgatttgagcttgtgtttattgctttttgttaattagtttcgcttttcacgtttagagcccgagtacgagaaagctctggacgccgtttttgagggagaagacccccaaccctgtgcaagccaagcctctttgatcacattgcccctatatttactaatatatgttgtttgaaaaatgcattgcttagttcacacgaataacatgttttggcctcggattgtttatacaactgacggactaacctagtagccgcacttatattttataggttgatgtttccatacctttgatagctccacaaatgtttacgacggtatcgttatacgattaccaaggtagttttgcttagccatgcttgtttaaaaatccggtacgttgtaccgaggagttctgaaataaaatgtgttgtgaaagtggtgatgatgcagagtcatgcctttgtggtgtgccaatggttgtggaatgccgagaatgaggagatgaagttttacacatttttgcccatcatgggtgtctttttgcctctattgtggcatggtgccagtaggagtaggagacatcctcggtatttcctgagtggatgacggctgtccttaactgatactcggctatggatcttagcctttaggtggcatgtgattttcatgggttagctttagaaatgccttatcacgaacttccattaccgacgggtaaatggtgtcagtttcgtgtcgtgtgggtaaagcgtgcaacctctgcagagattaatgaactgttcgaatagccgtgcccacagtcaagggcgagtgtaaggtgtttctcatagcgtatatttgtttgacaaaggtttatggaaaagtggttattgggaagggtaacgttttcagagtccgcctgtgtggcagacggctaacctttgtggttaggaacgggtctgtgagacctggggtatcgtccgacaccgaggtattgttaggaccgagttggtgttgatgtgctaagataactgtgtgaactttgtgttgttgtgaaagtgaaaagaaactaatagaggaaacaaattaactgttgcttgttaatgtgacaagttgttgcaaagcaacttgtggaatgggtcgaagcgtgatgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaaaaataaacagcagcggactagcggcctacggctccatcttcacaggcgctcaactggggtataagccaggactccacctaagacatcttctccaaagcttctcttactgaaggggggaaagattgagcaagaatgagtacaaccacagtactcagcaagccacaccggcagatgcatgattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgattcggaccgaactggcaacccgacctgggttccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctctgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaacataagccaaccattccatggtgtccaaatgatatgagaattcccaaagtctaaagttataaaaccacctaatgttgcctaattattcagcgaagcatctacctaaatttatactagtggaaccatgaatagagtacccactagttggggttcttattttcctagggtgaacaaggtaataataacaatagcaataataatgtcataacaaaggtaagtaggcatggctaaataaaacagtgataacgcgggaatttaagcaaagcgataatacgataatttaaatcaaaataattttataaactgggattcaatatgctcaagggtgatgtgacttgccttgctcagagagaacggccttccgaaccttcggcgacgaccgcgaaccacgcttcgggaacctccggaacgacgaaagctacgcgaagcacacaagcaaagctacaagcctatgaagaagcaataacaatacataaaaacaaagcacagggttctttaggttataacaaacattaagagacttgaacgggtcgattcggagttcgtatgaccaaaatatgatcatccgaggtttaatgctgttatatggagatttgcggattattataattaagctttgcaactataaaacaggtgtaagcgctagcctggaaaggacaggaaggctgcgccgttgacatgcggaccccacatgtcaacctaaaggactgcggtagaccgggtacacagaggcggtccacgggtcgacggaagcggatcccgtgtgtcaaccgaggcgagtggccgacaaacggactccactagacaccacacgggttgcacacgtggaaaccacgcggctaccgagcgggcacactaacacggacactacacggtcaccacccgcacacgtgaacgactaccgacaccggtacacgggtaccggggtcgacgaccgcacaacgggtacggggcgacaccgaaaggacgagggcggggaagcgagaggacggatccttaccaccacgcgacgaggcgcgggaacgacaacgacgaacgggcgcggcggagacagacgggcacaacggagacgaacggcgaggggacggcttcggcggcgatccttggacgaaggcgagacgcggccggcacgaggcttgacgacgcggaggcgaggacgaagacgatgacgggggctgcagcgaccttgacgaagcgaggacgacgaacgggaacggcttgacggagggacgaacgccacgacgaccgggaacgacgagaggacgacgacgacgacgacgaccgggaccggcgagggggcgacgaggggcagccagcagcagctgcacggggacgaggacgacgtggaacacgccgctacgatgccgacgacggaggcggcgccgcgagacgacgagccgggcgaccgatgggacgtcgacgacgagaacgatcggagacgacgatgaaacaatgatggcaggcagcagcggctgagcggaggaggggacggcgtggaacacgccgctgcgatgttggtgaaggtggtggtgcagcggggcgacgagccgacgaggaggaaggagaggccggcgcggagacgacggcgttccggcgaaattcgggcgaggaggaggtgatgccggggaagaaggcgatgccgcggtgtcgaaggaggagacggcggcgtcgatcggcgcactggcgatgaacagcagccggctggagggagtacagtggcaccaatgtcactggttgccggcgggggcaccgttccggcgagtttccggcgaggagacggtgaggccggtgaaggggacggtgttgcagagccgaggggggcgacggcacggccggacgatgctccggtgaggagggagaggcggctggaggtggccggcaaggaggaatgagaagggcgacggcgggagtgcgcctccggcggtcaccgcgcgaaacggagggtaggccggcgaagaggaggcggctgcgatgctagaggaggcgacggcgcggccggccggcgcacgggcgaggcggcacaggcggctggaggtcgccggcggcgtgggagagagagggcgacggcggggatggggctagagaccacggggaggctcgggatggggttaaaacggtagaacggagtgcggggatcccattttatagaatgggggagggagccggccacggggaaggtcggaacggcggcgggaaagccggccggcggcaatggttggtggccggagaaaacgcgggcgttcccggcgattgggggcgccattcaaggggaaaaacgggggaaatcaaagaggaatcaatggggattaattccccccaatcaattttggaatccaaggcttaaatcgcgtggattcgagggaggaacgaagctaggttttcggggagagagagaggaggccggctgggaggaggaagaaggcgacggcgggctgacgcgtgggccccgcgcggggcgcgcggtcagcgcgcgcacgtgcgcgctcgggcgggagggcgccgctcgagttgggccgggcggccggcccagggggggggaagggggaggcggcttgggccgggcggctgggccgaggcaggccgggaggaaggaggggggggggaaagagcccgggagagagaggggggggaagggagctgggccgagaggggaggaggcccaagagaaagagggagagaaggagagggagagaaagagagggaggaaagggagactttgggctgggcttggcccaaaggaggaagaggattatttttaggtttttctttttaataaactttgataattgtttttgttgcttaataattatttccggtgctctgaaaattcatgtaaaatttgagggctctttttagaccaaggagaatttaacaaaaattccccgggccacatttgaatttttctggcacgtattttagtgtttgccaatttcttttcgaatttttaattaattctattattccttttagcgaatgatttttattctcgggatgaatttatcaggacgtgacaaatccaccccccttacaggaatctcgtccccgagattcgaggaggctagcaagaagataggttgggcggtcttctcttcttgtctgacttcttccgctccgtcttctataacaaacttgcctagcacaacttctccactctggactgcttggctcgatctcctgttgcagatggaatcttctcttcacctgacttgtccctggttgaacctttagctgacttcgactgggttgcggcacttgaagatggggcttcagttccagaacttcgcatagctcatatctttggggtcaacctcatacaagttaccacttcatgttatgcgtcgatatcagcttgtcattactaggataccatgcttgttatttacttctaacttaccactattcacttcatgttgtcctcagttagcattcagcgtattcctttacacctttgaccttgatgtgttctttcccgatttctcttatcaatcacctttcgacctacttctttgcctggtaataaacatctttttcgatatcttctatcagtcatcttttgacctttgtcgctaagtactcttcactccgagagttgtggatgcttctggtggcgatgaggtcctttggtttgctacctttcagtgaaaccttgaagtgtttcgccaaaagctatacggactgtcattgcctttgatccgaaaaagacacatctgaaactcttagtccaaacaaatgtctcttgggttaatcacttgatttgcttcgccatcaatcgctaggttatttgattcataatagattatgagcttacggaaatgagaccctaggtctccctaatcagcaacaaaatgtacacaactcacagcacttgcaatcctaacatggatccctcaataaacttatcaagctcattcattatctcatgtttctctgttattacatgattgacggggaacaactataaaacataagtatatgattactgatataagagtattatggttgcttctgactagcgctaggcttaacaggtactgcatttgctccagtgaccacttggcgattggcacgtctgcttccttaacaggtactaccgttgtaaataactttcttacgcttgggttcttcatcctgtacttgatttcttggctgctgtgctggaacatccaaaggtacaatgccgatactggcctctgtcttgtcaactgatggctggggctgaaattgagcattgacaccttgtggtaatgcactcgctggagttggagctgttgcaacgcgggctataggactgcttcgggatgcatggatgacaattcgttgaggagcaagcttctgattgcagggagttgcgtggactgacgtgctggcagctatgtttctcggttttgggcacttgtcggcgaaatgacccattccttgacaattgaagcaacagatgtcttcccggactcggcattttcttttctcatttcgattcctctgtcctggcactggagttaggctgaaactgtaatcttggcgaggattggtgttgccttgatgcttctctccgttggaactggcgggttggttagccatcttcttcgtcagcagaaaactgaattgacaatcttttg

SEQ ID NO: 44082 - DNA, 23033 bp, Oryza sativa
tggcccaaaggaggaagaggattatttttaggtttttctttttaataaactttgataattgtttttgttgcttaataattatttccggtgctctgaaaattcaagtaaaatttgagggctctttttagaccaaggagaatttaacaaaaattccccgggccacatttgaatttttctggcacgtattttagtgtttgccaatttcttttcgaatttttaattaattctattattccttttagcgaatgatttttattctcgggatgaatttatcaggacgtgacacgtgagcctcctcccgacaactaaaacttgactcacaaggagtttttgtgaaataaatcactttgccaaaagggcagctttcgcaaataaaaccttagcctccttgtttaaaccgaacatatcattctttcccctggcttgctgagtacgttaaatactcacccttgccccttataataagctatagagttcgaagacgaagacgtcgacccgaccgttgaggagtatctctacgagcaagccgagtatgaagacttctagatgtttcgtgcctagccccaagcctcgcctgtggaataagttagttgcctaggttctttgcctagtgcatagttgcttagtcgcttagtctgtccgcgttgttcgcttatgtaccatcgctttatgtttttctatgatgttgtgttttcatctatggacctatccatgatggcaactttgtaaggactactacccagtgatgtaataaagtagttacttagattccacatttattttgtgtgtaccagctagtgtatcctgggactggtaccatctcacaagtaatgcataacaccctggtgtgagttagctgtgtttatggctaacgaatgtcaaggcgttacaatcaagcagtgggcaaggtgggagtaggccctcgaagtgaaatacccaagcctcgatcactagggtagttcttccttcaatccaaaggtggtgaattctaaaccactcacaaccggcgctgggccttctccacaatctccttggagaggtcaccaggcaacacctccacaagccgtctaggagacggcaacctccaagagtaacaagcgatgacccggctcgcagatgatcaagcgccacactatctttgcaatcaagcaaatgcacttgactcttgactaatcaaccctcaatcacacctaatagatgaacacaagcactagagagtgtgagagagtgtgagagagtgtgcaaagggtgtatgcaagagaagcaagtgccaagagagtccccttgctgctggtgggggagtgtttatacccccaccaacaaaacctagccattagaggagaaatccctcaactatgtgcactgccgatcagatcgccattgtctggcaggtcagaccgaactactttgtaacggctagaaaactagccattacagtgcaattattgatcccactcagcccaaccggtcagaccgccatacggtggccggtcagactggccacggctcggtcagaccggccatggctcggtcagaccgccactagctctgtctgaccgactgtggctctggcggctcgggttttccaccccagagcacaccacctaggcccacagccaccttccaaggggtcggtcagaccggcattgagccatcggtcagaccaacatctacccgccagtcagaccagccccagacagagagaaatgaatatagattgagaaccaagtctaaatacaaatgacctaatgtggcattttaatcatctctttgtttaggtcattacccctcttgatagtacggcaaagctataaatacaactagcaaattttgatcgcctaactcctcgatcaattaaaataaaaacctctagttttaccatcttcgttccttttgctttgcgccatcgaatttagtccagggtaatcatccatgaacacatatcacgtggtcctaactcaaaatatataactcaagagaacagttagtccacaattagctcttgtcattaattatcaaaattaacaaccggggcctagatgcttcagtcagcgacgaggagtcatgatctttagtacgtgttgaaggaaactgttgtaaagatatatatatatatatatatatatatatatatatatatatatatatatatatatatatatatgtgggattgtgggactcgaactcaagatctctcacctcagccctcacgcgcgttaccatcccacctactacacacatctgacttcgataaagatactttctttttaaactaaccctagagacatctttagtctgggttgatgttaccaaccggtataaaacgtgttgccaaccggtactaaaaatatctttaatccgggttgatgttaccaaccaatactaaagatgcatttttagtaccagttggtgttaccaactggaacttaaggtatgtttagggacttgggcttttcgaactggtactaaagcatatttagtaccggttcatcaggtatatttgtgttttgggactaggataaaagatttctctagtagtgtacggatgtaagaatatgtgctagtgggatttagctttcacgggtgcagagaaatcaatttctaggaacctagcaacggctttcatggtcatttgttgaaccacctttagccaagtatctacaaaaattacgtattgtgcacacgcacaaaagagccatgcatcccatgaaaatactaaacaaagcaaaggctctccatgtcacttctccttttaatcctaacgatcgacccaattcttcaagtactagacaaagcaacggaggatggcaccttatcatgtctaagtggccggcaagctaggatgcgaacatccctctacgcagatgatatcgcaatcttcgtcgcaccaacctaacgggatgttttcatccttagctcaaaccctagaggtctttggtgaatccacgggcttgcactacttagaaaaagcattttacccgatgtggggtctttttttcgcaggcagatatgacccttggagccaaatgaccgcctacaaaaatataaatcggggtgaaattcgctgtcagaccacttaagcggcgcctgcgaaaataattttcgcaggcggaccatttaagcggtccgcatgcaaaaatcgtacctaccccaaaaaaaaaacttaactccttatcttctcctctcaccccctccccatcactcatttccctctcaactctctctctctccctccctcaacacttctcctctccccaccgtccgggcccatcatccccctcccctccctccctccccgccggagggggagcgacggcggtggcgcggacgcagcggcggcggcacggacacggaggcggtggcgtggacggcgactgtggtggtgcggagcctgtggtcggggcgcatttttttgttcgtccagaggattttcgcaggcgggccattgggtgatgattttcgcaggcgtttatctacaggcggtccttcccccgcctagaaaaactacttttggccgcctgcaaaaatgctttttctagtagtgttgagagctaattcacctgcggaagagtcaagtggcaccaattcactgcttttagattaacctaaacaacatcatgacgaacttccttgccacacaaggtgatttcctgatcacctatctaggcctacccctctcgttgacgaaacttgggaaagcgcatcatcaaccgctgataggcaaggcagcatacacgcttcctccttagcagggaaaactcctcaaccatgcgggaagaacaactggtcaaaacggttctcatggcccaggcgatctaccacttaacttcaatcaagttacctaaggccatgttccaagcattggacaagataaaacgaaaactcctttgggccggtagtgtaaacctctccggtgccccccggggggatgcaaaattaactggaatacagaccgaaagacctaagtggtctcggcgcactggaccttcaacgttttgctcgagcactaagctctgcgctggctttggtttgaattggtggcgctagacaaacctttggtgcagcatgccggtgccttgcaaattgcaatgagaaatactacaaggctatgtttaatgcggcaatggaaatcagggtcagcacgacaacaagacgatcttcttgaacgacaaatggttgaatggccaaatcccgtggtccattgcaccgaatatctacgcgtctcaagaaggaagaacatatcagttaactaggctatttcaaacaacaattgggtaggtgacctcctgtctatgcactatgccacggcccagcattttcaacaatttgtcaagctccggatgcaaatccaaacaatcgacctgctgccaaacaccgaagactgcatcaagtggaggttcactgagcacggccaatactcgtccaaatcagcctacatgatacagttcaaaggagcaataaaaatagttttttaagaacatcatatgggacacatgggcaccatcgaagtgcaaattcttcgcctagctaatcatacaaaatattgtttggatggctgacagattacaagcgcgccaatggcccaaccaatggttctgcccactatgctgagctacaccagaatatgtagttcaccttctgatccattgcagattgacaagaagaatttgggactcagtcgcagcaactcagtacaagattggtggaacctcctcctcaccttactgaacgcgccaatgtagcccataaaatccctaatcatccacatctcttgggagctttggaaggaaaaaaaaactccaaagtgttcatggagcttgcaaacacaccaatgagcatcctggcaaaaatcaaggaagaggccacactgggtagcggtaggggtgaaaagcttatctgagttctgtcctctaggagagtagaactcagagttggtccgggataaccgaaactcccaccccttgaggtaaataatgaggtgaaaaattaatgtaggttattccttgatgaaaaaaggcaacagtgcagacaacaaagtcattcctgatgacactgggcgacttcctccacctcgctgcatcaccactctagctcgtccttcccaaatggtgacatgcaagtgatggcgccgcatagtcaccaacgccaacttcctatgttgctttgatcaccccgtccgtggaaggttggcaagtactaccatcactgcctccgatagtcatgtcctaacaactaccatagccgcaccttttgtccgttttacctcaccgctagaaatgattggcctcgatgcaaactacttcttccttgatttcatataacaccccgatgttcggaccgttaaaaactattttaataaaaaaatctattttcaaacattttggttgtttaaatgttattaaggacataagcaccaaaagattttagttgaatccttccttgcgaccattaaaattccccgtccaaaaatccctatcaaaatttcaatcataggatttgaatttctcaattcgaaattactccaaagttcttccaaaatttgggccagcagtataatgacgctagggcaaccggccgctccctcacttctcttgctaccacctctctctgttgtcctctttcgctacccaccacatataaatccgtggtcatcccctcttcttctccaacctcagcccacagcgccgtgcttcaaccctgagctcgccgccaccgcaagggcagactaccactatgggacgcgcttaggctaggccgggcagcccacgggccttcctggccgggcagcccacgggccttttctcctttttcattcctccgatgtccattttacccacctccgacctgaccgtacctgtcatcctctaaatcaaatccaaattattttttcgaaagtcttaattttctataatcccaaaaatgtttttgatttctaagctccatatctttccatctgtagctccgattaatccaattcaagtctcaatttttcttgaaattgagatctatctatcgacgagctatactcgacaatggtatttatagagtatggggtcgtttgtacctagatatacacaagattataataaggagaccaatggaagaacaatgatttatattgatttgggttctcaggatgagtaacaactctactcaagtttatatgtgtatcttgaaaaaaaacaccgtaccatacggattacaaaggggagcaagttagataatctaacctgccgatttggatatgccgagtacgtctcgatgagttggtatcgacaactaaggctctgactcttccagattatctctcaatgtggctttgactatggcttgtgattcgatgtttctcctccccacaacgggccttgtatttgtacggatgtcttctccaagtagaatatgggctgaacaaaaccttgtattctttgggttgaactccaatgtcttttattcccacgaaaacagtttctttcctgactcaccttattaccatacttgaatatacatttccgtatatcacgagaatccatatatgagaggtatgtcttacctgtaacactaactctatctaatactattagttattaataatactacatccgtatcatattataagttgttttgacttctttaagattgactaaatttataaaaaaaattagtaatatctataatacctaaatagttttataaaactaacatttaatatattttaataatatgtttgttttgttttaaaaatggacatatatttttctataaacttgattaaattttaaaagtttgagaaaaaaattaaagtgacttataatataaaacggagggagtagtattttatttttaagttattttggttctctctttttcgtgcgtactcaaacattgacgtacggagattagttccgacgcgaatattcgaagattttgaagatgaagaccgaggcatgtcactctttgattacattgcttccagattatagaatgtttttgcaaaatggtatggctaatgtgaacgataaacctgaccggtcgcttgacgggccaagaacacttttcgacctaaggcatcaatattccgccagcaatattattgcgcttgaaacatcatgcaacgcaaagtgaatgcatgcaactgtcgaaacagttttggaccagccagaatcaatccacatctcatcagcatcgtctcctcccactaatctgatcagcatccgtagcctgcaaagcccgcggccatggcaactcgcaggggtaagccaccccggcatacttgttcctctcatgccaccgctccaccgccatcgtctccagctcgacggagaagagccaagtgtcctccaccggcggcgtcagcagcacatacgccgcgctcgccgcgacaacgatggcttctccgttctgctcctggaagtacccctcgtcgtaccctggcaggccccgtgccgccgccggcaaccaaacccgcttctcgagcacccactcgccgtcgccgtcgagctgcgcgaacaccttgaggtcgttgtttatcacacggaccacgcgcatggcgacgccgtcgccgccggcgatgatccggaacgtccgcttgtcgtagctctcgcggacgttctccgggaacgtcacgagggagaatcccgcggtggtctcgtcgaggacgagcatgtcgccgccttcgtcgccctcgatttcccagtagacgcggccatttgcacgccccacgaagctcgtggcgtcgagccttacatgctctagtgtgacgtcgccaccggcggctgtgctgtgcggtaggcgccagccgccgccgccgctgccggaggtgaacgtgcaggccaatgtctcgctgagagggagaatatagttcagcaggtaacgatcgtagagtgcgcagatgaccttgaagttggacatgccgatgcggccgccgtcgccgtcgccgtcgaggaggaagacgccgaggcactggtaaccgctgaggtcgggaggacagaggataccctggtggcaccgcgtcaggggctcgcagacgacgatgtcggggaaggtgaagcagtggcgccgcgccggtgagccgtcgccggtgcgttgcttcatcttggtgaggaggagaaggccgccgcgggagtcggcgagctcccaggagtagccgctctcgcagtccgggaggaaatcgagggaggagaaccggcggcgatcggtgtcggcgagctcgtcggaggggacgaagacgaagctcctgccaccatcagggaatgcccccggcgccgcctgcctgtcgtacgcgtcgtcgacggtgtggtagtgcccggcgacgtggtgggtcgcgccgtggagtgagcggaaggcgtcgaggaagccggcggcggtgacaacgcggcgccaccgcttgcacgcgtacgccgcgcggacgaggcaggcggaggagccgaggcagaggaggatgtcctggaggaggtggtcggggacgtcgtccacggtcgtcgtcgtcgtcccgccgtcgacgaccttgggtgggtcgaccggcggcttcctccgcgccttgttaagcttgccccctcgccgaccgcggcggcgcgtctccgtcggcgtcgcgtctccgtcggcgtcgccatgggcagtggcaccaggtgtgtgaagacgtgacgtgactgtgtgttagggtcacgcgcgagagagattagtactaagcccacggccacgatctcggtcagcttgtttgactgacgacgcgttttttccttattaagagcgtgtgtagtgtaagcgtggggcgcgcggcaagtacgtcgcgtaaaaagctgactccatatgcgcgtggatagctgcttcgtccgctagaatatctggaaaatgggctgcacatgtattgcatggttgaacgtgcgggtgacgaggaaagcgtacgtgggtcattgtcgaatatgcttcgcatgccactaattaagctcgaatttgattaactgaatcttttcttcttgaaactgattgtgtgtctagctagacggattggcttagaaaatttgggcactactttaaaacaatcatttttgccgtcggacaaatcagttataacacgaggctaatccccgcgaaaatagtgtattttcgtaggtcgcctaagaaagtatttacaaagcgcaaaaaaaaaacctaacaaattcaaaaattccatattcgagcatattcaaatgcccccgatccattcaacaaatttattcatcaaattcatcaaatatcacacaaagcaaaaaaaatttcgcccggtcgaagccgccggcgcagcctgagagccaccacccaacctaccaaagccgctgctagttgaagtcgaagccgctttcgagaacggcctgaggcgtcggtgatggacccgctcacctgagactgctgggtggtggatccatgtgccccaagctagctagcggcggatccaaccgttgtcgtcgtcgcggccgacggtggatccaggcgctgttgccatcgtcgtcgcggccgtcattgttgtcccggccagcggccgatccatgcgcccaaggctagttggtggcggatccagatttttgtcgtcgtcacggtcggcagtggattcatgcactgtcgccaccgtcgtcgtcacggccagcgatagatctacgcaccgtcgccgtggctatcattgtcaccgcctgagggaaaagaggaaggccggatgagttggtgaggggacagggatggaggtggaggagaagaggagatggaggaggatttggccactgttgtaagctcaattctggccataagtgattgcacatatttagtagtagttctgcctagcttcttctctaatgtcaaagggttcaaaagagcatcgattttataacataaatgcatgcatcccttgcatgattttcaaatgattttaaaattttcaaacaaaattttgttgcagaggtcataatatcatcatatagctctcttcatgaacatacaacactaaatccaatctacacattcaagaaaagcaagggccatgtttatatcatcttacaagattaaagggtattattccaatcaatagacacagatgttagggcaacgaccatatatatccaaatcttctacaattcacggtgcaagcgcttaaggtaggtggccacggaagctcacacggatacgcaacacttgcgtacttgcattccgtcacctccatggtctcaaggtcgatggagaccatccatgtcgtcttctcctccaccggcgtcacaacagcacacgacgtgctcaccgtgacgatgtccactccgccgcaaaaacagctctccttgtagccttgtagcctacgagtagcctccaccaaatggaggctcttctcaagaaccaactcatcagtgtcgcacaaccatgtcacaacacggagagtctctccctctaagacgacgacgcgcacgttgtgacggtcgccattgccgtcgacgatagctcgcagctctgaccctcgcacacccgctggcgtgcgtaaaatgtggggatcaatcccattctcatcgagaattagcagtgacccttcgtcttccttgatcgcccagaatatcgagcccccagcatggccaagaaaacgaagggaatccctatcatggagatggataccgggtctggttctgagatgcgtgacgacgacgtaccactcgaaaagcttgggtacctcatcatcttcgtcgggcttcatgtgccgggtccaatcccacatgtcctccatgtactcgcaaacagtaatcgtgccaacatctccggacacaccgaagtatggctggtacaccacgcatgtcaccttgaaattggacatggagaagctgccgttgcggtcgaagtcgaggaggaacacgccgacgcagtggtggtacttcatcacctccatgcgagggatcaccttgtgccgccgtgtgaccggctcgcagacgacgaggtcggggaagcagcggcgcatccagttggatttctttttcttggcgaggaggaggaggctgccacggctatcgacgatctcccaccgcgagccgccaccggggaggaagtcgagggagaagcggcggcggcggcggccggtggtgagaaactccggcgaggtggggacgaacgcgacgctgctgcagcagcctctgggtttgggagtagtgaaggatggtggatggagacggtggtggtagtggcccacgatctgatgcggtggtatgtcgtagtcgaggacgaagctctgttgggtgatgactcggcgccaccgctggcatgtcgccgcggcgcggacgagcgagagagacgaatcgaggttttggaggatgagctccaggagcttgtcggggacgtcgtgcagcgtcgtcggcggtggcctgccattgccggacgctgttgttgaccccttggtcgtcggcctcgccgtcgccggtgctttgctgctgttgtttgtactgcagcaaggagctttctcctttgccatgtataggaggagatcagtactgtactagctacactactggatgttcagatcgatatctaccatggattggctatatgtatatataggttgtaattaagtagccacacgtttgctatcttgtcctacaattaattaaactaatgtttttggtgtgtgatttcgcacatgctagagtagggaagagttccctccaagtagtttcgctagctgctgagttcacattgttttttgtttcaaaagagaagacccagcattgctggtggtgttatattagaattttgcatactttagctagtcagcaaacacgctttatggcaaagacatgtgcctgcatgcgtgactgagtcgtgagtccataggagaaaaaaaggagctgctttctaaaagctagcgagacaagtggagaagaacttatcttatcttctcggcgagaaaatcaagcatatgttcttccgacaagcatctgtacatattaagaacatttcactgtacaggagtattattggagcgctaattttctgagtcgcctgcaaatcaggcgtccgatttttttctcaaaaattggacgctgtgtcactaagtagactgaaaatatttcgctaaatagatcgaaaatgtttcaatcttttaaaaagctgaaacacaacaaaatcacctcataaaacattttgctacaacatatgaaacaacggtttccacaaaatcgggcgttgtttcaccatatataaaaataatattttagcaaatagagaaataatgtttcaattcttaaaaaaaaaagtgaaatacaattagatcgctagatgaaacaatttggtttaacatatgcaaaatgattttaagccattgcaactcttaaaccatctgcatcaacaaaccacgtgtcaatcaagataaaattattaagacagtatcaaaaatctacagcaatttttggtacatacataatgaaacatcatgagtacactagctgaaacattgttggtggaaaaaaaataaaacggattctcctaatagggcgtttccgtaatatgcaggtgatttgctgcaaagcgtgcgtggtgggggtggcgcgtgaggcgtgggagccgcgggagtccgattttttctccccacccccccatcgggcgcccgatggggaggattttccctaattttcttagtcacgaacttaggttatatacatgtgacctaattaagtttatgtgtcgaatttggtaatatttactgaccggtgtttgatgaagccattggagcaagcagtgtaagtaccacacttgataagcttaagtcggcaattaggcctaccaaaagttgtaggaaacaccctccacagtgtatttggctttaaatagagtttttttactgacaataaattttatgattcaactcatgcttttattcatttctgccccaatgctgagaacaattaataatcgcacccccatccccacctatcaacaactcattcgtactttccccatctccaccactccaccgagccaactgatcttctcttctcccactacaactatgccgcatagtcacccaaccgatgagaaacacgactcgtctacctcatcgatggtcgtggccagtgtcgtgcatccttccctttgcagctccttctcttcctcaacagccaattgcctttccccatccacacacgcaaacctgggggtggcgcgaccggcgagctccgacatgcacaaatcaaagccatctctccctctcatgatgacgaggaagtagagaggacgacgaggtgaagaagaagaatgaggggtcgacgtcctcacggttcgtgctgacgatctcgagctcccctcctcatcagcggtctcgagcttcagacccggtgacgattgaggggtcgtgagctcgacagaaactactcgaccacgagtctggcagtggtgcggcatagagctaggggctttctccctggctgccgagacgagctctctttcctccctctcccatggttgcacggggcatgaccattgttggatttagtcccacatcgttaattgatgatgggggagcacgacttaaaaggggggggcaatacttacccatcagactaatcttttgagttgtgtattcccaggagctaaatttgtggctccggttgagcctgtggtggagcaggcccagttgtgacatgggtggcccaccaacaagtggtatcagagcccaagattggaatccggaacaattttcatgggtcacatggtggggagcccaggtaagtcttcggggtcaaatggttaatggtttgatgtgatgcgggaggttgttgggcccgatgtgtgataggggagattattgggtttagtctcacatcggtaattgatgatgggggtgcagtactcacccatcaaactagtttttgagttgtgtaggcccaagacctaaagttgtggctccgattgggcatgtggtagagcaggcccagttgtgacttgggtgtggcccatggttggtggcccggattgcgcactgtaacagctagtgtgggccggtaccgacgatgctgacaaattcttttgaggtacgagtgtctaagtttggatccgcgttcttcatttggtcatgagagagacatatatatacgtgactagaaggcacgcagcggagtgtgcttaacatcctgagctcgccgagtcacggccttgcaggagcatatctcccaatcgctgggccctattggcactagtctatttaaccactgatctagttgtgggccaatatcatagctgagaagtaagcttcccggccttctttctcgacgttgagcgttaccgctgttcatcttcgtccccaacaaaagccgcaatgacatttctccccatggttttgctatgtagttgaactattttcggtaaaaattggagggtaggctagagcctgatggagcctacctgctagaatcgccattgctttcgagtgtagaaggtggtcagaagggtgcgtttggatccaaggctagcaggggcctagcctggccaggccagtcgtttgaaatcagaaaaaaatcctagcctgtgggggcgagctagcccataggagcgagaaaaggctggctcacaagggagagctgaactatagggcttatagatccggtcaatttgcaatcatcctcctccccttgctgaactctcaggcatcctcatcatctgcagtaatcccgtgcccttatataaatgtagtagagcctccagtctccacgtagtaaatcggagagcaaggccaactcgatttgaggagagcttgttcttgcagaagattgctgctggacacaagattgctcgtggtgagaacagagaagctcccagatttgatttcttccaccggcggcgcctcgtctatctagatttgcaggtacgaggacttttttcttttattaaatctctccatattcctgtaatgtggtttggcagccccaggttgttgaggaaatgttgcgatatgtaacgccccgattttcgttcgggattaaaaaaaaatcatttaataatgcattttctagaaattaaataaaagttaaaccaatttaatcaagtggaattatggaggaaattaaaatttcctttaaaaatcattggccaggaatattctgtaatattctttgtgccctaatgtactctctagaattttccgtgaattttcggagctcaagaaataattttaaaagcacaaagttcattttaaccaattaaaaaaaaagaaaaaaaataaaatcccctcccctcccttttaggcttggcccaaaccttcccctcctctcccgtgggccgcgcgcctcctccctctctcggccggcccgtgccttgcgaaagtctgctttacgtcccccggtttccctcctctctctccatccggccgacaggtgggaccgtggaccccacctgtcagctcctccacctacctctcgccggccaaccccaaccgccattgccggccacgtcctgccaaatccggcgccctcccgctcgcgccttcgcgcccaaaccaagtaaaataggttcctcaccacctcctccaccaaatccctcacttttccccaatttttggcgctaaatcgagcccccacttcgcccacgatgtcgcccacgtcgccggccgttgccgcctcaaatccgccacgtccggccacgatttctcctccccaatcctataaaaacgatccccggagcatcctctctcttttcccctcctcacctgagcccgccgcgctctctctcgccctccccatgccgctcccgcgcgccgccgctcggcgtcgacttccagccgtgcgccgccgccgctccagacgccgccgcgttgcgccgccaccaccgttagcctcgttgtcctgagctccatcccggcatccactttatttccccgaaccaccgccgtgatgccgtgcccgcgcgcaacccgagctgccgtcgcttttgccgcctctggccgcctcttgctgcagcgcccaggccagccgtgcctcgtccgctgctcggtcgtcgtcttccgccgctccaacccatcctctaagttcgccggtgagctctacctcttgtcgtcgccatcggccttcatttccagtcaccccgcatcggtcctcccctccctaactccctcttctccttttgaaggtcaagggcgaccccgtccgccctccgtcctcgcaagctgtagacccccgatttcggaaatcggaaatcttctgtgtttatccgtaccaatccctggatctgtagttggtacacacatacatagttggatcacaacatatcatgagtgaatttaggctaaaagagataaatacttacattagggccaggtaggccaacaactatcagagaacaacagcagaaaacaaaataatataagggcccggttaacatgccacaggcagtcgactagggaacgagacttagaacaagaccgcactctgatcatcttgtgggatacgcaagcgtacctacaagggcttctcttcaacactctcctaaaagatatataaatagcaagggtgagtaccaaccgtacttagcaagccaccacaacaacaatgcatatgatagaggatatttcaaggaatggcttcaggttcttctacataaagctaattttacatttcttttcacaaacctaaaatctagcatagactgatcaaattttagtaccagtgttcactttaaataacgacggttctgtccaccatctattgtgatccaaaggatagcttcccgccattgaatcatcgtggttttctaaggatgtccaccttccctcctctcgggaagtggctccatcagcataaaattcatcatgcaatatcccatcccccacaagttaagaatttagagtgtagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccaggaaagagaagtctcacacgcatattaaattatggttcaagttaagttctctctctcacacactcatggcagtcctaccaatggcgacaccgatgtagggcacgcttctcggccctacctcaacggctgtcccatcgtagcgcacctgcctcactcaggggtgaaccatctatgcagggatactgcctccgctcggctatctaatccgctaggtctatacctattcgagaagtacggttgtacgggggtcgtttcatgcttaacttcatggcccagtccttaattgaccggggacggtactagccttttccagataccacccaaatcctccgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcattattgcatgcaattttatttgtaaacaaaacaatttcgcaattgggatcaacatgttcaaggaatagtgatgacttgccttgctcaggatagtccttattcttgatataattcttgatcaaccttcacctcctggaagttgctgacgttgcctcacgactaaccgatatacacaagtctataatacgcgagaaaaaccaatattcaagcaacaatcaaatatgcacaaacaaaatatatttgttgaggttgaacctaaggttgctcatattattcgcgcttgctaatgggttccaacatgctaagggctaaagtctcttaatctttctgttatcatggtggtctatttaggagctagccaatatagtatgaatgagatacgtatctggctaatttgtggtttagtctagctaatggctatggaaggattatggctacacatgcatctatctaaataaaatggtcgtatactagaggttctgttgtcggatggatttaggatcaatcaaataattacagtgaatcatttgtattatttattttattgatggaagctttactttaattatgaacatattttacttgtcacagtaaattataaaaggttaataattatccatgctttgtatgttagagttgtttaggttaatcatattatggttacagattatcccatcacataattttacaatgagtaatcctaatttacaggttaactataattataattatatgaggtcaagatttataactagtatttatctaatatacatgtttgtcatacactccctcttaatttcatatatgcaacacgcaaattaatactataccgtaccactataatgggatgtatagtatatgtgtaggcaacaatatcttattattggatcatatatttgagtagtttctttttactgtaagctatacaatacatgttgattttaagatggctctgtttggttaactaatggatatcaaccgactctatatatatatattctacttcacatgacattgtatcaactaattttttttaagtggtccaaatacaactagctctgtgattactctcctaaacaagttaaagattcttctatgtgtgtttatattttagttacataatcataaggctatacttgatttaaataacctataagccatggatttaattatatggccatcgaatattaaataagtactagtattttcctatacatccattcatttgagacatcacataaaattagtttgtgtggttgttacagtggcaagacatgttagagacaaatattattacatccactctactgtacaatactaattttatttattagcatatttttaagttgactattatgcatcatcttgatattaattatttaatatttataaatatattttatcaaatagtgaattatatatcattggaaagcttatgaatttagatgaatttaggttcaagtttcactcaaatcggagctgaaatgaataagttatgctagtgtaaagattcaaatttgaattaattctaataattgcgaaatggtactgctcctaattcatttatttataacacaaccttatccacaagctatagtgactgacaggtggggtcaaggtcttgattttcttttctacagaattatttttctaagggaaattggatggaattaatgataggtggggcccactctaacctctctcccccattctcttttctctctctcttctctgttttctctcttctctccctcccggcttcttctccctcctctctctctcggctctctggcgacaacgaccgagcaaggggaggaggcggcggcttaccgacgacggcggcggcgacggcggcacgatgacagcgacggcgcggcggcacgaaggcggcggtgcggcggcgccagggcggcgcaacggcggcgcacggcgtggcggcacgaaggcggcggcgcggcgtggtggaggggaagggggaaaaaggaggggaaggaggggggagtggtgtgggatggaagggcgaccgggggagggatttatagggcgcggggaggggtggccggctttaaacaacgacggaacggcgtggcgacgtggggcttggggcgacggcgacgcgcggcgacgggacggcgcagcgcgacggcgacagtgcgcggcgcgggtggggctcgaggcgctgatggcgacagcggtgacgcgatgacgcggtagcagcacggggctcggggcgcggcggcggctcgtggcttggtggcgcggcaacggcgcagggcgacggcgacaggatggcgggtgacgcaacggcgcagggcgacgggcgacgcgatgacgacggcggagcgtcgacgggacggcgacgcggcgacgggacggcgtggcgcggcacggggctcggcgcgcggcgatggcgacagggcagtgcggggctcgagacgacggcgacacgacggacgcgacgcgcgggcgcaggacggcgtgacagcggcggcgcgcggcgcgaggcaatgacggcgacggcgcgcggcgcggcagcggcgacgcgacgggcaggcggcgctgcgcggggcgcgaggtggtgtgtgcgcggcgcgaggcgccggggcacggctgcgaagccgacgcaacggcgatggcgacggcgcgcggcgcggcgatgatgtcgatgcgacggcgacgacgacggcacgcgcggaggacggatgtgaccgacgacagcgatggcgcgcggcggtatggagacggcgcggcgacggtgacatgacgcggtggcgcggcagggcgactgcggtgacaagacggcgcacggcggcgcggggcgcaaggcagcggcgcagcagagggcggcagcggcgtggcgcgcgcaggggcggcgcggggagcgagggggagcacggcagaggaggggtggtggttagggaaccaaatcaaacacctagagggctaatgaacagtgctagccaactgtttttgattttatagggtattttgcaattaggaaaaatatactattgccactaattttgtcacaatgtaaaatacaccaagcctaagttaatccatcgaaatttgtattcaaatttaatattgaacatatttttatttttattatatatttttctaagtattcctatttttagggctttggtttatttataaattgagaaaagttgcaaattaaatttgtatttactcctaagcagttgagtgactatattaagtgctcaaatgtgaattttcccaaaatttaatatggtccaatatttaatatatatcctagatttttataatttcctatatttggggattttggtatttatctgttttgacacatattggtttatctttttggattggttttaccactacatggatttctataatttagcatttgtgattcaattcaatctatataatatctaattaattttcccagtaaaactattctatagatagagtttcatttatttgaatgattatcatttcctaagtgtttatatttcatggcacgcatcacatggttcaagtattcaatatttgatccataaattaaattggtaattaaccttccctttgtctggctttgttttctcgtgcgtaaatatttatggggttcataataaatattttattattataattattacttagctgtataactttagtttaattttccattgtgacaatttatagtttggcaagtaaaagcaaccataacatccagcatgatgcaaaaagtgttaaaaagttcaaaattttagtaatttttattgttgagaattttcaggatgttacacaagccgccatcgggcaatcgtcgtcgccgtcatcttcctccgcgccggccgccgcttccggtgaggacctctcctcccttcccttttttttcccgtccccctttcttgccgaccgccgcctcttggggtgcgtcgccgtccccgtgcgcggcgttgtcctccgaccgcccgccgccattccacgtcgccggctgctgccgccggtggccgcatgccgccgccgcgccttggctcggccggaccggcttcgtgccacgcctgtgcccctggctgccgctcccctcggccgcccgatcggctcaggctgatctgggccgtccacgtggtggacgcgcacccgacgccacgtgtggaccatgtccaccgtgcgccctcccgctttgactcgctgacgtgtggggcccgcgtgtcggcgccggccgccccttgctgacgtcagcgaggtccatttcctttgtaaaaataaataataattgcgcaataaatcgagtttaattcttaaaattcatttaaatggctcaaaacttctaaaattcatatctaattcatacgaactccaaattgggccattcaatttgcaaaattcatctaaaattgatctctacatgtttgtttaatttttatgtactattcccttggtttttattagagtttttccttgttttgcgtgccagcgtgtagttcccgtcgtttcggaagtccgcggtcgcgaggaaaagagttcggaagatcaaagtgaagaagcaaggcaagtcacacattccccttgagcatgttgatcccaatttacaaatgttttactatttgcaaataaatatgcatattttgctaattacatggggtcagggttttacctatctgctcgcttgtgccatatttacttgatatatgtcctttgtcaacattgggtaataaatcgactagcttaggttacttatgtgacctagctagaactatatgcttagccatgcttaattaccactagctcagttgatgggataattaccgtattagaccttttagtatcagaataagctgcgtgctcgagacatctggccatgcttcatggtcataattatccaactaaaatgtgactgaatggtgggctgtgggtgcatggttttgctggtcgcacccatggcagttaaggaccggttcgtgggatgccctaaaagaacttattgtacttaccacaagccagcgtgggcaacggctcggttgtagtgtagctttcctctagtcgacacatctaggcaagggtgggcgtgatggagcggggcgggccctgcgacggcctctgtcgctttcggattcacctaggcacgagcggggactacccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgggtcttgtgggtacagttgtacacctctgatcagagtaaaactatt

SEQ ID NO: 44083 - DNA, 5557 bp, Oryza sativa
tacaaccgcctttatgcaaatagccacaaaccatccttgtatccccttgcacatctgcatcgttggtgtggcttgctgagtacggtggttgtactcagtcttgcttttattccctcttttcagaagtgtagtgcttctaagctgaagatggagttagaggaccaaggctcagaccccagttgagttttgcctgtggagtggagctgaagccccgctagaatcgcccttttccgctgctgtcgttctgtttcggtgtgaggactaagtgcctcttccgtaagtattttacgctttatttacgtttggaactatatattacttgtcgttttgtgtaccctggctggtcctggacagggatttaatacgcaaaatagtctggaaatttgggttaaatttctgggcgtgacaaagtggtatcagagccaactcgactgtaggttgagccaaatggtcaaaccctaagaacaagttttctaaaaaccctatttgtaaattgtctcctctcgcccttcggcatttctttgtcaaacggtttttcaaaattctcctcccagtctctccaattcttttagttgtcacacctagaggaccagccgtcaacttcatgtctgttcggaagtcaagtcaagtcaagcctcaagcttcatgcaaggagcgagaagatcagttcaaagtcatcgttccgcgaagatcaagtgaagttttctcggagatgacctaaacccaatccttcccaggagggtagtttcgttagcttctagatcgtgtgttgtttgcttgtgtgtaggggtatggtttgcatcactggtggggatgcgaccatactaggctgtttgcttaaacaacttgaatcataaaatccattcacaagagatcaataggcaagtggtttagtacctcatctctagtaacccctcccatttccccctctctctggtgcctgcagcagatggtctgcatgagggacaatttcatcggatcaagaccccgttagtttcatggggcaactcagtgcaattctaatagtattccacgtcagcctcttgaagatcagcctcaaccccaagtcatggctaatcaaactcagacagtggaagagttgttacaacagatgcgacgtcggtaccaaatataccagatgcaacaaatgcaacgacaatgtcaggagtcacgtcaatgtcacccaccgcaggtgcgagatcagatgccagcccggaacccgaatcagagtcagagtcaggagttcccaatatcggcaccgaagacccctgtcaaaatgctgtccagatccccgaagataacgacagccaagtcaacgtcagaccaaaggaaagtaagtgctacctgttatgactgtggtgagcaaggtcattatgtaaggaactgtccatggaaggtgttcgccaggtcacctgaaaaagacgagaagtagtgcccagggagtaaccaagctccaagtcagtctaccgacaagaaggatggtactttgcagcccaactctggagcgaacaggacagtgatatggaagatggataatggcaggaccatgatcatcaccggttcagaatttactcctgaagacgcagcaaggatacccaagcgtcagagaggaagaaataccttccgaggagcgcgtcagctaacccgtcatctcataaagtacggtccgcccagacccgaagatgatgaatcaggagaacggttttctgctgatgacgataacgacaacgatgatgataatgatgacaatgatgatgcgacccttgacagtttcagggaaagagagttgaagttcaaagcatgtgctagatgtgggatagtcggacacactgctagtttatgcctccccacatgccgctgtggtgaatatacccattacttagatgcatgccctttaaggaaggtcacatgtttcttgtgtgaaggaacagatcatgtgcctaagaactgtcagttgaacgcggtcatagctaagaccaagaaagaacaagggacaatcgtgcaacccattcgtcaaccaatgacaatcgacaacagcggtcacaatccttctgctcttcctccaactccagctccagtggaagccaaccatggaagaagcaacgtcaccaaggatgttcataagtctctgcttgttccagtttcagttgccaaagtgcataatcagaagcctgcaccccgggaccaagcaggtcgattctgtcgcaactgtcgtaagccaggacatcgtttcagtgattgtcctcttccaagagcagcaatggcagttcgtcgtgattcacaagttaccagcactgcccatgacaccaatcgacacctgaatgtgcaacctccgccccaacggattatcgtcaagggcaccgtcaaaggtcgcattgttccaccggcaatcgtttcaagcctacagcaccaacgccagcagggtaagcaatgccaggagaacaacagctcgctacagctacaaagaggcagtacgctccttcgtcagcacccgcggcaagtgttgtcagcaccaggtcgcccaactgttgtcagttctagcaatgcacctcgtattgctccaatctggaggcccatcgacaaatcaccgctcggtaaccccacgggcaagaagatcctacccgttacagctgacaagacagttgcccctccaccatcgaagatcaacaagcagagcaacgttcccggtgagacttctggtagtaggaactaaagaaacaagtcagtcaggtttgaataatggaagcaatagcagttctagacaagacttctacttttcaagttcagtcgtgaaaagggcagttctaatcagcaacagtctacaattgtttgattttgtagtacttctcattatacatatatgtttatggcagccatgtaatgaaaaggaaatattgaataaaatatgagtcagccagttcctctccttttatgattcatcttcagcatgcaaaagcaaatcaaaatgggtatctgtcagtgtctcaagaaaccaagggtttctctcctaactcatcgcaattctattgagctccaaaacctgtttgcgagccaatagaggaatggttaaccaacggagtgaaaatggttagaccctcaacactcgacatgatgagatctctctaaaggcaacatcagtggtactcaaatgaaaacagggatggaatatttgaaagtgacatcatatagagactcttgggaaatctctaaccttggaagctgttacaggatggtaatcggcaattacgccttagtgttgtgaccatgaatttagaaggtgtttgcttagttcaaggcaaccaatataagttccaggaatcatctcaatgtttctcagaagttgaaaaaaaaaagaaattgttccatacatgagtctggaagatacgagagtttggtccagaaatagaaatgtgtagtcaacaaggtatatggcatagaatctcttttcaacaaatcatctttaccgaagatatggatgcgaagtggttatgatcaaagagcagaaactctcggcagcatcaaagtcagtttccgatagttgttcagattgcagtattttccggaaagctgttgcaggatctatagtccgtcaacccaggaagagttagcaaaggatggtcgaagaagtgaaatgtcatgccatggaaaggacctcttgagttggatctgttgggtgatcagtgcttgtttcaaggaatgttaactatgcaatctgtttaggcatatgacaccaaaaatcaagtcagaagcaagaaagttgtaccagcagttagaactggttggggaagtagtcaagagttagtaagatcaggagctaaatgagaatttctttatgaggaatctcccatcagcaactgaggattaagttccaaatcttgctgggatgaaagtgcgtcgtcattgctctattttgatgaatcggtgaagtttcagttttcaaagtgagggcctttgtaagtaagagaagtgttggttatttttcaaggacaatagtccaattgttcctagtcaggagaaagtaagactactccctgtaaggggggtaggtctcggagatgagttttggctcacttcgtcgctgttttagtgaaggttcaacccagtgcagcaatccgggtagcacttgaagaagcctgttgcaaggtatcagaagagctaagccgatctcagggcatccgatgaggccagttcaacagcttagcttagagaagcaacagtgaggacagttgcagttcagacgaaagacaggtcaagcaggtttcctggaattacgtgtcactcgagtcagaacccgttcaagcggacgtaggatcaatgagttacaaaggtcagatgcaagtttcaggaacaacttcatcctcttcgagtcagcatggtgaattgtcaggttaccaaaattaccaacctcaacaattcagtccaagataagtaagttccttaagcatccacagccctgtctgggtcagttgaagtagaaccagtcggtccagtcttgcaaagcaaaggaacagaaaagttgaatcaatcagttcagtcgtgcaagtttggacaatcagtcaatcagtcagttcgagacagaaagggggcagtgcagtatgccgatccgtcagatcagtcaaaccgcccgccagctccagctttctttctagccatcccagaatctcgggacgagattcctgtaaggggggtagatttgtaacgccccgattttcgttcgggattaaaaaaatcatttaataatgcattttctagaaattaaataaaagttaaaccaatttaatcaagtggaattatggaggaaattaaaatttcctttaaaaatcattggccgggaatattctgtaatattctttgtgccctaatgtactctctagaattttccgtgaattttcggagctcaagaaataattttaaaagcacaaagttcattttaaccaattgaaaaaaagaaaacaaataaaatcccctcccctcccttttgggcttggcccaagccttcccctcctctcccgtgggccgcgcgcttcctccctctctcggccggcccgcgccttgcgaaagtctgctttacgtcccccgatttccctcctctctctccatccggccgacaggtgggaccgtggaccccacctgtcagctcctcctcctacctctcgccggccaaccccaaccgccattgccggccacgtcccgccaaatccggcgccctcccgctcgcgccttcgcgcccaaaccaagtaaaatcgattcctcaccacctcctccaccaaatccctcacttttccccaatttttggcgccaaatcgagcccccacttcgcccacgatgtcgcccacgtcgccggccgttgccgcctcaaatctgccacgtccggccacgatttctcctccccaatcctataaaaacgatccccggagcattgtctctcgtttcccctcctcacccgagcccgccgcgctctctctcgccctccccacgccgctcgccgtcgacttccagccacgcgccgccgcgttgcgccgccaccaccgtcagcctcgttgtcccgagctccatc

SEQ ID NO: 44084 - DNA, 11689 bp, Oryza sativa
tcaacattgggtaataaatcgactagcttaggttacttatgtgacctagctagaactatatgcttagccatgcttaattaccactagctcagttgatgggataattaccgtattagaccttttagtatcagaataagctgcgtgctcgagacatctggccatgcttcatggtcataattatccaactaaaatgtgactgaatggtgggctgtgggtgcatggttttgctggtcgcacccatggcagttaaggaccggttcgcgggatgccctgaaagaacttatcgtacttaccacaagccagcgtgggcaacggctcggcttgtagtgtagctttcctctagtcgacacatctaggcaagggtgggcgtgatggagcggggcgggccctgcgacggcctctgtcgctttcggattcacctaggcacgagcggggactacccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgagcccgcggttatgggcggtcgaccagattcaccgtgattagtcccatcttaataaatcgacccaatacactgtagttcaggtgggttggttgggcctgttcaacgtggtgtagcgttgatcagtggagatttaatgttactttaattactcaacagttttactgttttgctcaataaaatgttttacaaccgcctttatgcaaatagccacaaaccatccttgtatccccttgcagatctgcatcgttggtgtggcttgctgagtacaatggttgtactcagtcttgcttttattccctcttttcagaagtgtagtgcttctaagctgaagatggagttagaggaccaaggctcagaccccagttgagttttgcctgtggagtggagctgaagccccgctagaatcgcccttttccgctgctgtcgttctgtttcggtgtgaggactaaatgcctcttccgtaagtattttacgctttatttacgtttggaactgtatattacttgtcgttttgtgtaccctggctggtcctggacagggatttaatacgcaaaatagtctggaaatttgggttaaatttctgggcgtgacacgatactacaaggagaggatactggctgatggaagacaacttgtatttcaagaagtctatcatgaggaatgtgcaaagcaaattaatggcaagtatcacacaaacttcacaagtcgacaagtttatcacatgtttcacaagttgaaggctcagtggaaggtgattatggaggcaaagaatttgagcgggccgtgcaactttgatgatgttgagaaaaaaatcctatatgatgagactgaagttgttcgaatgactaatgttagtgttctaactattctttccttgcaaataactatcgtgtttacactatatggatgtctatgtttctgacatttttcttgtcatgtgtaggccaaagataaaatggctaaattcattaacgtccccatacgttggtatgatgaaatggagtttattttttaagacaagcatgcaacgggggaatttaatgttctgtaaacaccatatgaccattcaatgactgaagatgatgattttattggtgataaaaatggcagtcctggtgatgttgactcttcatgaaattatgactcagattatcttccagatcaagagaacaatactggaagtagctcatcttctaggcttgtaaaaggtagaaaaactgataaaggtaaaagagtcagagctgatgataatgtggtttatgagataacaggggctatggataatatgtctgaaaccatgcgtttcacacatatgacacatccaaatgaatccctattcaagataattgatgagatgacggaatactctgtcatggttcgacttgagctgcagacttatctcgcgaccatgagaatatagctgccatattgaagggtaggccactggattctattaaggaatatgtggtccaatcgataatacaaaactatccggctgctatgtaatttctttgctaagatgcttgaatattactatgtattcaagctaaatagtttaagaatgacacgtgcagtttagatattatttaaataattgatatgctttggtttgaacttgaaataaaatagttcaaaaacatatttgattgtttcaaggaattcttttagcatatagctttgccctttttactacttctatccgtaatatttttgtggccaagttaactgtggaagaatctgtagtgttcttgtgacaaagccatcagttaacaaaatttgatctgtgtgcaatattattttgctcaatatgaaaagaagcggcgcaaaatactctgaagaaccaaacggctagccactaattcttgccatagaaagcaaaccaaccaaacaaagggtatatgcatggcaagcccctggcaagctggcaacgagttggcttgcccttacccagctaggctaggtgggcaatggaaccaaacaaacccttaagtttctataggtggctaagctagctgccatcaaccgtaggccagcgaaaatacacaattttcacaactgggctttcattcaaccgctattgaaagttgattttcctaggcggctaggtcaagccgacccgctagctgctgcaagtttgttctaggccagtgagcaaatgtcctgacacgttcaagatgtcactccgcctgaggtcagctgtacaaatattaaatatacgtcacctccacacggagtgcagccgatgaatcgatcgtgcacgaacagttgatatcaaaccaaacaatgtcattccatatcatcgtccaacgccaagttgccaagtcgttgttctcatcgatatctgccgcccgcgtgcaaagcccgcagcaaaggcaactcgtacgggtaagccacccccgcgtacttgttcctctcatggtggcgctccaccgtcatcgtctccagctcgacggagaagagccacgtcttctccaccgacggcgtcaggagcacgtacgccgcgtccgccgcgacgatcatggcttcgttctgctcgaagtacctctcctcgtgccccggcaatccccgcgtcgcctccggcaaccgcaccagcttctccagcacccactcaacgccgctacccgccagctgcgtgaacaccttgaggtcgttgcctatcacgcggagaacacgcatggcgccgtcgccgccggcgatgatccggaacgtcgtcatgtggtagttctcccggatgatgtccgggaacgtcaccagcgagaactccgtggtggtctcgtcgaggacgagcatggcgccgtcgtcttcgtcgtcgtcgtcgtcgattccccagtagaagcagccaccggcgcgccccacgaagctcatggcgttgaaccttgctgtgagctggatgtcatccgcgacggcgctcttcggtagccgccacccgccgccatgtctgcctgacgagaacacgcaggcggattgcacgccaatgtgccgattgtttaaccagtagagatcgtagagcgcgcagaggaccctgaagttggacaggctgatgtcaccgccgccgtcatcgccgccgtcgagcaagaagacgccgatgcatcgatatccagtgaagtcggccggacaaaggataccctggtagcgccgcgtcaggggctcgcagacgatgaggtcagtgaagaagaagtcgccttctgctgcatagccgctgcgtgtgtgtgtcctcctcttcttggagaggagcagtaggccgccgcggctgtcggcgagctcccaggagaagtcgtcgctcgccgggagaaaatctagcgagaaccacaggcggccgtcgacgccggcgagcgatgacgaggacgggacgaagacggagctctcgccgccgggcagcgccggcgcgtagtaggcgtcgacggtgtggtagtacccggcgacgcggtggtggtgcgcgccgtggagcgcgcggaaggcgtcgaggaagcccgcggcagtgacgacgcggcgccaccgcttgcacgcgtacgccgcgcggacgaggcaggcggaggaggggccgaggcggaggaggatgtcctcgaggaggtggtcggggacgtcgtccacggacgtcgccgcggcggggacggccttcgccttcctcggcgcgctgccgcagttactagccttgtccgcgcgccggccgccgcggcgcgccatgggaaagaatcgaatcagccggtgtgtgaaattaacggtgatgtgaaattttgattgtgaggttggtgagcgcgcgatttgaagctgccaaccacgatcactgctggctattgacttggtcggcccatctctgagcgtggcgcgcccgccaagtctatagctgcctgcgcgtgggcaccaaatggtcaagttcagatgtacaaatatacacaattttcaatctgaaagtgtctagatttcaggtgtgatctccgatcacttgcctaaatagaaatttgaacaataagttatttaaacataaacatcaattgaacttatagttcataaaaaatataaaattacatgcaaaagtattcaaacataggtaagaaaaagaattagggtcaaaatgtgctaaaactgcatattacaaagctatacaattctagctggctgaaaatttataaatttacagacgcatgaagtcgttaatttaactagcttggtggcccgcgcaattgcgcggctagcagccatacaaaattatctattttttaatataattttacttaaaatttcttaaacagttatctcattgtcttaaaagtttgaaaaatcaaaccttattatctccgtatttctaattttatagtttttaaaagttatatcagttgttgtcccttgcttctttctcaccctttcttgctcgatctatcactatttctatttattttctttggaacctttacaaattggaccttgtaatttgttgagtttattgtcatgttgggtttcgtttttataatttctagaagtcccgtcaaacgcttccattatactcctctacgatctttccgtcgtctcctctctttattataattgaacataattatcgtttcggttcatttttttctttatagaagtcccgccaaaccgtcaacagttttgccattgtattcatctacggctcgcccgttgccttccctcttgtcattgagaagtcctgccaaccgccgtgaccgtgtcgcttaatggcctgccatcgtccatctttttaattgttattgggattatattcaggattttgttaatagtttctatatgtcccatcgatcgccaccattatactcctttgttaaaagcctcctgcatcttccctctttatcgtcatttgtcattattgtattctagatgaaattttcttttgaaagttccatatttttcgttctgatattttttttgtaaattatatttcggctttgccattggactactctacggttcgcctgttgcctccccacttctcattgagatttttgaatcgaacatgattatcattgtggtttatttttttacttttagaagtcctgccaaacgtcgtgaccgtgctgcttaacgacctgccatcgtccctccttttaattgtcattgggattatatttgggattttgttaatagtttttacatgtcccatcaactgccacacttcactcctttaaaagcctgctgcattttctcttttactgatatttgtcatcgttgtattacagatgaactttttttttgaaatttccatattttcattccgatattttttctttataaattatattcctagttgaactcttataattatttttctgtattcagaatttattttatttgttctgaatttcaattaatctcgtattgtgttatatattgattattcttataatattctttattttttattttctaattcagttgtttcgaaattacattcctacttgaactctcttttttttctaatttcagattttttttatttttaattcagaattttaattaatctcgtattgggtttttatatggactcttctttcaatattgtttagttttaattctgaatttcagttattatttaattgtattcttacttagacttttttttctaatttcagattttatttattttagtttcaaattttaattaatctcatattggattcttatatggactcttctttcaatattgtttatttttaattccgaattttagttattttataattttattcctacttaaactcttcttttattttttttaattttattttttattctgaattttaattaatctcgtattgggtacatatatggacttttcttttaatattgcttatttttaattccgatttctttaaaatttgttcctagttggattctttttccatttcttcgattattgtgagaatttctaactcctgcaaacgaacatggtgttttctttcaaagccgattagtctccccctgttgtatgcatgcggacatgtccgactcataatttgattgctccagtcacctcaagcatccacatgcacgaaaaaatgcatgttgtctgatgcctctaattactttgaattttaccgatataatttaagaaagaataggctagcctcaatcgtatctcttctaagatgttttctatttgcactctgcttattatctttccttttttactttgaatttcagtttatttctaaattatattcctacttaaacttttatttttcttatttttttctattaatgtgagtttttttagatctcataacgaacgacgtgtcttcttttaagcgtgtgaaaaatagaggacattgacgataaaaaaaaagaaaacttgaagaggtaaaaatctggcgatatcattgactttaattggatttcattcaccggtcataatgtgcccgctatttattttatcagttgttgtttgaatacgtgaatacgttatcggcagttgtgctgaacttctgttgattgctttaggatgttgggtaatcaccgtaggattttgttttgattctgttgattgcttttttatgctaggtattaatcagtataggattctgttttaaattccacatcaagctgtgtcatatatcctgctagtattctgtttcaaatttactcgtgtcagttgttagctgccgccgccatacatcaatccgatatctaacatgtaatctgccattgcaatctgataatgtctctgtttctattgcgccataggtgaaacggactattattttccaaaaactcatatggactccatctaaatctgaaccattaaaatttagactgatcacgatctaatggataatatttttctcttttctctgattaacgtgggaatttctaaccccaacgtggtgccttcttttaaagctgttttaataatataatagatagatagatttcttttgctgctaatgtagaaatttctaaggtttcatttattcttcaaaattcttgcaaactcgtacttttttacaaatcgggccactgcaacctagcacatatagagaggactataaagcaagtacatatgtacatatgtacatatgtattatacagcaaaagtgctcgtgcgttgcaccgagtgattacgtagtgtgtactatgaaaaaagtgttgtttggtttagacaactaatctgctaaaaaaatgtttgtttttagataaataatctgctctatatttgtggagtatatatgatgtttagtttggatgaattgtagcatgggagaaaatggatggacgaataatgcaattgtctttgcctaaaacgcgacggacggatgaaaatttgtatcataaacgaaattatttactttttatgtaggtaagtctaataaaacacgacacgagcattgagatggacaaagtaactacgaacgcctcgagcaccatgtcaaatcaaagatttgaatccaggttgactggttccaccacaagaaacctatctagttaaactatactcacttcgtaattgtgagaatatacgtgtgtattgttacctgaagaaaatttgtggagtttaacaaatcgtaaaaaataatcttattaattttgtgaaagtgagtattgtttttatttacaaattgtatttgaggttaaatattaataagtagacatgaaaaaatgaaaaaaaaataaaagaagattagacggagggaaaaaaagagcagacaagggaacaaaaataaaaaataaaaataaattgtatttgttaggatttagtttttatatttcttataaaaattaaaaagttgtaaaaaaaagcccattagactaaaaccgaacgaaaattaaaaacccgcccctataaatctctatatttgtcgggtatatggcatatgtgatgttcttttttcaaatacagagtgctcatttgttttaaaaaataaggctcgtcagattggatccttatccccgaaagagcaagcggagagcgagcggcgcgtcgatccttccgtcttctcgttttatcccacttgccttatttgccaaccaaataattatgtgtatgcatataatcaacatgtagtaagtatcaagattgttgtttgggttatgatcaataattaatttagcacatgaaaaaatataatcacttttagaaaatataaagaaaattagaatatgctatttcttttgtatagatgaagtaataaatagacaataaaaataaaagcaaagcagggaggaaaagatgagagaaaatttataaagcaaagcggtcaggagagggggaacaggaaaaaaaaaagaaaataaaagaaaaagaggcggataagcactcgctctctccgtctctcgtttcttcctcgctctctcagtcaccggccagaaaaaaaggacaaagcaagaggaaaagaagaactccgactgtatccctcctcatctgatctgatagcagtagccagccagccactgtccagaatttttttgagaattaatattatttttatggaaaatcacaaaagtagtggtcaaccggggaaaatcgcgaaagtaggtccctgtcaaacgggtgcagttcgatagggcgcctatcgaacggccagagcgcgactggcgaggagatcggaaggctgccgttcgacaggacctgtcgaacagcccccgttcgacaggcagggctgtcgaactgcccctgttcgacaggatatccgtcgaactggcgcagttcgacagggtcgcgttctccatttatttattttttttaataatatgtaatttattttagtgtgtaagaaaggaaaatatttttgtaatgttatatgtatatgatttagggttttgataatgtttggtcagaaattgtagtatttatttgttggttaaaatatttgaattatttagtttcattatttgtatatttgaatgataatttgtcatcattcattcgaagggtatgctactgagtaattatccgaagaagtttatgaaatagtactgatagtactaagttaatcgtaaagtgtttctcaaatagtacggacagaacagaaatgactaaaagtttaatacaaatagataagtcaaggacgatcagtgcccttcgcacgcttgctaggtcctcccttcttcctacgcctaatctgctcagtgggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttccccctagggaggatcagtggaaaagaagtcctcaatgaatgctgtgcgaggggagtaagcaggcattccgtgatgcgtcgacgccgaaccgtactcatcgtctgtttgcacaagagggagaaaccaaaaaatatggcgtagttagtaacgatacatataattagaaactaaagcgtgttattgtttaaaatgacttacatgcgtgctgtgtgtggccctgctctggcgcacgcggagtgatatgaagtccccatgctggtgtgttcaacacgttgtcccccgttggcatgtaagggaagtgtgccgacccagatgctccctgcgaggggtgaacataaggcggagtttggaatacctgcggacgtggtggtgccgtgctcgacgtgggtacccctgatccggctgaccccctggtgtactccggtgctggggtgtgctgaaaggaaggacgaccgtgagatatgtgggccgcttcgtacccgcgacgtgaagaggatggaccactccgatccacgctggaacgtcggggtagtggtggtgatggccgtcggcccgacgtctgcaccacatctgccgcgctccgacaggagacacgacgtagtagtgcggcagcacgtgcacggaagttgcgaaggatgctcgccacgtcgtcaggcctgacgactggaggtctcgcctctagtctttgcagcatggtgtcggactccacgtgaacgtgctcaacaaattccgcctgttccacaaataatcaaggcaattaaaattatttaaccagttgcacatttattaagagtatttaacaagatgcacatttgttagaaataatgaaccagttgcacatcatttataaatactgaactagttccacatttatgtaagaaaaggaactagttgaaccaattgcacatttattagacatactgaactacttgctaactttttaaaaatattgaactagttgctcaaattccacaaataaacacgtaccattgagttgtaagctgatctaggctgaggggcaaacgtgtcagtaatcgctgcctggtgggggacggtgctatctccttgtcgaggaaaacacctccatcgtgtaacactgcggtaccaacgaaggtaagctccataataactcccatcgtctggaggtgtctgaagtgccaagttatcagctgcatgctcccactcttgtaccgtcggctgaaccgtggtcacaataactagctcgtaggaaagcccgagcccctttctggagtacctgcacaacaacaaattcacacatcagaaaaaatgttgtgcagtgatttattttaaaaaatgtaggattagacaactgtgatgtgaactaacctatgaagactatcagccaaaggacgaccatctctcggagggaagtcctgatacatgcccaactgtttgagaaccctgtggacattgtgtggctcgacgtgcacgtccaccacgaggtgacaagtcgtcatccagagttgcatatctcgcgtgcaaagatccgcgagaccgtgcggtgcacgatcattgacatcgtgctgagtgtagggagtccaccgaacacggtcaggcgtaagctgatcaaagtcagctacaaactgagtgtagacacgatgtgtcgtcccgctaacccactgcggctgtaacaagtagtagttttcattagtcatataaggaaggtttgtgaactagtattcataatgataacataaacgaatttaacaaaaaaatacctcacggtgtgtccacaaggatcccatagtgggacgatcgtcgatgtcatcaacaccagacctgtacatctctcg

SEQ ID NO: 44085 - DNA, 5191 bp, Oryza sativa
ccgctgcacgatccactcctcctggtcattagggaagacatcctgtcgaaactgattcaaccaacttttcgtaggcccgtgcccatctgtgagatcctccagtgcaacaggcagcacaccaccaaaactggccagaaggtcatccgcccatccagcattcaccattgttgggccaactgctggcccagctattggcagccccaacaaataagacacatcctgcagagtgggcaccatctctccaactgtgaggtggaaagtgtgggtctcaggcctccatctatccacaagagcactcagaagcgccgcgtcaatgtggatccgttcggaccttgcacgtgaaggctcgaccaaccgtgcaaacgtcaacaacccagctgctctcagtctacaacatgacagagcgcaagttattaatatatgaaaatataaacaccttatattagtaaaaacaatatattttcacacaccttggaacccaacgaggatcaatacgccaatattgatccggtcctcgcatctttagcacattgcagaaagttcctgtactaagacgtcgcgatcgatggttcctatcgatctccttgtctatcagctgcccatcatattgatcagccatacctgcagatcgaaaaccacattagtacaatgcacgtatggtaacagtacagtaaatgtatgcaacataattcaagtaacaaatttgcatgccatttcaatttaaaattacagtaccagcacacatagatacagataagaacagttcagtacatttcaatttaaaattacaagcccaggacacatatattatgatattacaagtgtagtgcagttcgaaatttaaattacaattccaatacaaatacatgacgatattaaaagtgcagtgtagttcaaaatgaaaattacaaggccattacaaatagattcgggtaataaaagtgcaagaaagttcaaattaaaattacagacgcactaaacataaattgaacgataacgatcttcaaagtagagagtccaccaaggataatagtgaactaaggattatttttcttcttcgacttcccctttggaacgcgacgaacatcagcgcctgtggcatcttgccctacattgtacatgctgcaatctttacgggaatggttctccccgcaaagaatgcaagctttcttacgacgagaacgatctttcacttcagcttcatccataaggttcttgatactgcgcgactagcgacgacccttagtatcaactaataaatttgagtcaggaacccaattggcttgccctggaggaggacgagtgaaatcgcacacggcacgccaaccacgcaattcatcacgccaagttgcctcccacgattcctttctaaagtagggagaaacaaaaatgtttccatcaacacccccttttgcggaagcagcaagaacatgggaacatggccgatgtaacaggtaaggcttgttgcaaatgcgtttgtaagcgtgatactctggccataacgtgcattccaatgtgatgtcagtagtcccaatgccgacaccactcttgtcacgaagtcgtatctcaaataacaactctctattcccagcaggccacactctgtggattcctcccttcttacttttctcatccatgtactgtgtaatagcggggctatacttaacactgggtttgctgaggttcagactagccatggaataccttttacagagatacttctgtgtacccctcgtgatgccctccaggatagcaacaagtggtagaggtcgtgtattcttcataacccagttatacacttcagcaagatttgttgtcatcacaccatacctcgatccgtctgtatcgtacaacaacgaccatttctcccttggctcaaattctaccaactccgtgaagcacttcgtggcccttccacgcttcctgcgccgagtaatacttggtgcttcattaggaatgggttcaagtccctccggctcctcctctctggcaactataggttttttcctaacctcttccatgtgtgtagtggtcaaacgatccagttgatcccatatggcatcaaactttctttgttgattctgcttgcataacttcttgaacaggtccatcaatctcttactcctgaattgtctataaaaattagccccaaaatgtcgcatgcaccatcagctatgtaaatctggccatggcacggattgtgtgacatcttcttgaagcttctgtatcgctgatagcaaaccggcgtgtcggtcatacagaacacacacatttggtctgttttcaacaacacacattttaatgtgccgcaaaaaccatagccagcttgatgtgttctcgctttcaacaaatgcaaaagcaacaggaacgacatggctatccgcgtcgactccgatcgctgttagaattgttcctctgtacttgcctgtcatgaaagtgccatcaacacagagcaaaggaatgcaatttctaaaggcctctatcatggacccaaatgaccagaaagcccgacgaagaacattctccccatattcattcacctcatcgagaatagccatgtgtgtacccgggtttcttgcctgcatcacctccaatagtgggtgaagattgtgataagaatcctcataagttccaaacctcatctccaatgctttctgttttgccctccaagccttgtcgtacgatatctcatatccgtattctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaaccctcgaagctacccataaagtgtcatgttgtggcttgtaaccatgcactctccaaggacatccaccctgtatgcacttcacatcatacgtcgtcctatttgaaaccttcaccctgaactcacgcttctggacaaatgcccacctcttcaccgcatcttgtaagtgacctttttcatgaaacatctgtccaactttcacctgcttactatcataacaccagtgggcatctaaaccatcgtttaccttcatacgactcattgatatggtcgtccaatcatcgggtatgttagtttcgttgtcccacagtgttgtatcttctccttccactacaagcgcaaggtattcctcgttttccactttcatctgatccactaccgcctcattctcctccgctgcatcaacacgcataggcgaatccggttcttcatcgtccgagtcgttggcctcacgattagtaccacgaacaatgacctctccttgtgtattaccctctactacttcttcccctcgaccttgttcagtccgccaaatattttcatcttgtccaccttccaacggagtttcttccaccacggcatgacttgactcccccgattgatcaacacatgttgtcttctgcaccactattaccaggctatagcctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagaatcgccataatacagacgaatgggcatatcacctgacatcctgataaaacatgacaaatagtctcacgtttaatcatttaatcattcgataattaccctattacaacttatactatattgccgtgtactaatttacaactattagtaacaaacaactagtttaataatccaaataaaatataacacctttgtacctattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgttgccaaccctttgctcccggccggcgcctcctcggcctcctctccggcctgctatcccctcccctcgctccctccggcgctcacggcgacgatgtggcgactctcggtggtggctggcgatgtggtcctcaaaacaaatcgaactcgcggcctgggtggacggggctttaaaccggcctgtcgaacgcccattgttcgacagggtcggtggagggccctgtcgaacgcccccggttcgacaggcctcgtggcgccgggtggtgggccctgtcgaactccctccgttcgacaggtgagcgtgtcgaacgccagccgttcgactgggctttgtcgactgcccgtcgttcgataggtgccctatcgaattgcacccgttcgacagggacctactttcgcgattttccccggttggccactacttttgcgattttccataaaaataatattaattctcaaaaaaattccactgtccaccaccttccccatgcatcctcatgccgctgctcggtgtctctggcttgactttgatgaggcgctggatctggccggctggcgagctcctgcgttggtgtgctcgcgagagaaaatgttggatggagtgtgagatctcgggagggagcaggggaggaggaggaggaggaggaggatctatgtcaagcggattggggtggcctcacccctcctcgcctggatcgagccactgccatggccatctccatcgccggctcctctgccgccccggctccaccctccttcctccggcctccctccaccgccaccaagacgcaccgctgaggcgcaccgtgctaccgtcgtgtaccattgtcgcatcagccagcgaggaggctggggtcgccagatctggtggtttgcttttctctcgctctcctctctctcggtcctcttgttcgcttttctctcgctctcctctctctcggagccaaggcgacaggcggcggcgcaaaaagggaggcggcaggcgatgggtggtggcgacgggtggagacagtgc

SEQ ID NO: 44086 - DNA, 13098 bp, Oryza sativa
actccaccggatctggcggtggcgaggtccggccggtcgcccccacgccatacgggccgccgccttgctgccgcgcgcccgcgcccctcgccctcggccacgccacgctagcgccggagagtggagaagcggagtcggagggagacgcagaccggtagcgaatcctgtctcccatcctgtccctcctcaaacgttgttgtccagattggtccctgagcagacgcgcggtgcaagccgtcggcagcggcggcgtggggccgtggggtcagcgtcagcgctcgcctctcccctcgtcatctgcctctcgttggatggcgagctccatggcggcggcccctcggcgtgatggcgacggcgacagtgctcatcctcccttggctcgatggcgactacacttccccaacccccatcggcatgacagcggactacacttcgcgatgagaatgggggagcaacaacggcgctcgtccgttgcggtagtgactccggtgcattctccatccctaaagttttcaatcaaaatcaaaatattgttggagttctatatcttgaataaatattgaatgccttatctacctgattgaatcggactttttattcgcctttctttacggatttttttgttttttattgccttttttacggaattttttcaccgagtcaaattcaatcggactttccttatttttttttgggcgcgtgcacaagtgggacacttgattggacgccggacgaagggagcgatgtgacgacaggaaaaatatgaatatttataataggtatagatatagattattaaaacaaccttgaaataagacaccacgttctcgctgtggaggcgagaaattctcacattaatcggacaaaaagaaaagaaaagttcaagtagaatacagtttagaaatatctgaattcgaaatttaaaataatttaaaataagtaatattcaaaataaaaaataaaattttaggagaaaaaaaattaaaaataagtaatattcaaaataaaaaataaaattaattcctaaaatagaaaaataaaaataagtaatattcaaaataaaaaataaaattaattcctaaaatagaaaaataattataagagttcaaataggaatacactttatagataaaaaattatatataaagaagggagaagtaataagcctgtaaaacaataagatggtcaaccgttgttgggccatctaaaagttgtaaacaaaatcacaagtagaacccccaaggatgattaagagatggaactagacaggacgttgggtggaacgacagacaggacgtcaagcagcatagtcacgttgttggggcatctaaaaattgtaaacaaaatcacaagtagaacccccaaggacgattaagtggtggaaggacagataggatgttaagcagcatagtcacgacggttggcgggacttgtaaattgcaataacaatcatattttatttttaaaatctcaataacaataaacaggggagacaacaggtaggccatacaggagtataacggtgtgaagccgatggcggttggcgggacttctataaattaaaaataaatccttaaaattcaaaataaaaataaaataaatttcaaaaatagaaaaataattatacgagtacaagtatgaatatactttatgtcgatggggatacccgtagaccggatatagagggtattagggtacgctggtacgaggatctacgtagtacgacatcaagcaaacaggaaacaaggattatattggttcaggccccttggtagatgatagccctaattcagttgatatgagattatatgatcgaaaccacagatacaaagggaatagtggaactcgacgataccgacgagatcgtagtcgagttgatccgactagatctcccggtgacttggctccgataagctccggcttcgtaggctgtggtggatgtgttagctctaagattcgatgccttaggtcctcccgagggtcccttttatatcgcaggtcaactgtcttcaagtaggactcggagacgccggaccggacacgacataatgacgacccagttctgaccgagtaggactccttccatttatgtactccatgatgaattaccttaacgtatgccgaaaacttccatatacgcgcgagcataccatatcaatacgtggcgtatatcgaagggtagagggtataccttacccgtaaccctgacactttacaaataagaaaatatcgaaatgaaaaatatggaattttcaaaataaggtccacctagaactcaacgatgatagaaaacaataaataggagagaaacattaggcctgtaaagaagtaaattgttggcagttgatgcgacatctaaaaactataaacaaaactacaaatagaatctcaatgatgattaagaggagagacgatagacaagccgttaaacaacatagtcacgacagttggtggaacttctagaaagtaaaaagtaagtcacaatgacaatcatgttcggtttttaaaatctcaatgataataaaaatacatgagtatagtatggcgaagctggcggcggttgggcggatttaaagtaaaagatgaaccccaacaatagttatatttaatttttaaatcccaacaacaataaatatgggagacaacaggcggatcatggataaatacaatattgacatttgacaacactcctaaaaattataataagggaacctaacgagacaattgagtctaaaaattagaaggtgtattttttaaaggtttaaaggaagatatacaaaagctatgatagattgggtaaacaaataaaagggtgataaaagagtaagaggcaatgactggtgtaacttttaaataaaaatttaaaaaatttaaggatgataaggatcgatcttttaaggttataggacaatataatggctattaacaaattctaagtaatgtcaaataaagaaaaatagataattttatatgggtgctggccgtgcaattgtgcgggacatgcagctagtttaacactaaactgtatgtactacttgctgaaaaattcctacgaacatacgagcacttatgttaagtttaactgagcataccccacatatgtaatgcactacctcttaaccctaatcatagaaaaaaatgaacacccttgctaaagtataagacttagaaccccaataggcatgtttcgccaggaaaagtttagctaaccaaccaagttaatctatcagttcgctaactagctatttactgatagctttgaacatgctatccaaactatcaaacttcatatcccattaatttagctctgcatattatagggcagtcgagatgctctcgttcgttaacaagccagagagtgttgaccttgtagtaatcaaggcacagcctgtctaattcagtataattcgtttgcttggagggcgctccactccagttgttgctatacaattcgtacaatatactccctccatattttaatgtataacgccgttgcctttttaaccaacgtttgaccactcgtcttattcaaaaattttatacaaatataaaaatacttatgtcgtgcttaaagaacatttgatgataaatcaaatcacaataaaataaattataattacataaatttttttaataagacgaaaggtcaaacgtttgtaaaaaagtcaacggcgtcatacattaaaataaaataaaatacgagggagtaatttataataaccaatagctagcacaagaaacttatatataacaagtggtgctacattttacagagacatcgcaggctcgcagccaaaaaaaactagctgtacctccactgcttcccatggccaaggtcgttgttctcacatttgtatacgtggcaatggttaatgtgctactaaaattaataaacagatgaaggatcggagaaatctagatcaacttatttaaaacttcgtgggttacattgaaacggttgaatttcgatagaaattcttttcaatttccataaaattcattaaaactgatcggcggtacctgggccggttgaaagcctacttcccatggtctaggccattaatattctcgtgatactacccaactttctcgaattttttttatttttaatttttttattaaagtatttacaaaactaattttgtgtttcaaaaattgacaaaactagtcgcccgccgccctttgggagggcagtttttaaaatcaacctcccaaagggcgattttcgtgacgtggcagacgaccgttggctcatgccaaacggctggctatatgggacctgccattttgcaggcggccccttaccgcacttagggagggcggtttaacactgtgcggggggcagttcaatgacaatatacgcttcacatatataactatatcaatgataatgtttgtatcgattgttatagctaagacattgttggaggtataccgcgaagggccttcggtcgggcctgccgaaaccgaaaacttgggcgacaggttcaaactggaagcaagcggcgaaggtcgaagagggataccctaagggcgaaagcaatggctcaggaagtacgcgtgcttcgtcggacagggaccccgtcaggaggccacgcaggcgaagatggcgaggcaaaaagcctcggcctgaaggcatgggtttcgccaaggtaccaaaccccaccgtgaggaagcccagcgggccgttgcgaccctggggggattcgccaagatcaatgggccgagccatttagcctaattggggcccatacgtgtgaaggacactgtgtaccctaatcatgtccctatcataagggtaaccatgtaaattcccctgtaaaacctaaaccctagggggagagaacctgtaataacgttataaatagcccttctaggccatgtaatggggggatcctcaaaaaaatttttactaagcaatacaattgccttacttttccaacaactgttgagagaaccacgtctttcagtgtgacgcggttgtctattcgacaacagctggcgccgaccgtggggacctccgagcgaaaccactgagactgagcaaaaccactgatgccaccgaagaaggtcactaaggagaaagttgccaagcggaaggaaggcggaagtgaagtagagatggtagttgaatagggagcagatccttcggcctccgtgggtgaagccggagcagcactgccttcgacagggctgccacctctcccttcttcggcgcccaaaacttcgactgatgcggaagcggcgaaggcggtggcagcggcgaaggcccttcaggttagagacgtggtcttgtcctcccaagtactagggacgccctcagccacggccttcgcccaaccgatttcgacgtcagcagcgatcaccacctcacaagccaacaccgctctcgaagtacaagccgaagctgacatgggggccatgcgtcaaaacatggcaaaacttcaagacacgcttcgccagatgcaagagctgcaataagcatacgaagcagcaagacaagccaaggccaatgcccagcagttttatgctcagcgtcaagtcattccttcttatgtcgcgcaagcactggtgtacttcgccaggccagccctagccgctgccgttcacccaacacatcaagtgatccaagcaccggttcgcccggcggcgcctcaagcccagtacccgaagcctacttatacaccgcaagcaatgatggaagcagcttcgaccttgcaagctcaattccaagtttttctgcagcaacaacgtacaaagagcttcacctccggttcagaccgaggggagcccaagacaaggtgcattggcggggcttctggttggacagttcgcccagccaagtcaagttcgagggccttcgcctcaaggtccatcttcacaatttgacccaagcacaatggcccaagcactgacaacttttgcacaagctatacctccaggatacggatcagccccaccaccgaatcaaacatggaatcaaaccacgttcaacccaaccgcggcagcgcaggtcacttctccagaccagcagaaccaggcaatgatgttcaacatagcgcttcagtcgatgcccacagcacaacagcctgtggattccatggcttcaccgttcgcgctgccgtacccacatttgaattggcctgctcagcaaggggctatgatcaagccgaggaccgaaaagggcctgcccctcagctggggaatcaataatcatcccatcccaccccagttcaagtaccctccggtcccacggtatatcgggagaaacagatccgaaagagttcttgtccatctacgcatctgcaattgaagccgctcatggtgacgagaacaccaaggagaaggtaattcacctcacgctcgatggcatagccaggtcttggtatttcaatttgcatgttaatagcatttactcatgggagtaattgcgcgatgtttttgttcttaactttcgaggtacctatgcgaggagccgaaaacacaacaagaccttatgggcattcgccaaaggcaaggggaatcaacaagggagtgcatttgcctgttttcgcaagcgcgttgccaagtgcaagatataaccgaagcgtatgttatccatgccgctttggccagcttgctcgagggagaactcacaaggaaactcgcgcgtaaagaacccagaacacttgaacacctcttttgcataattgatggatatgctcgaggtgaagaagataccaagcggagggaagaaattcaagccgagtatgacaaggcagcaacagctgcagcagccgccgtccaaaccaacacccaagctcaggtccaagctcaagctgtaagttcagcaccagttcaagttcacccagcatctctggcgaaccaagtactgcaccccaggccgaaccaagcacccatgacatggaagaaattcaggactgagtgagctagcaaaacggtgatggcggtcgaagaggtacaagccctccgcaaggagttcgacacccagcaagcgggcgggcaacaacagccttttcacaagaaggtcaagaaagacttatgtcacgccctaaaaatcgactaaattaaaaatgcatattttaaatcatttttagaaattaatttaaaagcctacaagctaaaccctaattttctaggaaaattttcaacataaaaatgagctagataaaattttattaaatactatgcttgctcctttattttctagatttttctgggaattatttgagcaagggaagtatttttaataattgaaacaacatttcacaaattgttttatttcaaaaagtttaaaaaaatcccctcctaagccgttgggccgaattcggcccaactctctctctctctctcccgcgcggcccaagccggcccagctgccgccgccgctctctctctcgtgggacactgacaggtgggccccacctgtcaggtgtttcccctacctccggccggctgccctagccgagtccgagcacgagccgcctccttctcctctcaaattcgcctcaatccgaccccgattcctccgggtttttgaggggttttgttcctctcgttctcctctttcttttcccccaagaatcaaagagaatcgttgaggatttgatccgaatcgagttcgttttgattttatccctaaaaccgagttttaatctttcccgagtcgattgctctcgtttggagttcgatctcttcaatccaagcttatataaaggaccacctcgtcgttctctttcgtttgccccctctcccgagctttcccgtgcaccgtagcgccgtcgccgcgtcgttttagtcgccgccgccgccggccatctttcggccacgtcgcgccgccgcgtccgtcgtcgccgccgcttgccgccgccgccgttaggtgcgccgtggtgagaggaatctcggccgccccttccccttcgccgccgaccaccggagctccgccgacgccgtcaagccgagccgccgcgccgcctcttctcgtcgccggccgtcatcgtgcatcgtttgttgtcgtggtaagtaccatcgggttcgtctcgatgtcctcttcgcgttggtgtcctccaatcgcccggccgaagtccctagctccggcgagctcgcaaaccctaatcggccgtgggtgacgtcatgctgacgtcatcagggctgacgtcatcatccccttttctttttcctttttccaattttctaatagattaaaacttcggaaaatcataactaaataaccgtagatccgtttcaggtggtttaagtttctaaattcttctaaaatcaagatctacatgataaaaatatccacatgtactgtttatgcttgtttttgtactgttttgttgattttgtttatttgctttagtttccgacgttccggaggagagcgtttccgttgaggaaggttccgaagcgtttgtggaagcccaaggcaagtcacacagatcccaaacaaccctttgagcatgttgaacccgtttaaagctattattttatttcaactatgcattgttttcgaatgtcatcgggtggtgaacctttcccagttaattattggccgaagatgactttattttcctatgggttataatttgattagcatgaaccttatatattggattggttcagctaaatgctatatgtaagtttgcttagccatgcttagaaacattagctaactaaaggggttaattataaattatattatattattattcaattatggtgattcaatggtagctcacgatggtaaatcgtgtgatgataattaattggtaattaaaacctggctaaggtgggttgtgagcatatggttttgatggttgtgctcatgacaattaaggaccggttcgcgagctactgttgtgaaacatttatcgtgccaaccacaagccagcgtgggcaacggctttatcttttgtataacgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtacggtggtggtattgaggcacatggtgacatgatgtggggttgtgtcttgtgggtacagtggtacacctctgattagagtttaaactattcgaatagccgtacccgcggttatgggtgagttgagcaatgtttttcgtgattagtttcacactactcatcaatgttaataatgtgataaataatttgactcctggtttggaatggttaattcctggtttggaggtttaatttgttcaactggggttagttgttcaaatgtggttgggcctatgcaacatgggtgtgttgtatggtgttatttaatattgatcaattattcaactgtttttattattctcttatatatttattaaatgctgttttctgcaaatgagctatattatgccatcctttgttatcctgtgcacttgcatatttgctgtgtggcttgttgagtatgtcatacgctcattcttgcaatattcattcatcagaagaggagtatctcagtgaaggtgatgatctggaggattaggcttgttcttggttaagatgcctgtggagtggagtcgccatagctgttccgtagtttgttatcgttttatatttccgctgcgtagaatgttatttttgtttgagaggaactgtctacctctgtaataatttttatttgcgagtattaaatagttatttatttgtactctattatcaaattgtcattgtgtgcctcggttgattcctggacgagggtttaacacacatgtaagcgtttggaattttggatagaaattccgggcgtgacaacttataatgcgcttttcacggacgctcttcgcacacgaccgagcagagtcgaaacattcggcagcaaggcaatgttcaagcacaaaggcattgtctcagcattgtctctacagctgacagcattccaagatacttttcacagccaatatccttcggaccagaagatgccaaaggagttcttttcccgcaccaagacccgttgatcgtttcggtagaaatggctagttttgaagttcggcgcatcctcatcgatggaggaagttcggccgatgtcatgtttgcgttggaggtataccgcgaagggccttcggccgggcctaccgaaaccgaaaacttggcgacaggttcaaaccggaagcaagcggtgaaggtcgaagagggataccctaagggcgaaagccatggctcgggaagtacgcgtgcttcgtcggacagggccccgtcaggaggccacgcaagcgaagatggcgaggcaaaaagcctcggcccgaaggtatggatttcgccaaggtaccaaaccccaccgtgaggaagcccaacgggctgttgcgcccctgcggggattcgccaagatcaatgggctgagccatttagcccaattggggccatacgtgtaaaggacattgtgtacccctaatcatgtccctatcataagggtaaccatgtaaattctcctgtaaagcctaaaccctagggggagagaacctgtaataaggttataaatagcccttctaggccatgtaatagggggatccccaaataattttttactaagcaatacaattgccttacttttccaacaactattgagagaaccacgcctttcggtgtgacgcataccttttcgccatagtacgtagtgggggccggcatgttccgacataacaaaagcacgagagtgactatgcgaacgatggcataaagctatgatcaataattcacaaagtttcgagcggacaaaatcacaaaacttttctatttacgtgagaaaaacctcataaaaaattacatcaccagttacatgttcgccctcaattaagttactaatcggcgaattaggttcatcgttgctactaatattatacacaacccttaaaggggacggtggccaaaagcaaactaagctgtaacggcgacgagcgatagcctcttggagaaacgacctcttaaagtttcgctagaaaattgcgctatcttcgcgatacgttacacgatacctgtcatagtctttcaaagttcgaccggggtgtgcacgcatccattcggcaacccgtataaccatgtagctgttgccttttattaacatttcatggtaaacaggccgaaaacgacacttggtcttcagcaatcctttaaccgccacgaacttctcgttcttgtttcgccaactttcaggtgggggccgaatgcccatttttcggccacgaatctcctgacaaagcacaaaagaacaagtgcaaaaggaaaaatgtggacgaaatcaatcccactttccaacaaaatcataaggttggcgaaagcattaacttttccattaataaaataaaaaagtcataatggctataagatgaaaacggctcaaagccgaacatgcaaagcgcctatatacatagtaggactaccaaaaagcctaaaaggacaaagaaaaaaaaggtgggagtcacacgagggcctcacacctcagggtggtcttggcctccattgcctttgccctcgtgtccggcgcccggttccgacggcccaaggtcccctccggtgttagtggtagtggcttcgtcctttgcaatcctctcgagattctcgcgaaggcgtgtcttcgcgcaatcccggccgccatcctcctagaaaccttttcggaaggcccttaaggccgttccggaacactgtgaattgtcaggacattcttctttcacgaggtcgggaaagatcccaatgtggtcacaaccgtgtgagtgtagctggctaaggatgaagcccgccgaaacacgcgcacaacagtcaccataagcacctgccacttcgacgactgagccggccgcttcctgcgtcctctcggagaagtcgaacgtcgtcccgtcgtcgcccggagcgccctccgcccgtgtcccgaggtcatacagagccagcttgagagtataacagacttgcttgggggactctgttgccggcgccaaagtcacagcagcagcttcggccgagataagacgggcctcaagggacttgatcttctcctcggccgcagcaagttggcgatctcgttctgcgtcccgctagttcgccgcctctaggtcggcgcggagagacttgttgtctcctgtaagagccttgttttccgcattcgccttttttatggtctccgccacaacacgtctttcgtcttccttgtggcaaagatcctcctcggtttttcggaggcgaagacggtacccgtccggcctctccaaggcagacttttccgcactcaagtgcgcggcgaggccctggacaaggggaaccaaatacattatggcgtgacataggtgaaatgagaaaattctgcagacagaaaattcatacccgcacaaacaagctctccacggccgtgcaactttcgccaaatttgttcagctcggtgaagaggccaaggccatcggacggtgcgataacttggcacaccccgtccatgaaaggagtgatctccggccacgtggcgaaatccacgggaacgaagtgcggggcagtaagcgtcacgtccgacaaagtcatttcgaccgccggagcttttccttcccgctgacgagcttgcgaaggaatcgcctcaacctattcgtccccggagacgttcgctccagcggccggagccgaggcacttccactcgttgcagcttcggcgtcactagcaagcgctggggacatgcgtctctgtcgcgaccgggaaaattgccttttcccgaacgcttgtgtattaatccccgtcccaggaaaagccggggtacaccacacaaacatgatataaaagacacatctttattatatcgataatatttacattattacaaaggcgcttcaggcctgacaatcaaaaataaacagcagcggactagcgagcctacggctccaccttcacaggcgctcaactggggtataagccaggactccacctaagacatcttctccaaagcttctcttactgaagaggggaaagattgagcaagaatgagtacaaccacagtactcagcaagccacaccg

SEQ ID NO: 44087 - DNA, 9167 bp, Oryza sativa
tgagggctccttttagaccaaggataatttaacaaaaattctccgggccacattcgaatttttcttgtacgtattttagtgtttgccaaattcttttcgaattttaattaattctattattccttttagcgaatgatttttaattcgggatgaatttatcaggacgtgacaaatccaccccccttacaggaatctcgtccccgagattcgaggaggctagcaagaggataggttgggcggtcttctcttcttgtctgactccttccgctccgtcttctataacaaacttgcctaacaaaacttctccactctggactgcttggctcgatctcctgttgcagatggaatcttctcttcacccgacttgtccctggttgaacctttagctgacttcgactgggttgcggcacttgaagatggtgcttcagttccagaacttcgcatagttcatatctttggcgtcaacctcatacaacttacccacttcatgtcatgcgtcaacactagcttgtcattactaggataccatgtttgtcatcataagaatatcatgcttgtcatttacttctaacttgcaccaactgcctcatattagctttcctagtctccggtgctagatacttcctctattcaatgtgagggtcggtaacttttgcctttgaattatgtttcccaaggtaaccaaattatcccacttgacatgctttgacgtcttcccaaatgactttactgctgaacttgttattgtctgatcattttcctgccaaatctgaagcttcgttgttaggtgtgattttaatctgacctctatagactatcttcgaacatttcacttggttcataactgggaatagttcccacgaacaggcagctcggatttactttcgttacattcagtttacttcccactattaccttcaggttgtcctcagttagcattcaacgtattcctttacacctttaaccttgatgtgttctttcccgatttctcttatcaatcacctttcgacctacttctttgcccggtaataaacacctttgctggtatcttctatcaatcaccttttaaactttgtcaaccaagtactctccactccgagagttgtggatgcttctggtgacaatgaggtcctttggcttgctgccttccagtgaaaccttgaagtgtttcgccaaaagctatactgactgtctttgcctttgatccgaaaaagacacatctgaaactcttagtccaacaaatgtttctttggttaatcgcttgattttcttttccatcatcaggttggttattaactcgaggttagaacatagttcctctggaatgagaccctaggtctcctttgacagtaaacaattatacgcatgatcccatatcagcatcttccaaaataatcctcatagaacttgtttttatcacacatgtctcccttattacatgaatacaaggcactaccttaaacaaaaaagggaagatgcttaacatcggtacattgtttctactatgggttaggattaacatgaggcctcacaggtacggcgtttgctccagtgaccacaaggcgagtgacttgtcttcttcttgcataatggccggagtgatggcgcaggttacgcttcggctgtggacaatctctagagaaatgacctggttctttgcagttgtaacaaatcaacgtcttctttactgagctgtccatctggggacgatcattttgacttggagttggaattggtggttggaaatccttgctaacattggcatcagtggtaccatagttgctatcaccattggagtctttctcagtgtcaaaattgctaaggttgtcattctgggttccaacattgatactatcgttgacatcttggtgaatgctactgacattgcacgctttattcgggtggtcactaatggggcaagaaccatggttgttggtggtatcatcatcattagtattgctagtgttgttgtctgcattgcgtccatcttcttcgggcaggaattcttgatgcacaacagaagatccggtgatctgaagtggctcagtgcgctgtctttggttaccacctggaaatactgggatgttgacaatccttctcttgcagttcgtcatccgattatgctcactttcaagttgcatggctttgtccacaagtttctcaaaatcttcataatcctctaggagtagttgcactgcaagctcatcttttaacccctggagaaacttctcttgtttgtcttcatccgtttccacatcttctggtgcatagtgagccaaacgatagaactcgtgcaggtactctgtgacggtcaaatctccttgcttcaggtagcgaaactctcgttttcttagtgcgatcattcctgcgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcttctcgactgtgcgcaaccaatcactggcttccataggatcgacggcaatggcaaaggttggaggctcagttttgagaaattctgataacttgcactgttgctggactgtaggtacttgaacgttggttgcccctgctgggttgttccaattctgtaatagttgaaaggctgttgccaacatgttggtttggttaaccacaatttggattagctctggtgaggtttcgtttatgcttttctcattcccattggcttgggttcttgagtcatcggatccatcattcccatagcctttgttaccagtgttatccatctgtcacaaggtagaggttgagaggggaagcatacaaggaaagaatcgaccagaactagggacaagaccttaaaggaactaactctttttgttgatgtgttgtttgttttgcttattctgcaggttgattaagcaaacaacctagcatggttacatcacaccccactgatgcaaaccacgcgctacacacacaagcaaggaaacacacaactaacgactctaccctagagggcggcttaggttctgcaactggttctccaagatcttcactccttcttcacagctggcttcactgcttcctacacttcgctagcggatcctgcagtcttccggagcttcggcaaacaattggcgacatcttcttcttcgcaaagctgaccatctagtactagttgaaatttgaagaaggaagaaaaaagtaaaccattttgcaaatagcattaggggaaggagaaaaaggaactttcgccaatagttttatttataaaatatgtccttaggttttatccacttggcttatcctaccgtcgagatggctctgataccagcttgtcgcgaccaggaaaattgccttttcccgaacgcttgtgtattaatccccgtcccaggaaaagccggggtacaccacacaaacatgatataaaagacacatctttattatatcgataatatttacattattacaaaggcgcttcaggcctgacaatcaaaaataaacagcagcggactagcgagcctacggctccaccttcacaggcgctcaactggggtataagccaggactccacctaagacatcttctccaaagcttctcttactgaagaggggaaagattgagcaagaatgagtacaaccacagtactcagcaagccacaccggagatgcataattaatgcaagggggtacaaggggataataatataggggttaagttttgcagtaaacagcatttaaaagtcacttagttgcccaaagccattttataaagacgatcctagagctacacaaaattattaatcaaggccgtgaaccctcacgaacctgccttaacccaaggcctacgatgattcagaccgaactggcaacccgaccctaggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacctccgggacaggcaggcaggactgagcccctagcagcagggcaccaaccctgtgccatgacatctcgactaccgggccgcagctcgtgtagccttcatttgtcctagagaatgtccatcgacccccgacttcatccatctccatccgtgtacttttgtttatgaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccaggtgatatgagaattcccaaagtctaaagttataaaaccacctaatattgcctaattaatcagcgaagcatctacctaaattcatacttgtggaaccatgaatagagtgtccactagttggggttttgtttaatctagggtgaacaaggtaataatatcaataacaataatattaaggtcataacaaaggtaaataggcatggctaaataaaacagtgatcacgcgggaatttaaataaagcgttaatgcaataatttaaatcaaaataattttataaactgggattcaatatgttcaaggatgatgtgacttgccttgctcagagagaacggccttccgaaccttcggcgacgaccgcaaaccacgcttcgggaacctccggaatgacagaagctacgcgaagcacacaagcaaagctacaagcctataaagaagcaataacaatacataaaaagaaagcacagggttctttaggttataacaaacattaagagacttgaacgggtcgattcggagttcgtatgaccaagatatgatcatccgaagtttagtgctgttatatggagatttgcggattattataattaagctttgcaacaataaaacatgtgtaagcgctagcctggaaaagacaggaaggctgcgccgttgacatgcggaccccacatgtcaacctaaaggaccgcggtagaccgagtacacagagtcggtccatgggtcgacggaagcggatcccgtgtgtcaaccgaggcgagtggccgacaaacggactccactagacaccacacgggttgcacacgtggaaaccacgcggctaccgagcgggcacactaacacggacactacacggtcaccatccgcacacgtgaacgactaccgacaccggtacacgggtaccggggttgacgaccgcacaacgagcacggacgacaccgaaaggacgaggacggggcagcgagggagagggatccttaccaccacgcgacgaggcgcgggaacgacaacgacgaacgggcgcggcggagacagacgggcacaacggagacgaacggcgaggggacggcttcggcggcgatccttggacgaaggcgagacgcggccggcacgaggcttgacgacgcggagccgaggacgaagacgaggacggggctgccgcggctcgcttgacgaacgcggacgacgaacgagaacggctcgacggagggacgaacgccacgacgaccgagaacgacgagaggacgacgacgacgacgaccggggccggcgaggagacgatgagggcagccggcggcagctgcacggagacggggacgacgtggaacgcaccgctgcgaatccgacgacggaggcggcaccgcgagacgacgagccggcgaggatgaacggtgaagacgacgacggacaccggcggtgttcggtcggaggggaggcgaggccgagaacgacgtcgcggctgcgatgccgaagatggtggaggtgtggccgaccggtgcacggcgtggagggagaggttcgcggcgatgtgcggcggcttccgggcgaaaccgaggggtggacgaggtggagggctacgccaccatgccgagggagggacggcagcgccggctgatgcacgggcccggtggaagggggctgccggaggagacgtcgacgaggaggaaggagaggccgacgcgggcgacggcgttccggcgaaattcgggcgacgccgtggccttgccgggaaagaggacggcactccgatgccgggagaggtggtggcgacgtcggccggcgcaccggggacgcggcagaggcgaccggaggcggaatcgtggcggcaacaccacggttgccggcggggaggcacttccggaggtctccgcgggagacagagggtaggccggcgaagaggaggcggctgcgatgctagaggaggcgacggcgcgaccggacggcgctccggcgaggagggagaggcggctggaggcggccggcggcacgggagggaggggacgacggcggggaggtggctagggaccacgggagagcccgggaggagactaaaacggtagaacgcaaagagggggttctattttataggatgggggagggagccgggcacgggaggagcggggaacggcggcggaaaagccggccggcggcaatggaaggcggccgggaatggcgcggccgtttccggcgattgggggcaccattcaaggggaaattaagggggaaagagagaggagggaaaggggattaattccccctaatcaatttgggaatcccatgcttgaatcgcgcggatttgagggaggaatggcgctagggttcgcacgggagggagagagaggaaggggccgggcggttggaaggggacgaccggcctggcgcgtgggccccacgcggtcaggcggcggcgtcagcgcgcgcacgcgcgcggcacgggcgggaggcgcggctcggcttgggccgggcgaagccgaggcgacccaggaggagaggagggagaggaggcccgggagagagaggggaggggagggagctgggccgggaggggaggaggcccaagaggaggagggagagaaggagagggagagaaagagagggaggagagggagacttcggccgcgggccgaggggagagagggaggactttgggccagacttggcccaaaggaggaaggagggttatttttaggtttttctttttaaataaactttgataattgtttttgttgcttaataattatttccggtgctctgaaaattcaagtaaaatttgagggctccttttagaccaaggataatttaacaaaaattctccgggccacattcgaatttttcttgtacgtattttagtgtttgccaaattcttttcgaattttaattaactctattattccttttagcgaatgatttttaattcgggatgaatttatcaggacgtgacagtctcccccgaggaggaatgcgccgcagaatcggcgaagtgggcatcccatcggacccctcactgtccgaaaagccacagccaacttgcacaaccttccccttcttcttcttcttcctggcaacagctcccggcttcgccgcagagctagaaatcgccagaagggcattcgctccagcaatgtcttgcgggcgcacgggcgaaacatgagagcccaccccagatttcaccctagctgggctaggagtataaccatgcgatccatcatcctcagatccggcctccctatcgtcttcttcctcctccccaccatcgctttcggccgcgtccttagcggcgcgacgagttcgcacctggccaccctttgcaaccgctcgtttgcacttcttcgacgtaccgacatcctcgtcgccggccctagaggggattgatcaacctggcagttcgccaacataaactcggttcacccggccatcggtctgacgctgaagcaggcgggcgaatttggctgtggttaggacgccaaccattttcgatgcctccgttttggcgtcctctaaggtgtgaactgaaaaagagaggaaaaggaaaacgatgaattaggccgaagtatatttccgcaaaaagaagtatacgacacggagcaaaagcaaaaactcacgttcggccccggtggggagaacaaggcggggaagcccgagaacctctttgtcctcattgacggaaaccccccagacacgagcaaggggggagatcggaagaaggcaaaactcctcggaaaggtcacgggtacttagccgccgtgcgaccttgcgaaggagtatgagccgggactcgagggttccatcgacctctaggtttggcttcacgacaatggagacggcggagcactggaagcggagctagttcgccttgttgtctttagtagggtaggggttggcgatgtagagtcacttttgcatctagttcctttcccatttgcccatcgatgcaggcaccggccaggcgtccgaacattccagccgcagcatgaagttcacgcaaccgaaaacggtttttcttggtccggctggcgtatgcacgtctttggtcgtggcacatgctgtaaataggacggcgaacagctcggcggtgggagagaacctgcaggttcggcacatcctagcgaagacagccagcttcgggattgctgacggactgagctagggaagcctaacctcgtatgtcgccagcacggacgccaggaaatcgtcacacgggagacgaagcccggcggcaaagaaggtggcgaagacgaccgttcgcccatcgcctggcgaagggacaacggcttcgcccccacatgtcccttggccctccgcgagagtgccggaggagaccaattcggccaagtcggcctctttgacaagcgatttgccaagaaagcatgaccacccctccccgaggctgctagggtcttcgccagtcgacccggccttggtgggcttacgaggagccatcaggtccgtggcgaaggaggaattgagaagcgaaagaaagtgagagtacagaggtggcgaagagctgaagtgcaaacaaatgcagagagcacggagcgt

SEQ ID NO: 44088 - DNA, 5786 bp, Oryza sativa
cacccttgctcgtgaggggcttgttggaggtatactgcgaaaggccttcggccgggcctgccgaaaccgaaaacttgggcgacatgttcaaaccggaagcaagcggcgaaggtcgaagagggataccataagggcgaaagccatggctcgggaagtacgcgtgcttcgtcggacagggaccccgtcaggaggccacgcaggcgaagatggtgaggcgaaaagcttcagcccgaaggcatgggtttcgccaaggtaccataccccactgtgaggaagcccagcgggctgttgcgaccctgtggggattcgccaagatcaattggccgagccatttagcccaattggggccatacgtgtaaaggacactgtgtacccctaatcatctccctatcataagggtaaccatgtaaattctcctgtaaagcctaaaccctaaggggagagaacctgtaataaggttataaatagcccttctaggccatgtaatgggggatccccaaaaaaatttttactaagcaatacaattgccttacttttccaacaactgtttagagaaccacgcctttcggtgtgacgctgttgtctattcgacaacagacatgtcataaggaaaattggaacatcttcaatattgtaataccccaacctcggcgacgacataattacctactccctccgtttcacaatgtaagactttctagcattgctcacatacatattgatgttaatgaatctaaacacatgcatatatttagattaatttacatctaaattaatatgggtaatgctagaaagtcttacattataaaacggaggaagtttgtctcatttacccaaaagaattggattatttgtgtggctgtacacatataatctgaaaaactctttttcaatttcattcttgcaactaataataggattaatcaaatcctatactgtctcacatggtcacatggtcaattctagacaaaacagagccactgtgaactcttctgttaatatatgtattatttttatatgatatgctatcaaaaatattagctatacttaacaaagtagtctgataattccatacagagatatgaagtgccttcaatacacgagaatagatcgtggaacacaagccgtctaggagatggaaaaaatcgatgatcctatctgacccaagcctcgatcaatttgatctcgcttcgagaaaaaaaaggcccaagcaagacttgttttagatccacacatcagaacattccaggaacgctttggaaaaaccaaaccgatgaggtagatgatacaaaagattaaattctttttcatggaattggatgtttttttcctgaaaccgatgaggtagataaggtagatgttttttttcacattgcacagtgctaaaccggatttttttttataaacatgaggtttttaatgcattgggttagacagttttttccgagcgattttttttataaacgatgattttttctcgtatggagttggatggttttttttatctttttttcgcgtggattcggacggttttttcaatccatttttttatacacaatggattttatctcatgttgagttggacgtttttttgaacctgtatttttataaaagacttcttttcctcgtgttgagtcgacagattttttcgaacaggtttttttataaatggcgttttcttgcttttgagttaggttttttctctttttttacagacaacggaaacttggcttttttttctcaattgaaaagatgcccgtgcattgcaatgggaaaaggtgtttttttccattggtacaacagctattaggagttgaggaataaattgaaaaagcgttacctcctacctagggttgtcaacggggcgggtcaggggcgggttgggctggaacgcccccgcacccgctccccgacttctccccccaaccccggccccgcacaggtgatcgggtgggaaatatccccccgtccccgcccctgcaggggacccgtgggtgagcggggctccgtaccaccgacggcaaacgcgagatgaggaggaatgcagccgccgccacggtgcatgtgccgcccttgacgtcgatggcgacgccgacgcggttggccgcacccctggccgtcaacaccgctgccgctgcaagctccatggccgttgatgccgacgcagatggctgcgcttggcagccgccgccgccgcccgcgccttaaccgtcgacgccgtcgcccaccccttggccgccaccgctgcaagctccaaggccgtcgacaccgacgcggatggcggcgcttagcagtcgacgtggatggcggcgcttggcagccgacgccgccatggcccgcgcctggccaccgccgccgcctgcgccttggccgccaacgccatcgctctccttgtgatgggagaggatattcccaataggcaatatgacactgaaagagatgggttgttaattttgaccatgattcagttattagatttaacacgagtgctcacacttacagttaattagacacctgaggagacttcatcaatctcaagttatgccggtaaagagtttcaaatgtgttaatagaagtaggatgtgtgtatatacatacacaggggtatgtgcacgcactgtatccttttctaaaaaaaaaggaataagttcaccggaggtccctcaacttaacagcgagattttttgaaatcccctaaccataaaccagaaatgtgtgcccctaaatttacacaagccgtgcacacaaggacctatacagtatatatgggtggtttcactgacgtggcatcctagtcagaaaaaacattttaaaaaatacatgggacccatacactggtggagaaaccatctttcgtcggtcggccgatttccacagtagtcccggatgcaataaaaaccggggctaaagatgttctttagtcccggttcaaaagggtaacgggcatatttgatctttagtcccggtttgtgttaccaaccgggactaaagatgatctttagtcccggttcgaatgctgtcagggtctgtcaggccctcccggtatctttagtcccggttgataacaccaaccgggactaaagatggtaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatgtagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggaaaaggggttttatttgttgtccatgcaataagtgtaagaatcagaaggagtattctgcatccaggactattcatttccacttgtttgagtcggggttcatgccaagctataattgttggacatccccggagagcaaggtgttgaaatggaagaagatgaagtggaagacgacaatattccggactttgctcaatttgttggatttgaaggaaatcaaacgggcgaggaggaaatagctgctgatggtaacgacgttgcggatgatcttggtcaaatgttgcaggacgccagggaggactgcgaaagtgaaaaggaggcccataaatttgacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtacgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaggattttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgt

SEQ ID NO: 44089 - DNA, 1857 bp, Oryza sativa
ggtaccggaatcaccccataagggagactacggggaaagggaactcccggaaggaaagcaattatgacggtagacaacaatttattccgtaaagcccatttcactgttttgcaacactcttcattggtagctccttacatcgaggagcacttggctctagttcgcgccaggaacatcggtaagtccgatgtatggattacacggcatcacattgatactttccccgcgtggctacgacaacatctcatgggtaacgagtcgatcaaccaacaacttgccttcctggcgaggggaccgtctgggtcgatcgcgacattccagggatattaaatcaatgggtacacattctacacgagagcccaagacatgaagagcatgaaccaaaacagcgctgttcgtgtcgatgccatgggacatgatggaacaactgccacgtattacggtgccatccaggacatatgggaacttgactatggtcctctcaaggttcctctgttccggtgccaatgggttaggttgactggtgaggcgtaatgattgatgacagtgggaatgacaactgttgaccttaacaaggttggatactcggacgaaccttttgtccttgccaatgatgtaacgcaagtctttttcgtgaaggacatgtctagcaaaggaaagaagggcagagggcctgatgagccggaacgtcaagtggttctcccaggcaaaagaaaaattgcgggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgctgtaattattgtgtacacgatgtaaactattttggatgtattgattatccatataaatcaattgatgtatggcatatgttaattacgcacgattattagaggtttcaacaagttcaaatcatgtatatgctagttatatgtgatacttacaatttttaaaagttttaaatcacaggtggcaatttcatatgtacgttaattagagtttttaacatttaatttactagcattcatatgctaattataattgactagaggatttttaaaagttttaaatcacgcaagtggcaattttatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggttttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatatattggaatttttattaattataagtcatatatttgcttattacgatttatccacttaatttattacagacaaaaataatttttcgaagtaattgtcattaatctttagtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttg

SEQ ID NO: 44090 - DNA, 3128 bp, Oryza sativa
atatacgcacgaaacacttagcagacatgactattttagtcttagcatgtaatattatttgagttttaatataagattactttatttgagattagacttagtatataattattgactacggaagtggtgcgacaagtagcaattgactattgcagtcttaattacacttagcatatacgcacgaaacacttagcagacatgactattttagtcttagcatgtaatattatttgagttttaatataagattactttatttgagattagacttagtatataattatttactacggaaatggtgcgacaagtagcaattgactattgttgtcttaattagacttagcatatatgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtatttagacttagcacgtaagtttgtgtagggttctaatgtacgacatttacacttagcatacatgacttagattgttaaaacataaatgtctcgtggcttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgaggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtacaagaagtatatactgaaggggcagacaccgaacttcgacacattcccaaagctaagggatcactgggacgagttcgttgcatataagataggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtattcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacacaggacgaatcgacctgtcccgttgatgacatcactcagcggacaccatgtgagctgcatattcctttcaagaacttatcaataaaggtaagatttagccattccgctagttcctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgccaagaacaaggacccggggtacgattgcacgcaagaggagctggacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaacagagatcgagccgttggttaccggtaaagaaatgacgatagaacaatttattactgacaccggtctaactacggatcaattgctaggagtcgcaccaatcgaaaaggcggaagtgaaatacatgtacgaactcggtaaaccgctcgtcaagcctgagctgctgtagtccctacccacacaaatgtacaagttccatcagctgtacatggagatgagcgccttcagtagagagatgatcggagcgaggatcagggacac

SEQ ID NO: 44091 - DNA, 7638 bp, Oryza sativa
  unsure (1)..(7638): unsure at all n locations
acgtctctattatgagttgctggattttgtaagtatatcgttcggttagatttcttactatacgtctcctttaataaattaggtccttgtatataagtagactatagaaaataatatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattatgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttaatcccaagggtgaattctactacgacggaaacacaattcaccggtccttagcttctgagctagcagcgagtactactacgtcgaaatgatagctagctagctaggacatataatggattgtaattaatacatgactacatatgtttctatatgcatgtgtacacattttctataatgtaaatatattttggtcatatatatatatctatatacatatgcattaatttgcataacatatatatgtgtataaatacatatatattatgcatgtatatacatataatataatataatatatatatatatatatacatatatatatatgtatgcatatatatgtattgaaacatatatatgcatggtttatatatatatatatatatataaactatatatatatataaaccatgcagcaacagggccatgcaaaaaaaaaaatggtcagctcgatctttagtcccggttatttcacccgggactaaagatagcgatctttagtcccggattggtactcccggtttggaaaccgggactaaaggggggttacgaaccgggactacaaagggtttctccaccagtgatatatcatctgcacatcctttttccttctcttttctccttcttctcctctcttatctcgtttctctcttcccttctttgggccggcggcgggcggaatcggtgagcgcggatgagggcggcggtcgagcgttggggaggctgcggtgggcggtggcggtggggaggagccgttctacgtgccgtggtgcaaacggctgtcggtggacggcaaggcatccaccacgctacggatatgcatctgggagtgagacggtgagggcagggacaacacctgcgacattgtcgccgcgccgctccgccgcagctgcagcgccaaggcaatgccgctgccagccccgctcttccgaatgatgacgccgccgccgaggccgcagaaaggggacggggagtaggccagnaggcctggagaggccatccgcaaggggcaccggagctacagtctcatggtcaacctgcagcttggcgtaaggtgataccaattgctctatcccttcctgctcttcctcccactttctcaaatactctgtcccaatgtttggtttggttttggtccctgtggtgagctgcagctattcggtgggggaagtcgtcggcgctgccattccagaagctcgccacatcggactttgacccgtgggagaagctctgccgccacgctcacccaccgtccgctccgcccgcagcccgccaccgcgctcacccgccgtctgctccgagcacaacctgccgccgctctgctgccacactcacccaccgccgcgctcgcttgccgcccacgtccgggctcgccgattccgctcgctgctagcccgaagaaggcaagagagaagaaaaaaaaaagatgtgcagctgacatgtggaccccacctatttttttattttttttattgactaggatgccacatcagcgaaaccacccatatattgatatatacttgttaacgaccaaatttggtaattcaagtatgggggattgttggcgatatggcatgaggccttcgaccaaatctgctgaaaccagtaaggattcaagcccgaaacgtcaagtttagtcagggcgaagccccccatggcgtagactaagaagcaaggaccgcgagaggcagggaatcgcgcgggtaccttgccaggccagaggcctcctgggcgaaggatgcagggcgaagagtatacgcggaagggggacaacttcgccatagcaaattcgaccccgggaggaccaaagaagccatcctagcccatcaagcctaagggctaattgggtcgataatcgcttgacggcccgctaagggcccatggaccacaattacactatgtacccatgtaaatgtccctttcataagggcaaccatgtaaattcctctgtataaccaaaaccctagtagtaagaacctgtatgctataaatagccccataggaccatgtaatagggggatcctaagaaaaattctcaatttaatacactttacttctttcccaactactgttgagtgaccacgtgtttcgacgtatgcggttgtcgtttcgatcacagggatggagataaaaccgaagcggaatccaaggtagagatcgttccggaaacagagcaagaatcagctaaagtccgaatcggccgcgaccaggatcggcagagttcgagtcggacaagggtagtcgattgagtcgattccgacaatgtgatttggtacacgttgtcagattgggttaatgtgcttcatatggattgccacgcacggactaagtcctgaaaaggcaattgtatctattagttaggatattttatgtaatttccttagagataagtttgggcaaaagtctgccgcaaagacttatggtatcttagagtttgttagagataagagtcgtgtacgacaagaacatagtttgtatctcgggtataaatatgacccgaacccatgtaatcaaacaatctcggtgcatcgccacccttttacttttgtttactttcgacgagttcttgatttcgggttgagctgcatcggtttcgatcttcaactagaggtaaaatatgttatggcggcttgcgttctcaggattagtgcttctatctttatgatactctaatcttgtttatgtaattcgtcgagttatcatatatcttatgtaatctttgacaatattgctatctaaccctcaatcggcgaacatctatcattgaaaggcaaccgattaggttaaatatcaatattgactcagattatataggatatccaccaccctatgaaacatccaacggcttgatagtctagatattgtctttcttttcatacttatagctgcatcagttgagtttgaccttataagtcgtgattagaatcttaatctctagcctgtctttgcttgccgatttgggtagtatcgtggtttcagccgatcttacttgatttagccttatatcttatgtgctagattgatatgttaaatctaccctttatgctaagatcttgtcgcatctaggtatattaagcttcatgtttgatatattttgcccgatttaatatcttaatatagagtggtatcggagtattagccgatacatgttaaatctatctgatcggctatgctatgaatgctataatctcctttttaatatatatttcgatctaagtgatttatactgtctcggcatggcgaccgatctatcccaatcacatgatttaagtatatattgatggaagtattatatatcattaatatctttagccgatcgaatacatttagtcctttcttacctatttatgattgccgatcgacttaaatatgacatcggctcaaagataaataatacatcatcggcgactggccgatcggctatcgtttatggatttaaccgctatttttctatctttatttcttgttgattgcaggatcaaatcaactagcacgctcacgaacctaaaggtaagatttttggacttgcactgaagttaagcagatcttccaggccagtgtgtgtttttcgcatcaacaatactgccataggatgccctcccggacatagactcgggccccacgtgcggggccatcctggaggccctcgtcggggtgggaggcgaccgtgggagcggcgccgacgaggtcatggtggtcggcggcggagtcggaggctgcggggacgaggaggatagggttctggtggtcggggaggagcgggacgagaagcttggttctcacaatggctacgtcgaggggatcagggaaggaatcgctggttcggatcgcgcaaaaggcaatggagaagaggggaagaagatggaggtggtggtggttgctgtggagaagacgatcttggtggaagatttctcgtgtgagctcgattggtaactctagtactctactactacatcttcgcacaatgatgtgagtttttttttcttttccagtttgtttggttaaactagtctcttagaagttagatgtactacgatttactgtatttttttctcggttgttgtttgttagaatgtgatgcttggcttttagatcagatgagatcccatgaagtcatgtttcactgccgatggttgtgaatgtggctgttccgctgttcccctttcaggatatttgttcaacttaggtatatgtacaaatccatacaaagacccgtagaattatttgggacattccaactaatctagaataactttgttaaggtcaactacagccaattcgatgatgatttaatgttttattcacgtggacaaagaggctctaatcaacctctctaagcatagtgtgaatatcgtacacctaaaagagaaatccgtgctttattaatgtggccttggagaatgatttgttagttaaattcacaatcgctgatgcaaacatataccagaaacattcggtttgcagcttaggttgtctgttagatattgaagtgtcacataaaagtgacgaacaggcctcaagtattcattgacagtacgtaccatgatggtttaataaaaggaaattaacagggtctgaatgttaaaaatagaaataacaaaaagaaattacaatatctgagctgagcacagcatgtagctacatattttttcgaatcaaatattaattctggagagatatcacgtgaataatgattggcaactacaaatatagattaaatttcaaacttactacatacttttggtcatctctctgtctctctggtcgggtgcatctaatgacgactcatccatgtcttgtgtgcccatcttttgttgaaatcgctgcccagccaaagattatcacacagggccaatatgtaattagcgttcgaataagtagaatctgtgcaataactagcaatacccgattgcccctcctaacatatagtgctattgcaaaacgaacgccatttaaaggctccgtatataagcacagtgatgcaatcatcatcattgcacagattgcaattgcagtgcatcgagtcactggggccagcactaaatacatacctagtgcaaaggcagtacccaaacttgtcactgaactgaaggccaggagtagagatatgttaaagtgccgacggcgaagtggtagactaaccataggcattccagagtacatgaggttgatgatagccaagctcgagcaaatgaatgctattgtgttagccatgatgaatgcatcaaatatataacttccagcaagtgttggtgtgccaccattattgtgatcgtctgctttgtaacctcctggtatggcaaacattacgccaaacgtgacagtaacaatcagcactgaggcaatacccaaagtttgtgttgaatttgtcattttgtccgattccctcacttcatctacttgtttttgatgaataatatattgttcctgcaggtgatctacccgacgacaaccacctcttgcattgcaaaacgttagtgcccgcaatatcagtttgttagggttctgcaaagcaaacataatggatcagtaggtcagtactctttatttttcttgagtaaattacactcacggtacatgaatttgtgtggtgggtgcaaatagatataacagcttgcaaattgctcactttgatataataacttggctagtaggtgcgaaccgggccaaaatgatccatacaagtaaaattgttctaaattagtgcacaataatgacataacagcatatacgtacaactatgatttggagatcttatttcgaatccaaataaaaagaggaattagatgtccaaaagtttatttttcatgtataggatacaatatttatttcattttttggaaaaaattgatcatctatataactcgtctaatgtttatttatctattcaagaccaagataatttttatatgtacaattaactactaaaagaacattttaattttcattttcatgttccgacactttcattgaaagtgtattttaatgattaggtatttttaattattttgtttttttttctaaatcttgaaagtatcatgcgaataatagtaataatatgtgtcagtataaaattttgatgtgtaacaacaattacaccagtagtatgtatcatattagatcaattttacttttgcggatcggtttggcctatgtttgcatgaactagccaagttattgtacccgaataagcaatttgtaagttattgtacctatttgcacccaccatacaagtttgtgtaccatgaacgtaatttactcatttttctttgttaatcaaaaagggttaaaagtgtaatcttacccatccatagaaatatcctgcaagaatcttactctgcgatatatctaaagcagtttgccccttattatttgatatatttaagtttacctccttattcatcagtagagaacagaagatagccttattcccatgcttcactgctatgtgcaatgcagtgtttccatcgttgtcttgcatattcaaaatcctagccaacgattgagtatggcaagcatacacaactacattccatctttccctttcaacggcaacatgaaggaaagtcctccccttagaatcgcgtaaaccagcgatct

SEQ ID NO: 44092 - DNA, 3229 bp, Oryza sativa
gtccccgtagtacttgttctcaatttttcttatgcatcagtggatgtgtttttttcagctgagtgcaatttggtgcgacagctgtatgtttttatttgtttaatgaaattgtaagatagcttgcacacatgcgcgtccatcttttttattacgaatatttatacttattctattgtaaacatgttttttttaaaaaaatttatttgggattaccattgtggcgtataacaatgtataacttgtaaactaaaattacttaaaaacaccgagttttgaatttataagaaaatatcgtgtcacgatgaagttgctacctatgaaactatataacatttgtacataagtgtgtttttgtaagtatcttacttttggaatttctaaattctactaagtaacatttttttcatactatatatgtctttgtgaattttacaatattttatttgaagatattatctattaaaaatatagataatatgaccgcatcatctaattaaatgaggtggatatgttgaagtattgatttaattatcaggatatagttttgcaataggaaactacagttgtcctatctcttagcgattgtcttcctgttggctatctcttaacgtggcttgtggctatggctctctatggctcgtgattgtatgccctcttcttctaggaagaagacgagagaaagaaggaagaagatggaaaataaaggatattgatggaaaacgtgaagacagtggcacggtccaattttgtaaaattttagtgatacgactattaatagacgaattttaatgtcatttatttgaataggcaaatttgtaaaggcatggatccaattaagctaattttgtttattatttgactggttgaggtgggaatttcttggtttcgctgtttcttcgtgattcttttccttcccaaaagttttctccttttttttctccatacgaaccttttttttttggtaaaatctaaatcaagaggcatcttgttttaatgctaacgagaggccctaacaatataccttcactatagtactagctagtccaacaagcaagtagaaaaaaatatattcctatcacatgtgcttcaaataaaattctcttaaaatacttatccgatctatgatccaattacaccgttgtgttcataaaagttaaagttttataacaagatctcacatgattatgttttaatgaaaaaaatataaattactcttataatataccttaattaattttaaatttcactaaactacttcttcgacatataaaagtaaattcaataaagcataaaagtaattacatatattatattatagaagtaacttaaaataataatttacatatattatagaagtaacttaaaaaaaagaaagtaactttgtgatgatattaaaagtaaatccgttatggagataaaaacatgagtttatctagcaattaaatttaattagcacaaattacggaattgaccaaaaatgataataaaataaacaatatattcacaacatcatgaatgtataagaagtaatttaatcaaatcgaaaagtaatttatatatatgataaaagtaacttatttatataataaaaatattttacaatatatatatatatatatatatttatttcttttatcaaaatatagtcatgtaagatcttgttgtacaaatttaattgcaacaaacacaatggtgtaatcggattatggatagataagtaatttaaaagaaaaatctataagaagaaaaaaaaggcatgtattattcggtttactagtaggcaaccagatctaaagatgagtctctggttaagacaatatagggtgcggtctctgtgtagttacatctttttattgtttgttttttttagaagatccatttttcctgctctaattttggtaattgcgcttgactttccttttaatgatcaagttgttaataacggcggcaataatcagggttgcatccatttgagccggtagagagccggctattctttttcttttaccatggaaaactggcacatctttttaggtgttagttttaaaaacctagtacacctttgtgaaatatgtctctaaattggtgccagttgagaagaagttcccatccggtatctatgggtactctgtagcagtgatgtcatgtttcccttatcaaatgctaatgttgttacatatattgacaattatttggttaaaactgccagtttgttacaaatttatagtaaggtatttcacaaaatttgttatgaaacaatagggtgaactcatccatataaaaggatggatcgcaaccgaaggcatccacgcctcttccctaggcgctccttggcaacggacgcgtctacagttgccacctcttccccctctataaattgtaccgcattgatcaataaaggaccgcattgatcaataaaggacatccactcattcgctctattgtggtcaattctctctctcgctcaatcaatcttacccactttcaacatgttatcagcacttagctctaagcgaagagaagaaatccgattgctttttatctcaagaaaaagcgaagaacagaagaaactaaggaagcgcataaggtatgtctaccttgatttcatcctcgatgccgttctcggcctccctcgccgagaccgcacccatcgccttcgccacctcctctgtcgattcgaggagtcgccaccatcgccatgccgggcaccattctagggttggtggccgccgccaccatcctcggcgcagcatttgccgtcgctgctacacctccgactccaccaccacaagcgcccgccatggcaccggcgccccgccgcgtccaggtccaggcaccatggatggattgcggtggtgacacccgccggcgagcagtgctccctcccactggagatggagtcgccaccggcaccgttcgtcgccgctccgccatcaccttcacctcgtcggagctgctcccccgatcccgcgccgccggggtttcggggattggaactctcaccacgcgcacggggtagccggccttctaccctccatcatagtctcgccaccatgctggtgaagccgccgcttgccacccagcctccccgctactttccgcccgcgccattcctcacgactccccgagttgcacgctctcaaatggagtggggagaacggcgtccgaacccgaccggactcttactccgatgaggagagggggctgtcggcggacgacgggggctgcg

SEQ ID NO: 44093 - DNA, 7912 bp, Oryza sativa
  unsure (1)..(7912): unsure at all n locations
ccacccattttacccctttattttagtttttaattttattttagcagcaatttcatattagtccctgtgttttatttaatttagtacaagcagttcatcagttgtacaaattacaatgtaagaccactggtgttatatgttacttaacataggtgtttattcaaataccctgcttcactaaatttcatgttgtcttaattaaatgccttttgcatattattttgagacatgctctacttcctcgcttcattaatttacaaaattctttaaattttgtactttaatttagcaaattctcttaattatgtacaacatgattaatggaggatttaatgcatgttccactacacattttgactcggaaattaatcacatgtagctggagtcctatattttggtcatcgtgaccataacctaggtagcaagtatgttgcccatcattaagtgttctacattttgagatgattacccggtggagtcctacaaattggccacactggtcataacctaggcagcgagtatctcgcctatcacacagaggtctacatctcacgatgattacccacatgtggtattttccgagaatatgttttgaaaaatgagattatttgaaatttggataaacacaaggtagtggagtcctaaacattggctgcggtatattcaccagaatatatttgcctagagatcatgttttaggcagcaagtataacttgcccactattaagagatctactccactgtttaattacttggagattatccacattgtgccacctaatttcgaattctaactcaaattatcaggtctataacctacatcttttcgaaacattacaaaatatgaagtcttacatttcgcattgagattacaacctcaatgtcatgtttttattaatttacctctgtaaataaataatgttaatcatgattatagggacatgacaactatagagttcgacgaactcgccctcgatgggagtaactacccaatttgggcttccgatatcaaaataaatttttgttctcgtgggatttcaaatacaatttaggaacccaatgattgggatccactagttgagaacagaaagctatatattgccattttccttctaaggctctacatctataaagatctcaaacatgagtacatgttggagacgagccctctcaacctatagaaagctctaaaagagcgttatgatcagcaaaaggaactcatttggcctgaggctaattatgagtggattcatttacgcctacaggattttgcgaaaaagagccaacggaagcagagaagatagagaaaactctatcaactatgtttccaaaggacaggatactgaaccaatagtatcgcactaaaaggattcaagagaaattcctcgaataaccctaagaatctaactggacaacgcaaacgcaacaacaggcgcaaatccaatggtcgacagaaaggaaaagggaaaggtcaggcaccacaacctcgtggcaaatagcaacaggcattacaacaagtgtggatctgactatcatgtcactaaagattgccgcatcccaaaaacatcttgttctcatgtatcagaaatccctaaaggagaaaaataaatcttctaaagaactaagatttgaagctcactttaatcttacaaaagaaagacctgagattgaaagttctcaccaggttgaagctcacttcaatcttacaaaagaaaaacctgagattgaaagttctcaccaggctcctattgaaccagagaacaacctcgctcttctcctagaggataccgcggcactttctgcaatggatgacatgctcatcgagtactgctcaacggacccagttggagatttactatgatcgcagtgcaccccacttagagataaagctgctttaatctcagtgtgtttgagacattatattgatatcctatagtttgtcaaaacaatattggttgtaataagtagataagtacaaactcccttatattataaggttgtaagacttgctagtcattagagtatgtacttataacatttgtaaacatcatactatgtatttgatgttttaattattgtatgtatgtatatattgtggataaagaattcttcactaagcaattcttctttcactatagatgtctaaggatatgactccgattggagatgaattatgtcttgtggacagtggtaccacaaactctatacttagggagatcaaatactttcaagctctcaaaaagagagaaggcaaagttttgactatcgctgggcgcgatactgtgatatttggctcaggacgagcaactattacactcccaatggatacacaaattacaatcgaggatgctttattgtatcctgattcaacccataccctactaagttatagagatatccgtcaaattgggtttcacattgaaacccatatgcataatcgagaagaatttcttctcttaaccaaacaaaagggatatggcaaacgcatttgcgagaaaattccatctctcacattgggattgtactatacatacattaagcccattgcacatgttgtgtacaaagtgattttttaaaatgttgatgcattccacacttggcatgatcgacttgagcacccggtatcgggatggtgagaaaaattattgacaattctattggtcatcatttgatcactgacaaatttcccaaatactctgatttcgtatgcacagcatgtgctactgggaaactgattttgagaccatcttatctcaaaattagagccgaaccacttaaattccttgaacgcattcaaggagatatctgtggccctatggtgccaagatctagaccgttcaggtactttatggttttgattgacgcatctactagatggtctcatgtgtgtcttctatcgacacgaaaccatgcctttgccaaactaatgtctcaaattataaggctgaagggaaattatcctgaacataggattcaatcaatccgtatagacaacgctgccgaatttacatctcatgctttcgatgattattgtatggcattgggaattcaggttcaacactctgttccatatgtccacacacaaaatggtttggctgaatcattgatctaaagaattaagcttattgcccgaccattattgataaactgcaaattaccttcgttgtgttgtggtcatgtagttctgcacactgctgaccttgtccaactacgaccaactgcattgaggaaactgcatatcgtgaaacttccccaatgcagttagtacgtggaaatcctccaagtatttcccatttgtgtaagttcggttgtattgtatacatactgatctcaccaccacatcgtaccgctatgggcccacacaggaaagtggggatctatgtgggatttaaatctccgtcgatcataaagtatttaaaacccttaataggtgatctatttactgcccggttcgctgactctatctttgatgaggaaaatttcccggcattagcgggagacttcaagtaccagaaagaatgacaggaaattgattgggatgcccagggtattccagcctcacacccacgcactactgaaactgaacttcaagtttaggaaattatacatttgcaaagcctgacaaataccttgccaaaggccatttcctattaataaaggtgtacttaaatctttcattcctgctcagaatgcgctagaaagagtggaggtaccaaataaaaccactcaacttccactcactaaaaagagaggaagaagtttggccactcagcgagatacagttgctagcaagaaaagaaagacaataaagcaaaccaaccttaagttggtacacaccaaattgatactatgtatcaagcagatcgtgataatctgcaacctagcccagttgtgcataatgctgagactaggaattcagaagaccatagacacattgttttgggaaatcacaatgagtctataagggttgatgaaattgccatcaactactcggaaactggagaatcttttgatagaagagctacaattgttgacattaatttttctgaataaattgctgattgcctgcaagttgatccagaacctaggtctataaaagagtgccaaaagcgctctgactggaacaaatggaaggacgcaactgacgcagaattagcctcgctttacaaaagagatgtattctcggctgtaatgcctactcctcgtggtatctttcctgtgggatacaaatgggttttcgtctggaaacggaatgaaaacaatgaggtggtgagatataaagcaaggcttgtagcacaaagttttacgcaaaaacatggcgttgatttcaactaaacttactctccagttatgggtggtataactttccgatatttaatatcattgatagtacaaaatcgtctatttatgcagttgatggacgtagtgacagcatacctttatggatcacttgattctaatatttacatgaaggttcctgacggaatcgacatgccgaatcagaaggtaaatcgtaacatgtattgtgttaagttgcagaagtcactttgtggcttaaaacaatcgggcaggatgtggtacaaccgattaagtaaattcctttcactaaagagatacactaaaaatgatgattgcccatgtgtccttatcaaaaagtcccccacaggattttgtattatctcggtatatgtcgatgatcttaacatcattggcaatacacaagatattaatgaagcacgtcatcatttaaagacggaatttgagatgaagaatttgggtcaaaccaaattttgcttaggtatacaacttgagcatttaccttctggaatccttgtgcaccaaagtgcatatacctagaaaattttggagaaattcaatatatggacaagtcatatctttccaaaacccttatggtggttcgatctctagacgtggagaaagtcccatttagaccaaaggaagatggtgaggatgtgcttggacctgattttccatatcttagtgctattggcgcacttatgtatcttgcaaatagtacgaggccaaatattgctttctcggtaaatctattagcaagatatatcgctgctcctaccaaacgccattcgactagagttaagaatgtctttcgatatcttaatagcacaagagatcttagacttttctttaaaaagaaccaagattcgaccttaattgggtatactgatgctggctatctatctgatccctacaatgccaaatcacaaacaggattcgtacttttacaaggtggaactgctatttcatggaagtcttctaaacagacactggtagccacttccacaaatcattttgaaataattgcattatatgaggcatcacgtgaatgtttatggcttcacagaatgattaaccacatattaacatcttgtggtattggttcattagaatcacctaccattatctatgaagataatgccgcttgtgttgtttagatggaaactggttatattaagagcaacatcactaagaatattgctcctaaattattttatcctcatgagcttcagcaacatggagagataaacatcttgcaaactaagtcatgtgataatctcgctgatttattcataaaatctctgccatactccatattttttaaatgtgtcgaaggaattggtatgagatgacttaaaaatttgcaggattgagggggagtaactctctctgggaaataacctattttcgtcatattatactatttttcctttgtatgagttttaccctttatattttctcatccaaagtttttaacgaggtaatatcaacataagttatatgtcttatcattttgcttttccccactagggtttttactaaatgataactatagacattatactaattttggaccatactatgagctttactcataaagtctaaaaatagttaactatatatcacggttcttctccttattttcccaatgggtttttgaggagtttacctgatgtatctaatacaataaattataattatttctaagattatgtttacaaatattctggaacaatgaaagagcaatgatcaaagctggattcgatcaagggagagtattatgaaacaatagggtgatctcatccatataaaaggattgatcgcaaccgaaggcaaccacgcctcttccctacggaattgctactaggcgattgctcgctcagggcgatcagatccgatccccctccccctcctccacgtgggttccttttttggcaccgcattactttcctattttagtaaatttatgcacctaaagtttgtacacctcaagtttacacatctaaagtttatacacttaaagtttagagacccaaagtttataagtcaaaagtttatacatcagattcaaatttgaatttgaattcaaatatattttatatataatatttctgtacatctaaagtttatagacctaaagtttataattcaaaagtttatatacccgattcaaatttgaatttaaattatatccgattcaaatttgaacttgaattcaaatattttttatatatagtatttctttacatctaaagtttatacacctaaagtttatagacccaaagtttatgagtcaaaagtttacatacccgattcaaatttgaatttgaattcaaatattagtttatagacccaaagtttataagtcaaaagtttacatacccatttcaaatttgaatttaaattcaaatatttttatatatagtattttctatacataaatttttccaactttatttttttattttttttaaatttatggtgtagtaggaagagaagaaggggaggaggaagggaaagagtagagtatagggggacggagagcgatcacccgcccattagcacccccctcttccctaggcactccttagcacccatttcctatctataaattgtaccgcattgatcaataaaggacatccgctcattcgctctattgcgttcaattctctctctcgctcaatctctctcgctcaatcaatcttatatactttcaacgaaattgacacgatagcaaaccattttatttttattagaaagctacaaatatttcccactatatatgtgcgtatgacttgcattgtgggccccaacttgcaaaagcatgagttttgcatttgtgtatgacatattgacctataaacttataaaacaaattaagttgtcgctttatgataaaagcaaatatatgattcaaaataagtatggaatatagctagaatgaaattcaaaacagcaaatataaattgcacacgtaccttggtcttgtagaacggctgcgtgcaatgcattttgtctatttgggccagagtacgaaagattcccgtctgtcatttgatgcaataactttgcaatgtcgacctgttgatgcaagacagctaggtacaacggtgaagtacctgttgcatccataaggaagccggccaattctgaataatatttaagaaggttggtgattatatccttatttccaatgcagacggcatcatgaaaggccgtctccttacggcagttttcctttctcaggagttcctccagtctcgcgctgctaggggagttgtccttagtttcaaccagatcaattagatgatcaaccattttggaatggccagcccggacagcgcagtgcagaggtgtgtcaccgttgttgttctgcactaacatgagatgttgggacctgctgtagatgacgcctgcactcctcaagtagcccgggccatcaccgcaggtggccacaacatggagtgcagtgttcccttcagtggtgaccccgtccagatccatgcccgactctgcatctgcaccagnnnnnnnnnnnnnnnnnnnnnnnnnnnnnnnnnnnnnnnnnnnnnnnnnnnnnnnnnnggctgcagga

SEQ ID NO: 44094 - DNA, 1393 bp, Oryza sativa
taggtggagtcctgcttataccccagttgagcgcctgtgaagatggagccgtaggccgctagtccgctgctgtttattttttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaaattatttgcgaaagttcctttttctccttcccctaatgctatttgcaaaaggtttactccgttcttccttcttcggattttcaactagtactagatggtcaggtcagtgaagaagaagacatcgtcagttgtttgccgaagctccggaagactgcaggatccgctagcgaaatggaggaagtagtgaagccagctgtgtaggagtgaagatcttgggaacccatcgcagaacctaagccgccctctagggtagagttgttagtcgtgtgtttcattgcttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacttcaagctcccgagtgaatgaagcaccagacaccagttgtgtgacactagtccaacacctggttaaccagaaccgattgcttatagagatactacagcagcaccagacgccaattctgaacttgagtcaaatacaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaagatgaagtccgtaagatgatcattaccagcacagaatggcctccaccaggaatgacaagacgtcagagaagaaataccttccgaggtgcaacacagttgacagagcatcttttagctaatggaggtagagtgtctggtagtgaagattcagatcaagtctcctccgatgatgaagatgagaagtctccccaaggttttaaccagtgatgagctactgtac

SEQ ID NO: 44095 - DNA, 2321 bp, Oryza sativa
aaggttcctcacagttagcggttggtacttcgatcgcgggcctttcctttactttcttttttgttcagaattgaacaaagaatttggggaagaaaacatcttcccccacttatcatgaaatctgggccatagagaaagagtgagatgtttttttttatttatcatagacactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagaacatataggcccgagaccattaccaaaagttcttcccaataatcatattgggtatctgttcccttccttttcctattaggatggggcatgttggattttccatatccatataccatcgaaccttaagggttccagaaccctccttttttgctagttttcggaaacggaaaaccctgaaccaggagcagtataaattctactgcccgccttttacaagaaaattggtgataaaactccactacagtttgttcaaaatgcaccaatcagaatcccttgagaatattcaagtaccctatttctaagatatttctaagagaagaggtacctgctgaaaatcgcttcaacaaatccgcttaagaaaaattgcaaagttttgaactcgaaggtttttccaagggatgcctgttaaaaattgtttcaacctctcaccaaaacagacaagaagtatatcactgaaaattaatacccagccatatgggtatatgaagggcgcgaattcgtttataccccacccaattagaggaaataaaacataaatggagaaagttttcatgataagatcagccaatagaagaaaaaagtccctaatttttcagaccgttctgagcatgtgaaaagtcaatagcctaaagataaaaaaccctatactttgtgcaagtgataagagagaatatgaaagattttcctatttttcttgattttcttaagatttttttgaacctgaccatgaatagacttatatatctcgatatatacagatataatgtacattatggagtagacctataatgggaaatgaaagtggctaattttggaattgaataagaagcccttttaactcagtggtagagtaatgccatggtaaggcataagtcatcggttcaaatccgataaagggctttttttacttagtggtagagtaatgccgcggtaagacgtgagtcagtggttcaaatccgatacagtacttttctactaaattcattcactttctttctttttgaaaatttctctttttttattgaatttgataacttagtgcgagatgcatgcatttttagtttaaacactaagcgaagcaggggggtgtaaattccaaaaaagaaattggactctttttcctattagatcaatcaaatcactacccgtactgaactaatatagaatcccttttattaatctattcttattccatatcctttataaacgaatttccctaaaaagtaggggatgatccgtgaattaacctaaccatcaactaaaaaaaatcctacaaaagcataatggaaaagtaggaaggactccttgctttggatctagttatactcttcgagtatattgacaattccaaaaaactgctcatactatcattatagtataatgaggagcggttgtataccgccctatcgtctagtgatgcccctatcgtctagtggttcaggacatctctctttcaaggaggcagcggggattcgacttccctgggggtagggagtattatgaaaggaggttaatcatagattatcaaaaaccctagaataaattcttcctgggtcgatgcccgagcggttaatggggacggactgtaaattcgttgacaatatgtctacgctggttcaaatccagctcggcccaaaaatctagggcttcgtgaatatgagttaaatccattttttttcttccataaaaaagaatatttgatccatagaaataaaagaaataaaggataaaaagaaaaggggaaatatctttctaatctatatctctttcattcctctcttacaaacaaaagaccttttcttattggttattgaaaggtggattattatctatttttagcgataataaatcgcgacatactagttatgtcattctcactatacccccatacgatacgggggtatgtagtatatgattcgtctatttcttag

SEQ ID NO: 44096 - DNA, 3516 bp, Oryza sativa
ttcaaaagagcataaaatttattttaagaactaagaataagaaaagaatataaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctatttctattctactatatagaaatagaaatagaaagaatagaaagactctttcttacaagagtttcttacaggagtgaaacaaaattaaagaaagagagaaagaataaagttcggcaaaatgattaatgcaaaacggtcaattaaagaaaagagttgatacaacaattcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaggctatggatgaatcagttcaaagaatttactcttaacaaattcttagagtatttctggtagaattggggagcattaagtataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtactataagcctaagtattttattgatcaggcggcacccagatttgaactggggataaaggatttgcagtcccctgccttaccgcttggccatgccgccaaaaaatacgatctaaaatcgagaaaagagcaagtattcatccacgtttcttactaaaactaactttcttttatcttaaatctaattctacttacttttttccaatctttttcaaaaaatctattcatgctttttttggatccagtttcgattattctcctcaaaggattctatcttaaaacacacattgctaacactagaaaacttcccttttctttctattgaaatgaaaaaggagaaaagtggatttctagtcacaagctacaaaattaagaacaaattggaaccattaactagaattctctttttattttgaatttcggtattctctccgcctgccatttaatgtcataataaaagacaatggatttatgcctaatccgtatataggtaaactccaggtccgaacagcattattatctatggatcccccttatgtacatatctctgtggagaatcgttctttaatttttcattgcattaaatatcttgaataaaaaaaagaaaattgactttgctatgtggaggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtcctttttatgaaatatctgagaaagcaaagaaaaaaaaagagagacaggtggtttatttatcaccaaatagagatgagtattatatgata

SEQ ID NO: 44097 - DNA, 9266 bp, Oryza sativa
cattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgataaaccagaaaaagatggattgttttgcgaaagaatctttggacccataaaaagcagaatttgtgcttgtggaaattctcgagcgagcggagctgaaaacgaagacgaaagattttgccaaaaatgcggagtagaatttgttgattctcggatacgaagatatcaaatgggatacatcaaactcgcatgtcccgtgactcatgtgtggtatttaaaaggtcttcctagttatatcgcgaatcttttagataaaccccttaagaaattggagggcctagtatatggcgatttctcttttgctaggcccagtgctaaaaaaccaactttcttacgattacgaggtttattcgaggatgaaatttcatcctgtaaccatagcatttccccctttttttctaccccaggctttacaacatttcgaaatcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccagttcttcctcccgaattaagacccattgtttataggtctggggataaagtagtgacttcggatattaatgaactttataagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccaacgagggatggtcacaataaagtatacaaatcactttcagatgtaattgaaggtaaagaggggaggtttcgcgaaactctgcttgggaaacgggtcgattactcggggcgttctgtcattgttgtgggtccttcactttcattacatcaatgtgggttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataatagttgcggaaactatccaaaccaaaaagtaaattacaataataataatcctaagtatacgaaagataaagaatctcttttttctagttcctatgatgcactgggagcttatagacagaaacaaatctgtttagacagtcccttgtggctccgatggaaactagatcaacgcgtcattgggttaagagaagttccgattgaagttcaatatgaatctttggggacttatcgtgagatttatgcccactatctagtagtgggaaatagaaaaaaggaaatccgttctatatacattcgcaccactcttggtcatatttctttttatagagaaatagaggaagccatacaaggatttagtcaggcctattcatacactatctaaacaaggaagttagattcggggatgcccctttcgaggggcattccgatttcgctagtatcatcatttttgccgcacgaatccagattgagattgaggaaaggaagttaactaagttttcgaatcactgactcaggcccattgtcgaatcctactcagcaattgtcgaattatactcagccgaaaaagggggtacttatttatggcggaacgggccaatctggtctttcagaataaagagatagatggaactgctatgaaacgacttattagcagattaatagatcatttcggaatgggatatacatcccatatactggatcaaataaaaacgctgggcttccatcaagccactactacatcgatttcattaggaatcgaggatcttttaacaataccctctaagggatggttagtccaagatgcggaacaacagagttttcttttggaaaaacactattattatggggctgtacacgcggtagaaaaattacgccaatccgttgaaatctggtatgctacaagtgaatatttgaaacacgaaatgaattcgaattttcggataacagatccttctaatccagtctatctaatgtctttttcaggagctagaggaaatgcatcgcaggtacaccaattagtaggtatgcgaggattaatggcggatcctcaaggacaaatgattgatttacctattcaaagcaatttacgcgagggactttctttgacagaatatataatttcctgctacggagcccgcaaaggggttgtagatactgctgtacgaacggcggatgctggatatcttacacgtagacttgttgaagtagttcaacatattattgtgcgtagaagagattgtggtactatccaagctatttctgtgagtcctcaaaatgggatgacggaaaaactttttgtacaaacattaattggtcgtgtattagcaaacgatatatatatcggttcacggtgcattgccactcgaaatcaagatattggaattgggttagtcaatcgattcataaccacctttcgagcacagccatttcgagcacaaccaatatatattagaaccccctttacttgccggagcacatcttggatctgtcaattatgttatggtcggagttccactcatggcgatctggtcgaattgggggaagctgtaggtgttattgcgggtcaatctattggggagccagggactcaactaacattaagaacttttcatactggtggggtattcacagggggtactgccgaccttgtacgatccccttcaaatggaaaaatccaattcaatggggatttggttcaccccacacgtacccgtcatgggcagcctgcttttctatgttatatagacttgcatataactattcagagtcaggatattctacatagtgtgactattccttcaaaaagcttgattctagtgcaaaatgatcaatatgtagaatccgaacaagtaattgcggagattcgtgccggaacgtccgctttgcattttaaagaaaaggtacaaaaacatatttattccgaatcagatggggaaatgcactggagtaccgatgtttatcatgcgcccgaatatcaatatggtaatcttcgtcgattaccaaaaacaagccatttatggatattgtcagtaagtatgtgcagatctagtatagcttctttttcgctccacaaggatcaagatcaaatgaatacttattccttttctgttgacggaaggtatatctttggcctctcgatggctgatgatgaggtaagacatagactgttggatacttttggtaaaaaagatagggaaattcttgattattcaacgccggatcgaatcatgtccaatggtcattggaattttgtctatccttctattcttcaaaataattttgatttgttagcgaaaaagcgaagaaataggttcgccattccattacagtatcatcaagaacaagagaaagaaccaatatcctgttttgggatttcgattgaaataccctttatgggtgttttacgtagaaatactatagttgcttattttgacgacccacgatacaaaaaagataaaaagggttcaggaattgttaaatttagatataggaccctagaggacgaatataggactcgagagaaagactcagagaacgaatacgggagcccagaaaacgaatataggacccgagaggaagaatgtaaaaccctagaagacgaatataggactcgagaggaggagtatgaaaccctagaagatgaatatgggatcccagagaacgaatatgaaaccctagaagatgaatatggaatcctagaggacgaatataggactcgagaggaggaatccgaggacgaatatgggagtccagagaacaaatataggccccgagaggataaatatggcactttagaggaagactcagaggacgaacatgggactttagaggaagactcagaggaagactcagaggacgaatatgggaacccggaggaagattccgtcttaaaaaagggggttttgattgagcatcgaggaacaaaagaatttagtctaaaataccaaaaagaagtagatcggttttttttcattctccaagaactgcatatcttgccgagatcctcatccctaaaggtacttgacaatagtattattggagtggatacacaactcacaaaaaatacaagaagtcggctgggtggattggttcgagtgaagagaaaaaaaagccatacggaactaaaaatcttttctggagatattcattttcctgaagaggcggataagatattaggtggcagtttgataccactagaaagagaaaaaaaagattcgaaggaatcaaaaaaaagggaaaattgggtctatgttcagtggaaaaaaattctcaagagcaaggaaaagtattttgttttggttcgacctgcagtcgcgtatgaaatgaacgaagggagaaatttagcaacacttttcccacaggatctcttgcaggaagagggtaatctccaacttcgacttgtcaattttatttctcatgaaaatagcaagttaactcaaagaatttatcatacgaatagtcaattcgttcgaacttgcttagtattgaattgggaacaagaagaaaaagaggaggctcgtgcttcccttgttgagataagagcaaatggtctgattcgcgatttcctaagaattgggttaatcaaatccactatttcgtatacacgaaaaaggtatgatagcagaagtgcaggactgattctccataataggttagatcgcaccaatacccattccttttattccaaggcgaagattcaatcacttagccaacatcaagaagctattggtaccttgttgaatcgaaataaagaataccaatctttgatggttttgtcggcatccaactgttctcgaattggtttttttaagaattcaaaaaatcccaatggggtaaaagaatcgaatcctagaattcctattccaaaattttgggggctctttcgaaatttttcgggactcttaggtactattgcacctagtatatcgaatttttcttcatcttactatttactaacgtataatcagatcctgttaaaaagcatttgctccttgacaatttgaaacaaaacttcaaagtacttcaaggacttaaacactctttaataaatgaaaatcaaaggacttcaaatttcgatagtaacatcatgttggatccattccagttaaattggcactttctccctcatgattcttgggaagagacatcagcaaaaattcaccttggacaatttatttgcgaaaatgtatgtctatttaaatcgcacataaaaaaatcaggtcaaattttcattgtaaatatagattcctttgttataagagcagctaagccttatttggccactacaggagcaactgttcatggtcattatggagaaatcctttacaaaggggataggttagttacgtttatatacgaaaaagcgagatctagtgacataacgcaaggtcttccaaaagtagaacaaatcttcgaagcgcgttcaattgattcactatcgccgaatctcgaaaggagaattgaggattggaatgagcgtataccaagaattcttgggggtccttggggattcttgattggagctgagttaaccatagcccaaagtcgtatctctttggttaataagatccaaaaggtttatcgatcccaaggggtacagatccataatagacatatagagattattatacgccaagtaacatcaaaagtgcgggtttccgaagatggaatgtctaatgttttttcacctggggaattaattggactattgcgagcagagcgagcagggcgggctttggatgaatcgatctattatcgggcaatcttattgggaataacaagggtttccctgaatacccaaagtttcatatctgaagcaagttttcaagaaactgctcgagttttagcaaaagctccttacgaggtcgtattgattggttgaaaggcctgaaagaaaacgtagttctgggggggattatacctgttggtaccggattccaaaaatttgtgcaccgttacccacaaaacaagaacctttatttcgaaattcaaaaaaaaaactatttgcgtcggaaatgagagatattttgtttctccatacagaattagtttcttctgattctgacgtaacaaacaatttctatgagacatcagaatcaccatttaccccatttatatgatttaaggatacataaagcagattttttactttaaactagatttttgaccttagaacgctaagaggttagattttctatttttattttaatttaaaaagaagtttagttaattcattaaggttatgcttataccatgtagaaggttccatcggaacaattattatttatttcaagctatttcggctctttcttaatcttcgaaaagaaagaaatttcgtaatggaaaggtaggatgaaaaaaaagaaaaaatcaaaaggaagtgtggaaaaaatgacaagaagatattggaacatcaatttgaaagagatgatagaagcgggagttcattttggtcatggtattaagaaatggaatcctaaaatggccccttacatctcggcaaagcgtaaaggtactcatattacaaatctcgctagaaccacccgttttttatcagaagcttgtgatttagtttttgatgcagcaagtcagggaaaaagcttcttaattgttggtaccaaaaaaagagcagcggatttagtagcatcagctgcaataagggctcgttgtcattatgttaataaaaagtggttcagtggtatgttaacgaattggtcgattactaaaactagactttctcaatttagagacttaagagcagaagaaaagatggaaaaattccaccatctcccaaaaagagatgtggcaatcttgaagagaaaattatctaccttgcaaagatatctcggcgggatcaaatatatgacgaggttgcctgacattgtgatcgtcctcgatcagcaaaaagagtatatagctcttcgggaatgtgccattttggggattcctactatttctttagccgatacaaattgtgacccagatctcgcgaatatatcgattccagccaacgatgacactatgacttcaattcgattga

SEQ ID NO: 44098 - DNA, 4637 bp, Oryza sativa
  unsure (1)..(4637): unsure at all n locations
agacttaagcaaaactcagattgaggaagaatacggtccctgggttccctttattggaactatgttcctttttatttttgtttcgaactggtcgggtgctcttttaccttggaaaattatacagttaccccatggagaattagcagcgcccacgaatgatataaatactactgttgctttagctttactcacgtcagcggcatatttttatgcgggtcttagcaaaaaaggattgagttatttcgagaaatatattaaaccaactccaatccttttaccaattaacatattagaagatttcacaaaaccattatcgcttagttttcgacttttcgggaatatattggcggatgaattagtcgttgttgttcttgtttctttagtccccttagtagttcctataccggtcatgtttcttggattatttacaagcggtattcaagctcttatttttgcaacgttagccgcagcctatataggtgaatccatggagggtcatcattgaattgactagttttcaaaatagtcttttttttagcttaactcaattcatgcatggttgcggaaaattcgcttggttggaaaacaaaatagttagaattgcgtatgaatatacaatctagagttgtagaagagagaataggctatattacggaattgccaaacaaagtatataggcattagggaggggcggagtcaggctagatctatatcctttatgtctataagttcagtcatcttttgtatgggtttccactttaaggaattttttttgaatccgattcaatagaaaatgagaaaatacacaaacaaaatagaagaaacaaattgatatgggatattatatattcccaagttagattcattatctaatccgatatatggaatcggattccatatccaattcgatgcagcatattgttatcaattggatatcttgatttaattcctattggatctggattaggtcgatttccataggggttcttcctctatttcaccttttattatgaattagatgataggggaaaaaatagaaactcaaggatatcgaagaggaaagaaagaaggatggaatgaaagatcagttggttggaaagaaagagaaatagaataatgagtacacaaacctctaatgattagaaactaaaaaggagatctcgaagcagttcggagaattcagattatcgtttcaatttgtactttttagttacttctgtccaatagagcttagaaatatgaatttcttggttgattgtatccttaaccatttcttttttttgacacgaggaactcatcatgaatccactaattgctgctgcttccgttattgctgctggattggccgtaggtcttgcttctattgggcctggagttggtcaaggtactgctgcaggacaagctgtagaaggtattgcgagacagccagaagcagaaggtaaaatacgcggtactttattgcttagtctagcttttatggaagctttaacaatttatggactagttgtggcactggcgcttttatttgcgaacccttttgtttaatcctaaaaaagaaaacgagtcctttagattagatactttcttctttttttagtaaattggtatttgcttctgcaattccaattatatcaatactttactcctaatttattactcctagagttttctatttatggggacagacaataccccaccccaggaatagctgatttgaggatgatcaatttaaaggatatgttcgccgtcttgcttcccgccctttgtttagggcagtggaaagtatttttccttttattttaggaattttgggaacatttcaacaaaggaggtctttcacaggtcaaacgagatctaagacttaatctaaaagaaattactaaattgaatctatttctattaaaaaaaattgcattaaaaaaaccgatcaaaaagggcgagcgaagtaagtgatcgaaaaactttgttctttgttcgtcctatctataagaggagagcatatgaaaaatgtaacccattctttcgtttttttagctcactggccatccgctgggagtttcgggcttaataccgatattttagcaacaaatctaataaatctaactgtagtggttggtgtattgatttattttggaaagggagtgtgtgcgagttgtctatttcaagaatagattggatctatccggctgcactttagaatattttttagtatttttcgaataaataagaaaagggtgcacgatctcgacgaattacttctgaataaatgcagaaatcatatgaaagaaccatagcatttcgcgacctattggtaaatcaaatcaactttgattctctatagaccaataatatgagaccattaacacggttaaagctaaactgcttgaagtctaggcaaaagggggtactctttctacaactatattagtattagtaccaaatgctttaaacaggaaatagctaatgtagaatttatctgatatagaacactcatatcgataaaatggtttgaactatttactagaaggggcaccctgcccttttttatccaatgccgaatcgacgacctatgtataaaaaaggagaaagtttttggatttaaagaaaaaagtaggaattctatccattttcattttccatttttctatttagtttttcttaatgaaattgaaaattttaactaaagggcaaatacaaataaaaaaacaactttgctgcccacgatagatttttatctaggcggaagagtcctcttaatatttatctagtcttatatgggtttcggtatattgaaatataaacagaaaagagagggtagaggataggctcattacattaaaaaaaatatggaagtagccatagcaaaaaaagaaaaagggagcgtgagagccaaatgaatcgaaagattcatgtttggttcgggaagagatcataaaagttgtaaacttaatagcaaggtaatctactttcattaaaagatttattagataatcgaaaacagaggatcttgagtactattcgaaattcggaagaattgcgtagaggaaccattgagcagctcgaaaaagctcgaattcgattacagaaagtcgaactagaagcggatgagtatcgaatgaatggatactctgagatagaacgagaaaaagcaaatttgattaatgccacttctattagtttggaacaattagaaaagtctaaaaacgaaaccctttattttgaaaaacaaagggcgatgaatcaggtccgacaacgggttttccaacaagccgtacaaggagctctaggaactctgaatagttgtttgaataccgagttacatttccgtacgattcgtgctaatattagcattctcggggccatggaatggaagagttaaattaattaggccttgaacttctactttcctttagaatttaggcattatttttccccttgcttccgaaaaaaaaatagtaaagaaacactaatggcaacccttcgagtcgacgaaattcataaaattctccgcgaacgtattgaacaatataatagaaaagtagggattgagaatatcggtcgcgtagttcaagtgggggatgggattgctcgtattataggtcttggtgaaataatgtcaggcgaattagtcgaatttgcagaagggactaggggtattgctctgaatttggaatccaaaaatgttgggattgtattaatgggcgatgggttgatgatacaagagggcagttttgtaaaagcaacaggaagaattgctcagatacccgtgagcgaggcttacttgggtcgtgttataaatgctctggctaaacctattgatgggagaggcgaaattgtagcttcggaatctcgcttaattgaatctcctgctccgggtataatttccaggcgttctgtatatgaaccccttcaaacggggcttattgctatcgattcgatgattcctattgggcgcggtcagcgagagttaattattggggacagacaaaccggcaaaacagcagtagctacagatacaattctcaatcaaaaagggcaagatgtaatatgtgtttatgtagctatcggtcaaagagcatcctccgtagctcaagtagtaactactttccatgaagagggggccatggaatacactattgtagtagctgaaatggcggattcccctgctacattacaatacctcgctccttatacgggagcagccctggctgagtattttatgtaccgcgaacggcatactttaataatttatgatgatctctccaaacaggcacaagcttatcgccaaatgtcccttctattaagaagaccccccggccgcgaagcttacccaggggatgttttttatttgcattcacgccttttagaaagagccgctaaattaaattctcttttaggggaaggaagtatgactgctttaccaatagttgagactcaatctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagtannnnnnnnnnnnnnnnnnnnnnnnnnnnnnnnnnnnnnnnnnnnnnnnnnnnnnnnnnnnnnnnnnn

SEQ ID NO: 44099 - DNA, 41709 bp, Oryza sativa
  unsure (1)..(41709): unsure at all n locations
acaattcgcctctgctctcgataaaacaagtcacaatcaattggcaaggggccgacgattacgaaaattgcttaaacaatcccaagcaaatcctcttccagtggaagagcagatagctactatttatatcggaacaagaggatatcttgattccttagaaattggacaggtaaagaaatttctggatgagttacgtaaacacctaaaagatactaaacctcaattccaagaaattatatcttctagcaagacattcaccgaggaagcggaaatccttttgaaggaagctattcaggaacaactcgaacggttttcccttcaggaacaaacataaattttgcacgtctactcttgttagtagaagtagtagaggagaaatcgttgagaaagatttttcatttgaatcatgcaaaaaagttttcttagtttttagtatagttatttaaagaatagatagaaataagattgcgtccaataggatttgaacctataccaaaggtttagaagacctctgtcctatccattagacaatggacgcttttttcatattttcttctttcttttcattttttatcggaccaagagaaaaaactgttagaccaaaactcttttaggaaagaaaaacaaatgcatatacaaatgtatgatgcatatatcataaagaaggaatannnnnnnnnnnnnnnnnnnnnnnnnnnnnaccccacggttatgagccttgtcagctaccaaactgttctatcctgttaaactaaagagaggggaactagtggataaaaggggggttgaatacgcccctctaccatatctatacaaatagaatagtccatttatacagaatggtaaagagggctcttctacgatcatcaattccagaaatccatacaaatacgaaagggtattttatccttaccaactggatcttgttgcacccggtaacaaacatgcataaaccatttctcgaagtatgtgtccggatagcccaaagtctcgatagttagctctaggtcttccggtcaaaaaacaacgtcgatgaaggcgtgtcggtgcactattacgtggcagggattgcaatttttctcgcattttcgttttttcactcaaactcaaagggtaaactttgcttcttatctttttttttgaagatcgacgaatcaaatgatatttctgttctaatttctgccgcttcctctctctctgaatcaaacttttttttgccataatgtgccgttcctactatctaccaagtatacggttctaatcctagatggaaaaataaatagaaaaagaaatctaagaaggcggatcctccccctccatcaagagtaatgaactaggtgctgatacagtacaacaaaattaactaaattaaccaaacttgcctgatgttgaggcaatcaagaaagcggcataagtgaatatataacccacggaaaagtgagctaatcccaccaatcttgcttgcacaatggaaagagccacgggcttatctctccagcgaattaaattagccaaaggtgtccgttcatgagcccatgctaaagtctcaattaattcctgccaatatccacgccaggaaattaagaacataaatccagtcgcccaaacaagatgtccaaataagaacatccacgcccataccgataaactattcatcccaaaaggattatatccattgataagttgtgaagagtttaaccataggtaatctcttaaccatcccatcaaataagtggaggattcattaaatccctcttccctttttctttgtatcaactaaaccgttgggttgtcttcaattagatgggggaatccaattaacagcctcgactcgtatcctagctcgtctgagagctaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaaccgctccacagaaccgccgttaaccattgatcgttgaggaggcgtattctcaagggacccatatctacagctgtgttaatgggggcgtggtttggtaatacgccaatttggccactattagtagataaaatgatttctttcacttcacaatcccaaataattcgcttaggagtcagtacataaagatttaatttcatttcttcaatttgttctcctcttctaagtttatagctttcgtgctagcttcatcgatgttacccaccaaataaaaagcctgttcgggtaggccgtctaattctccggaaaggattagttgaaatcccctaatagtttctgcaagaccaacatactttcccggagaacccgtaaaaacttctgcacaaaaaacgggtgtgataaaaagcgctcaatttttcgtgctcttgctacagttaaacgatcctcctccgataattcatccaacccaagaattgcgataatgtcctgaagttctttgtaacgttgtaaagtttgcttaactctttgcgcagtttcataatgttcgttgccaacgatccgaggttgtaacatagttgaggttgaatctaaaggatctactgcaggataaatccctttggaagctaatcctctggaaagtacggtagtagcatccaaatgtgcaaatgttgtagcaggagcagggtcggtcaaatcgtccgcaggtacataaaccgcttggatcgaagttatagatccctttttagtagaagtaattctttcttgcaaagaacccatttctgtactaagagtaggttgataacccactgcagagggcattctccctaataaggcagatacctccgatcctgcttgaacaaaacgaaagatattatcgatgaatagaagcacgtcttgcttattaacatctcggaaatattctgccatagttagggcagtcaaaccaactctcatacgagctcctggcggttcattcatttggccatagactagagctacctttgattcctcaagatttttttcattaattactccagattccttcatttccatataaagatcatttccttcacgagtccgttcccctactccgccaaatacggatacgcccccgtgagctttagcaatattgttgattaattccatgatgagtactgttttacctactccagctcccccaaatagtccgatttttcctccacgccgataaggagctaaaagatcgaccaccttaataccagtttcaaagatggataatttcgtatctaactcgataaaggcgggcgcggatctatgaatagggaatgttgcactagtatctacaggacccaaattgtcaacaggctccccaagaacgttgaaaattcgtccaagagtagctccaccgacaggaacactgagaggagctcccgtgtcaatcacttccattcctctcatcaacccatctgtagcactcatagctacagctctaactcgattatttcctaataattgttgtacctcacaagttacattaatttgcttaccgtcagtgtctcgactcttgactaccaaagcattataaatataaggtaacttgcccgggggaaaagtgacatccagcacgggtccaataatttgatcgatacgccctgtacttttttcttcaattgtagaaaccccgggacgagaagtagtaggattggttctcataattatcacataattttcaaaaaaaaggaatttatcgaaattttgatttttttcttgttgaataatgccaaatcaacaccaaaaaaatatccaaaaatccaaaagtcaaaaggaaatgaattagttaattcaataagagagaaaaggggaccagcacttgatttcgttgcccaaacgaatcccattcaatcgtttactcatggaatgagcccgtcggaaagttcaatcaatctttttttcatatacattttgccttttgtaaacgatttgtgcctactctactttcttatctaggacttcgatatacaaaatatatactactgtgaagcatagattgctgtcaacagagaattttcgtagtatttaggtatttccactcaaaataagaaaagggggtctattaagaacttaataaggattagaagttgatttggggttgcgctatatctattaaagagtatacaataaagatggatttggtgaatcaaatccatggtttaataacgaagcatgttaacttaccataacaacaactcaattcttatcgaattcctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaagagggttctgttactaacatgtttacttccattgtgggtaacgtatttggtttcaaagccctacgcgctctacgtctggaggatctgcgaattccccctacttattcaaaaactttccaaggtccgcctcatggtatccaagttgaaagggataagttgaacaaatacggtcgtcctttattgggatgtactattaaaccaaaattgggattatctgcaaaaaattatggtagagcatgttatgagtgtctacgcggtggacttgattttaccaaagatgatgaaaacgtaaactcacaaccatttatgcgttggagggaccgttttgtcttttgtgccgaagctatttataaatcacaggccgaaaccggtgaaattaaggggcattacttgaatgcgactgcaggtacatgcgaagaaatgattaaaagagctgtatttgcgagggaattaggggttcctattgtaatgcatgactacttaaccggggggttcaccgcaaatactagtttggctcattattgccgcgacaacggcctacttcttcacattcaccgagcaatgcatgcagttattgatagacagaaaaatcatggtatgcatttccgtgtattagctaaagcattgcgtatgtctgggggagatcatatccacgctggtacagtagtaggtaagttagaaggggaacgcgaaatgactttaggttttgttgatttattgcgcgatgattttattgaaaaagatcgtgctcgcggtatctttttcactcaggactgggtatccatgccaggtgttataccggtggcttcagggggtattcatgtttggcatatgccagctctgaccgaaatctttggagatgattctgtattgcaatttggtggaggaactttaggacatccttggggtaatgcacctggtgcagcagctaatcgggtggctttagaagcctgtgtacaagctcgtaacgaagggcgcgatcttgctcgtgaaggtaatgaaattatccgatcagcttgcaaatggagtcctgaactagccgcagcttgtgaaatatggaaagcgatcaaattcgagttcgagccggtagataaactagatagctagactaagtggataaaattagatagaaaaaaggtctaaataaaaaagaagagaaatagaaagatcaaaaatcagttacgaaaatgcagtaattcttcttttttcttctaattgattgcaattaaactcggctcaatctgaaaaaagattgagccgagtttaaatagattttgatacgatcatgagacttgacaaatcgggattcctctattctatatatttagaagatataaaggtataatacaataaataaatacaaatagagtattatcatatgataatggaatcaaatacgcagtatttacagaaaaagttttcatttattgggaaagaatcaatgacatacaatgcattacagacgtatgatcattaccctttaaccgggttattctattccacttctagatagagaaaaaaactaaaggagaatgaatgaaaaaagacagagtttggaagttagacccctttctaagactctctttcaaaaaagaggacattttgaaacttttaacaggcacaatcgtgagtcaacaagtgactcgaaatgctcgtaagaaaagagaattgattttcaaaatggtagaactagatgacgaagttttctataaccttgatgaagaggtagttttagtttacgactccgatcaagagcgagaagtctttcatttcagattggactgctatagaatctggacccatcgtagagacgttcaaaaggctcctgatgataagaatcatactttcgcggaactccatggggctatgggcttcaacgcggtagacgttttgttccgaatttttctggagcaaacctccgacccaacgatacaatgaattttttctattcacaaagaaaaaagattcggaatcgcaatgctactatacgcacccggaggaatattcggaattatattcttatataatccatttttgcgcggggtcttactaacaggacttcgctgcacgagacgaggattcgtcgaaaagctaaggtcatccggtattttcataccctttgggggtggtatatggccttacaaagtctaaggggtagtatgagatctgtagtaggtaaaagaatttgtcccttgattgagtatgctattttccctcctttaccgcgcattattgtatatgcttctagaagagcacgtatgcagagaggaaattacagtttaataaaaaagcctaaaaaagtttcaactttacggcaatatcaatcaactaaaagtcctatgtatcaatccttacagcggatttgtggggtccgagagtggttgaataagtattgcatgtggaaggaagtagacgaaaaagattttggattcgaaataggcgcattcgactaagtcgtactttgaatccaatttcaagttcgattagaaggatagaaaggccgcgaggatcggaaaagaaaaatcaaatctttttaattgcttctccttttttgctattttcttattatttatataatccattcgattctttttttttagaatactttttttttagaatactaaagtattctaaaaaaaaagtattctataaaaaatctttttttgcaaactcaaaaatacaatagtcaatattcgttataatagatatacttaattatatcataagaatcttaagatattttttgaatagatcaaatcgaatagatagaaatagtaaatttgaatggagacacctattctatgatggattttaacttaccctctattttcgtgcctttagtaggcttagtatttccggcaattgcaatggcttctttatttctttatgtgcagaaaaataagattgtctagaaccgacgggaccgaattttctcaatgtatttccacacaggatcataatacggatcttttgtagtgtaagtaatataatatggtatgttatgtggctctttctacacacaaatgcaaacccgctatggatggggattatggatgcggatataggctacgagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaagaggtaattttttctgggcctgtattctttttctaggttcactaggattcttagcggttggggcttccagttatcttggtaagaatattatatctgtacttccatctcaacaaattcttttttttccacagggggtcgtgatgtctttctacggaatcgcaggcctattcattagcgcttacttgtggtgcactattttgtggaatgtaggcagtggttatgaccgattcgatagaaaagagggagtagtgtgcatttttcgttggggattccctggaataaaacgtcgcgtcttccttcgattccttatgcgggatatccaatcaattagaattcaggttaaagaaggtctttttcctcgtcgtatcctttatatggaaatccggggccagggggccattcccttgactcgtactgatgagaagttttttactccacgagaaattgaacaaaaagctgccgaattggcttatttcttgcgcataccaatggaagtattttgagtaccaattgaattttttgaaatgaattgaatgaagaagaattggaagaagaaaagttttctcaacacgagggaaaaggtcccttcgaaattgcattattgtaaggggattttgagtatttatctaaaggaaggaacaaatgaggataagagaaaattgcttctaatttgtccaagtgggatatatggcgtaatattcttccattttcatccgaaaggacttttttctatttctctattccactccatctagatctaagaaagaactcaatgcaatgaaattctactagtatagaaaaaagaggaatagatacaaggtctcaaaccttgttatagaatttttccttcaaagaaaaagaaatatcatatagagtcagcgaataaagcggattcattaacaactcaatttacagatcaaaaatgaaaaaaaagaaagcattgccttctttcctatatcttgtatttatcgtacttttgccttggggagtctctttctcttttaacaaatgtctggaactttggattaagaattggtggaataccaggcaatcccaaactctcttaactgctattcaagagaaaagagttctagaaagattcatggaattagaagacctttttatcttggacgaaatgataaaagagaaaccgaatacacatgtacaaaacccccctataggaatacgcaaggaaataatacaattggccaaaatagataatgagggtcatctccatatcattttgcatttctcgacaaatataatctgtttggctattctaagtggttctttttttctgggtaaagaggaacttgttattttgaattcttgggttcaggaattcttctataacttaaatgactcagtaaaagctttttttattcttttagttactgatttttttgttggatttcactccacccgcggttgggaactactaattcgttgggtctataacgatcttggatgggttcctaacgagctaattttcactatttttgtttgtagttttcctgtgattctagatacatgtttgaaattttgggtctttttttgtttaaaccgcctatctccttcgcttgtagtcatttatcattcaattagtgaagcataaactcatttgatctcctgatattaatcaaaattagcatcctttttcctttagaaagaaagcctttttccattttagcaaaattctttttttctatttctacctgctcaaggtattcatcattccagtacaactgttgcagtagaatgacaacagattcgtgtatagggaactagattagcttagctacctatctaatttattgtagaaattccgggatctgtgattggacatggaaaatagaaatactttttcttgggtaaaggaacagatgactcgatcgatttctgtatcgatcatgatatacgtaataactcggacatctatttcaaatgcatatcccatttttgcgcagcaaggttatgaaaacccacgagaagcaactggacgaattgtatgtgccaattgccatttagcgaataagcctgtggatattgaagttccccaagcagtgcttcccgatactgtatttgaagcagttcttcgaattccttatgatatgcaactgaaacaagttcttgctaatgggaaaaagggagggttgaatgtgggtgctgttcttattttgcccgagggattcgaattagcgccgcccgaccgtatttctcctgagttgaaagaaaagataggaaatctctcttttcagagttatcgtcccaataaaaaaaatattcttgtgataggccctgttcccggtaagaaatatagtgaaatcgtctttcccattctttcccccgaccctgctatgaagaaagacgttcatttcttaaaatatcccatatatgtggggggaaaccgaggaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgattgctagaattctctatgatccattttggaaatcttttttttgtttagactattttttgtttgcgagatgtcttgtctgcaattccttatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtatcgaaatatgaatcttttttcttcctattcggcaaagattactatttcttctttatttgggtctgtctcttgaacctcttttgcttaggttcaggcgatgtagtggacaaaaagagggaaagaaaatatggcgtgggacaaattttttgtgaccaaatagaattgcttgacttgttcaattaagttcaatttagaacttacagaaattttgcaaaaaaaacggatactcttccattgaaggctgttttttatttttaggctagttgagtagttttaattaaggttttattagtttattactctaaattaaatcaatgatttacaagagacttcctccggggaataaaatattggatcctcgattgatcctttctttctcctcgcttcataaaagtgaattaatttcattggcgagggggttataaatcaactgatggattacttcactaacattattaacaaacaaaattaacaaacaaaacgaataaatagagggattctgaccatcagagcaaaggctttctctttgttatttttacaaatcaaaataggaaacccgtttgtaggttatggaatagattaaaaaagtcgggttataagagtaagaattccgcgggtcctttccgctctaatcagataaaagggggtaaggacccgctaagttcctattttttcatgtttacaacctggtccctccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggctttctgtgaaatactcgtttggccgaggacttccaaacacgtcataagctaaacccgtactgacaaataaccaacccgcaatgaatagggaaggtatagtaatgctatgaataacccagtatcgaatactggtaataatatcagcaaaagaacgttctcccgtgcttccagacatgctgagctccccaaatttttgtacattcaaaaaaggaattgattccgtaaaagatgggatcaaccagtaaatagaaaattactgatatttcatccttgtgagattgtcaattttgtaccaaaggtgtattttgagtataccaaattagtatagctatccttcctatggcacagcaatcctgtttcgcttggtctcgaaacagaattctttttttctcttctttgttccttgtctatagggtaagctatatggtattcaaggcatcaatagaaaacctcaattttgagggtcctacttaattttcaccggcttcggaatagtagaataattcggaatagggctcaagatcttgggaaaatctaagttaatgatcaacaggtttggataaagaatttaggaaagatattcttatactgacacaatacaaagagaagtagatgcgaaagctatcccttcgaatccaacctttccccttaaagaatttaattggttagcataatataatatctaataaatagaaaatcaaatagtagataatctgttatgaaagagagaaaacattctttgaagaatcaagattcgtaatcaacccttgccttgtttactaactttcttgaccaaactgcaagcgtggaactttgccagttcttaggtttccgaaatagtgtaatggaaaaagaagtgcttcgaatcgactttgattggggttcgaaaaaggaattaaaaaaaagtaaattcaggaaagatttcctttttttaggagaccctcgaggggtcgtggaatgcttttcttctcctcttattccatatggaatacaatcaattaaaataagaaggaataggggaatattcgactgttcgctccaaaaagaaggttaaatcatcctattgaaaaagaccaaaatagaaagaactttttcaaattcaattctttatttttcactggggttagctgatctagttcttaatatttttactttactcaattgacagattacacagcaaatctcttgattcggaattagggactcatgccccatctgatgaatccattttcttttacacttctgtatctcactctatcttgttttttagtattatctaaaataaccgatgaattatgaattttccataacttaggtaagtgctttaccaacatatgtagtgtagtaaaaaaaatggaatttaaccctttcatgcttactataactagttatttcggttttctattggctgctttaactctaaccctagctctatttattggcttgaacaagatacgtcttatttgaaatgaattgaatgaataaggcagaaaagaaaaaatctctcttttggattcctggtattctacgcactaattaccaattctttttttcttggtcattgagattcgtggataatttagactactatttagggataaatcgtacctcttttttttatcccctcgaacaaatcgaaatgattgaagtttttctatttggaatcgtcttaggcctaattcctattactttagcgggattattcgtgactgcgtatttgcaatacagacgtggggatcagttggatctttgattgagtaatatttcttttttgattgccctcctctctggtctggaggaggtcaaattggaattgcaatttgttttgttaagttattttgccctgcttcgacataagatagatggaatcacgctctgtaggatttgaacctacgacatcgggttttggagacccgcgttctaccgaactgaactaagagcgctttcaaaaatcaaatccttttctactcctaatgtgtctcacgtacgtatagtatccacaaattcaagttatacccgctttaatcgacctcctcactactgcctataaagaagaaagaagtaataggtagggatgacaggatttgaacctgtgacattttgtacccaaaacaaacgcgctaccaagctgcgctacatcccttttccaaattgttgtacaatgtcattgtacacaattcctatcttgttttccacatcctaattttcttgtctttttctatctatagagaatcctcgtgtcatttcttctttttggtctcatataatcaaggaatggtatatatctaaatccaatctaatttcacctataaaagaaagattactattccttggtaatctataggaagggattgtctttttcgtttttagttcggaatttcgcctaaacaaaagaaatacaaatgatcttgggcaataatatctgatcatatacgtattccaataaggaaggaggattttcaatgcgggatataaaaacatatctctctgtagcacccgtgctaagtactctatggtttggggctttagcaggtttattgatagaaattaatcgtttatttccagatgctttgtcattcccctttttttcattctagttgttgctatgtgaggaatagagttcttcgtgacatgataaaaaattcccacttttcaatccctttttagtataggaaagaaaaagaaagaaaagatagattgggttggaccttagagtcatgaaaaatttggtaaatctcatttttgaaaaaagaaattcaattaaaagcagtatccaagctaagtcaggcctcagaaatcagagcatagaaagaggctgggttggctactaaaatgaaaggattttgcttcaaaatccttgctaatttgacaaggattgtattccttaattatttctctattttttattacttaattgaaaaatttccaaaaatttttattctaatggattttcttcttcctcttcggtttcaaaatagaggaataaaagaataagtagaagaattaagttaagtcaatccaaaaaggaaggaggttcatggccaaggggaaagatgttagaatcagagttattttgcaatgtgtgagttgtgttcgaaaaggggccaatgaggagtcggcagggatttctagatatagtactcaaaagaatcgccacaatacacccggacaattagaattaagaaaattttgtcgttattgtcgtaagcatacgattcatgccgaaataaagaaataggagcatcttgtgttcgatctttccaaagatcaaaaagaataagaacttcctatttaatatatagagcatagatagaatacaaaatacaaatcaacttgtctgatttccattagatattatttcatatgtatcgagggtattcatctaatatatggaccaaagagagactatttcttctggatccaaaattaataaaataaacaaatcaatttttttttcaattttaaaataaggaataaatcatgtatacatctaaacaaccctttcataaatccaaacaaacttttcataaatccaagcaaacttttcgtaaatccaagcaaacttttcgtaaattcaaacaaccttttcgcaaacccaaacaaccttttcgtaggcgtcctcggattggcccgggggatcgaattgattatagaaacatgagtttaattaatcgatttattagtgaacaaggaaaaatattatcgagacgaataaatagattaaccttgaaacaacaacgattaattactcttgctataaaacaggctcgtattttatctttcttaccatttcgtaactatgagaatgagaaacaatttcaagcccagtcaatttcaataattacaggtcctagacccagaaaaaatagacatattcctccattaacacaaaagttcaattccaatcgaaacttaagaaactccaaccagactttaagaaacaacaatcggaacttaagttccgattgttgatgttttattcgaaagggccagactatatataaagaaagtaatccaatttagattcttgggtttgttataagaaagaacaatggggaagaaaaaatagtttttttatttattgcaacatgctcgttgattcctaccacttaatcttaatttattgtatcttcccggagttacctctccgggaattcttttttaattattcctgtatattacttttttatccctttaattgataatctttattttattggaaatcgtgtaaagattatttgaatttaatacagctacttgtgcaaggattttacgattaagaatcaattctttcttgtaaagattgtgtattaatttactataattatcgaatactttatgtatccgcgttgctgcgtttatccgactgatccacaaacgccgaaaatccctcttttgcctgactctatctcgatgagaggaaacaaacgctcttcttacctgttgagtaatcattcgattaagtcttaaatgagcccctctaaagtttgaggcaaatgaacgcatttttgcccgtcgtctccgagctatatatcctcgcggaactctggtcattgaatcaaattaaccttaatgaataactaatgatttctcttcttttagccatcctttttcccattaataacaaaacgaattattcccatatataaaatattagttccaatggcttttgctactataaccttcccaaccacaattttctcttctactcccttcagttatttcgcacgatactaaaaaatagtgggttccatcgtttctatggttcccttttaaacggcgaggccctctctatacaccggagccctttctttcatttcatcaaagggtattgtgaacttgtatagttcacattctttggctctacctatccattatagagtaaatagctcttttcacaataagagttatccatacagtgacggcatttaattatgaaagttggctaagtagctgaccctcttagtccgtttttttaagataaaggagcataagcctttatctttttattactatttcctccgcttaatgaatagccgtttgctaccaatgggggaattgcttcttatttccaatctagatgattggatttgcaccaaaggaaaccagaaattccatataccgtagaaatctaggatagagaagctctatcctattcattggtaccgatcatggatacttcaaaaattgtcttatttgtttgaacccatgatccgaacgagtcgcacatacaccctagcacatgttcctcgacgctgaggacatcccttaagcgcggccgattttctagcatttcgtattggctgtcttgcgtttctaataagttgtttaaccgttggcatgtcgtatgtatatagaaaaaatggattggtttagatcgatcttaacctgaatgattgatcattatgaagtatttccattaaattgcataaaacccgaatttagggttgaaataaatttacaagaaatctggccactaccaatccttaaacatttctggaaaccacactggatcagtatcgcagtgctcgtcaagcatttcatcccctacaatatcgacaagtccataagctttggcttcgtctgctgacataaaaacatccctttccatgtcttcggatacaacccaaaaaggcttgcctgttcttagtgcataaacccttgtgatcatttcgcgaactttgtgtaactcttccacttctagtaaaaattctggtgttcttgcccgataataagcactagcaggttggtgaagcataatcctcgcgtgggggaatgctatacgcttggtgggttctcctccaagcagaatgaaggacgccatggacgcggctattccgaggcatattgtatatatatctggtgtcaccgtttgcatcgtatcaaaaatcgccattcctgagattaaccacccgccgggggagtttataaacaaaaaaatatcgctaattccatcttctatactgagatataccatgagacctgtaatatgattcgtgacctcgcaacgaatctcttgacctaaaaaaagtgtcctttctcgatacataacattgtataagtcaacccaagtcgcttcttcatctccgggaatccggtaaggtacttttggaacaccaatgggcatattagattaatattattaaatttaagtaagaaaactacactttaatatggaaacgtaagaatggaagagaaagaaagaatccgcagtttattgttttcactttttttcttattctatatgaatactatagattctattaatacgtagattgaaataatacatagattgaaagattatacatataagtaggataagacagattgaataaagaaaaaagaatgggtgattcgaatactaaacaaaaagagatagggatctattcttcgttttttccaaataagccaagctgcccattgcatattggcacttatcgagtatagaatagatctgcttctctttcttcttacgaacagaattggcttcttatttttaatggaatgaaataaatattcacgctttctgacacagaatcccctagaagggttaggtacataggatatggatagtctttgccaatgcgataaaataaagtgacatcgtgtctatttttctttgctaaaggggtatttccatgggtttgccttggtatcgtgttcatactgtcgtattgaatgatccgggtcgattgctttcggtgcatataatgcacacagctctagtttctggttgggctggctcgatggctttatacgaattagcggtttttgatccctctgatcctgttctggatccaatgtggagacaaggtatgttcgtcattcctttcatgactcgtttaggaataaccaattcgtggggtggttggagtatttcaggaggaactgtaacgaatccgggtatttggagttatgaaggcgtggcaggggcgcatattgtgttttctggcttgtgtttcttggcagctatctggcattgggtatattgggacctcgaaatattctgtgatgagcggacgggaaaaccttctttggatttgcccaagatctttggaattcatttatttcttgcaggggtggcttgctttggctttggcgcatttcatgtaacgggtttgtatggtcctgggatatgggtgtctgatccttatggactaactggaaaagtacaagctgtaaatccggcgtggggtgcagaaggttttgatccttttgttccggggggaatagcttctcatcatattgctgcgggtacattgggcatattagcgggcctattccatcttagtgtccgtccacctcaacgtctatacaaaggattacgtatgggcaatattgaaactgtactttccagtagtatcgctgctgttttttttgcagctttcgtagttgccggaactatgtggtatgggtcagcaactaccccaattgaattgtttgggcctactcgttatcagtgggatcagggatactttcagcaagaaatatatcgaagagttagtgatgggttagccgaaaatctcagtttatcagaagcttggtctaaaattcccgaaaaattagccttttatgattatattggtaataatccggcaaaggggggattattcagagcaggctcaatggacaatggggatggaatagctgttggatggttaggacatcctatctttagagataaagaagggcgcgaactttttgtacgccgtatgcctactttttttgaaacatttccggttgttttggtagatgaagagggaattgtgagagcggacgttccttttagaagagcagaatccaaatatagtgttgaacaagtaggcgtaacggtggagttctatggtggcgaacttaatggagtaagttattctgatcctgctactgtaaaaaaatatgcgaggcgttcccaattaggggaaatttttgaattagatcgggctactttgaaatcagatggtgtttttcgcagcagtccaaggggttggttcacttttggtcatgctacctttgctttgctcttctttttcggacacatttggcatggggctagaaccttgttccgagatgtttttgctggtattgatccagacttggatgctcaagtggaatttggaacattccaaaaagtcggagatccaactacgaggagacagccagtctgaggccgcattgctttggtatctttcacctctcttttttgatttgacatgggaaacatctcccatcccttctttgactctttttccttttttatacgggaaatgatcccaaatgacaaatgaataggtgtggaagttataattgtaaataaaccacgatcgaatctatggaagcattggtttatacgttccttttagtttcgactttagggataatttttttcgctatcttcttccgagaaccacctaaggttccgactaaaaaagtgaaataatttaattgaagtaagaagtctccccatctgggagacttcttacttcaattagtccccgtgttcttcgaatggatctcttaattgttgagagggttgcccaaacgcggtatataaggcatacccagtaaagcttacaagtaaaccagatatggagatggcgactaaagttgctgtttccatttttatagaatttcaagattacaatggatctacgaaaagatcgtgtatttacaactacaacggaatagtatacaaagtcaacacaaatcattaaatggaatttatggctacacaaaccgttgaagatagttctagacctggaccaagacaaactcgcgtaggtaatttattgaaacccttgaattcggaatatgggaaagtagctccgggttgggggactactccttttatgggggtcgcaatggctttattcgcggtattcctatctattattttagaaatttataattcttccgttttactggacggaattttaatgaattaggtttctactaacgaaaactacgaagtcatagtttttccatccaaaagagcctttctactttaagctctacatttctagacattctggtagttcgaccgtggaattttttggtttcggtatctctggaatatgagtgtgtgacttgttagaatttgctcctattgataatacatagaaagcacctgttatctctatcaagatgattctaattcgtcggatattatttattctagtatctggaacacgaaatagatagagtggatcaagaaaaaaaaatgaaactatgattcatattaactattcagacctcgcaaccagactgaaaaaaattcaagtagttcttaataaaaataaaaaaagaaaatttcttccttccaattttgtttgcccaaaaaacaactttttttctctcgattttgtcgagtcattacaccgattcaataaatgatcatcaagcggttcttattcgaagaacccttgccttttgtttagcttgagactcaatcatcgtggctctagtatgaatctaaggttttaattgaactgattcataggatcgcaacaagataatttctaccagaaaactactccaatttttgctttatttatttatctagtaaaacaagagtaaatctgcattacgcacaaaaaaaagaaatccaaaatagggaagagaaaaatcaagaggcctctaatgatcaacatttgggaaagaaagatagacgagccaacttgagattttttggcattatcatcacaaagaagaaattctggatttttcttatttcatatcttcaaggcaaatcgacccaacccagtggctgatgaagttttgaaccttttttctaatatccgttgaaaatttgtgtgtttctgtttgagccgtacgagatgaaattctcatatacggttctcggaggggggttcgggttagttacctatctcaataaagtatatgattggtttgaggaacgtcttgagattcaggcaattgcagatgatataactagtaaatatgttcctcctcatgtcaacatattttattgtttagggggaattacacttacttgttttctagtacaagttgctaccggttttgctatgactttttactatcgcccaaccgttacagaggctttttcctcggttcaatacataatgaccgaggccaactttggttggttaatccgatcagttcatcgatggtcagcaagtatgatggttctaatgatgatcctgcacgtatttcgtgtgtatctcacaggtgggtttaaaaaaccccgcgaattaacttgggtcactggtgtggttttagctgtattaactgcatcgtttggtgtaactggttattctttaccttgggatcaaattggttattgggcagtcaaaattgtgacaggtgtgcctgacgcgattccggtaataggatcacctttagtggagttattacgtggaagtgctagtgtgggtcaatccactttgactcgtttttatagtttacatacctttgtacttcctctgcttactgccgtatttatgttaatgcactttctaatgatacgtaagcaaggtatttcgggccctttataaggaaggcatctcatagagagttctaattctcatatatcatatcgggtaggttgtggtatttcattgctacaaacatgggttattctaaaataagacatgtcatttagatacttctcttcaactccgaactattgtgatacaaataatacaaatagttgaagttaattttacgaaagaaaagaaggcggattatgggagtgtgcgacttgaattattgatttggccatgcagatagagagttggatctgccacattagaattcacgaccaaaggtgtctccatatccaatcaacacgtaagtcccctgtctagtaaggataggctggttcacttgaggagaatattttctatgatcatacctcaaccatgtcatccatgaagaggctccgtaagatcccatagagtagaaatggaataagtcatgtgacatgatccaattctctatttattacacttactttttattatagtatggaaatgcattcattttctttgcatcgattgcgatctgcaatactatcggagtaaaagaagggatctaaggaagaacgtaggctaaactttttgattttttattagtaacaagtaaatactttgtttggacgtaagaaacttgcaatattgggggggataaataccaactaatcaagagacgcgagacaatccacaaagcaattgatcatgatcaaatttgtaagcccacttggatattgagcatttacccataagagtaggattcttttcaatgaatagttgtaggtgcaacttcggaaaatagaatctgataaagcttttcttacttagagccattgagccattatataccttattctattatggatcttctacggttttatttctttcattcttgctcgagccggatgatgaaaaattctcatgtccggttcctttgggggctggatcttaaagaattcacctatcccaataacaaagaaacctgacttaaacgatcctgtattaagagcaaaattagctaaagggatgggacataattattacggggaacccgcgtggcccaacgatcttttatatatttttccagtagtaattctaggtactattgcatgtaatgtaggtttagcggttctcgagccgtcaatgattggtgaaccggcggatccgtttgcaactcctctggaaatattacccgagtggtacttctttcccgtgtttcaaatactccgtacagtacctaataagttattgggcgttctcttaatggtttctgtgccgacgggcttattgacagtaccttttctagagaatgtcaataaattccaaaatccatttcgtcgcccagtagctacaaccgtttttttaatcggtactgcagtagctctttggttaggtattggagcaacattacccattgaaaaatccttaactttaggtcttttttagggatttttcagtttgattcattcaatcgtgaagtaccgtgcataggtatctaggaaatagttacttccaagtgaatcttccctagatacctataatctattttattatgatccatttcgcgaaaatatagattgtcccaaagatgcaaaattgttttattttttctttttattctaactcgaaaaagaagaagaggaaaaaattgcaatggatttaaaactagaacttattcttaggtaaatccattgggagatgcttctctagagtgtcccatatctgttttccatcttgcatacgaaaactgtcaattctcatcagatcttcttccgtcttactcaaaaggtccaatagtgtatggatattggcccttttgagacaattatacgttctagaaggcagttctaattgatcaataaaaatacaattcaatggaattctttttttgtttttctttagattagttaatcttttttgaaagcttaaaaggggggaagtaaacctgtttttattttcttggaaacgagtaccctcttcctccgtgtgaagaaaaggaagaaataaatcaatcaaattacgagaagcctcataaagcgcttccttaggggttaaacttccattggtccatatttctagaaaaagtatctcatattttgcatttccattcccacaagcaaaaatactataattcacatttcgaacaggcatggatacagcatctataggataacttccatcttgagtgttctttctgacttccgtgtgatatccgcgatctctcttgatccgtaactcaatacggaaatccgtgggttctgtcaagttagctataggttgtgccgtatcaacgatttctacggaaggcggtaagataatatcttgggcagttatgtatctaggacctttgacgcaaattgatgcggttctaactccatagagattacttctcaatacaatttctttcaaatttagtaaaatttcttgtaccgattcttcaatacctgctattgtagaatattcgtgcggcacgctcccaaattttgcatgtgtgatacatgttccttctgtttctccaagtaaagctcttcgcaaggcaataccaacggtatccgcttgaccttttctaagcggggacagaatgaaacgaccataataaagacgcttactatctactcttgattcaacacacttccactgtagtgtttgagtggatcctgctacctcctctcgaaccatatagactagtattattatttgatcattgaatcgtttatttctcttgaaaggggtttaattcttttacagacgtctttttttaggaggtcgacacccattatgcggcataggtgttacatcgcgtatacaacttaatcgtacaccacttttagcaatggctcgtaatgcggcatctcttccactaccagcaccctttaccataacttctgctcgttgcaaacccactgtacgaatagcatctacagctgttctttgaccagcatagggtgatgcttttcttgagcttttgaatccacaagtacccgcggaggaccagaaaaccacccgaccttgcggatctgtaacagttataatagtattgttgaaactagcttgaacatgaataactccttttgttattctacgtgcactcttccgtaaactaaaacgcgcattcctacgcaaaccaatacgtactttcctacgtgaaccaatttttggtatagcttttgtcatattttattatctcataaatatgagttagaaataacaaaaagaaaaaaagatacaaagatatccgtttcagggtaaaatatatcctttacttgaatttttttatttggaatttggacattttcgcgggtacttttttttttactttttagaaagtcaagttcttttttcgaaagattacccctgtctttgtttatgcttcggattggaacaaatgactctaattcgtccacgcctacgaatcagtcgacattttgtacaaattttacgaacagaagctcttattttcatatttccgtattcctttcttaaactatgaatttactcttttggaaaaaataagtctctttgtttgaattttagaactttgaattttttaccctagaaaaaaaaaagaaaaacctaaccctttgaatctttggtatccttcaaatcttcggtatccttcgagtcttcggtacgcttcgaatccttatggggaagtctataaattatacgccccttgcttgaatcataacgacttacttcaattttgaccctatcccccatcagtattcgtatagaactagaccggatctttcctgaaatatagcccaggatgatggtgtcattctctaggcgaacgcggaacattccgttgggtagggcttccataactaaaccctcgaaagtaatttttgcttctctcgggttttttttttctctcctatttttcttttctgtcatatttttttttctcctatttttctttttttattttcaaataaaaaaacgttgtatttttgtttgaaaaataggaagttcaagatagaatttgggtactataactataggtggggcgattaccgctataggcggggcgattaccatatataacataagacttctcccccaattctgtttagtcgagcttctcgatctgtcattatacctcgagaagtagaaagaatagcaattcccattccgcccaaaaccttaggaattccttgatagttggcataaattcgtaagccaggtcggctgatacgctttaaaaaggttctagttctatatattccctttctagtctttctcttttgatgtcgcaaagttgaaaccaagaaatatctgttactttcctgatgtttccgaacactttcaataaaaccctctcgtagaagtattttaacaatgttttcggtaatatttgtagatactacccgaacagttccttttttattcatgtccgcgtttcttatagaggttagtaaatcagcaatagtgtccttgcccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactattttagtaaaattcaattctctcaattcctcggcgatcgcgccaaaaacgcgagttccttttggatttcctttttgatcaatgataaccgctgcattgtcgtcatagcgtattattataccgtcttcgcatttgaactctttacatgtacgtacaattacagctcgaattacttcggatctttctagaggcatttggggcactgcgtctttgattacagcaacaataacatcaccaatacgagcatatcgctgattactagcagctcctatgactcgaatacacatcaattttcgagctccactgttatctgctacatttaaaagggtctgaggttgaatcatattattttgatttcaatttgttatttcaatgcaaaaggatgaaagaaatattgtctttccagaaagaagaacctggttttttattttcaatactactttttttggggggttatatttctaaccgaagaaattgacttcgtatgggcattttgctggcagctatggaaatagctgctctagctacagtttcggatactccgcccatttcataaagtattcgacctggtttaacaacggctacccaatattcgggggatccctttcccgaacccatacgtgtttcggtcggtcttattgtaaccggtttgtcgggaaatatacgtacccagatttttccaccacgacgtgcatatcgtgtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattctttttttttttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggacgctctttgttattccttgaaatttgtatttcttgtttcaatcaaattacgatttcgaattctctgttatttttattatattgatgctttatcacattgctttttatgatgtaattcatagaccatacatattggaatcctatatctttcttatttctcttccttctttctatcatccttccttttatctacatcccctttagttttgcttcacaacttagaatcctatttttttttaaagaaaaaattgcagttgctacacgtatatgatagatttactcatttatgatagatgtatttattcatatagtgactgtttcttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcactcggcacgcgcaatttcttttcccgcgagacggcctgcaatttttacttttactccctttatatctgtttttttagttaattcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttctctaattcttcgattgctccttttttctttaataaattggggaatccaatatggattatgacgtggattgtatcgatttctttttgaatttctatatgtgtaattacttcggaacttgagcctgagtccatttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattctattttttttaccgggaatcaaatcttagatggatctaaagattatttcgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagatgggataagatgctcgataaggcatgaggttcaatatcataacagtttcttcgtagtaacgccaacgaatctcatccagaactctttgtactttgaaaacggacatgtggatgcgtttttgtgctttgaaaacccgttcgaacttaagtagacgatcggttggtacttttcttgcgagtttccttagcccactcttcttcttctttatcctaggggtatactttaccagtttgaaacttgtcataaataaggttattccccgcttacctatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatacctagttgacattgataacaaggatctaatgaattatgagtttaatagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttgtcgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccaccccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcggattttgcagttcttttttctgcagtacctcgacgtgacatgagcgtgaaagaggttcaagaatccgttttctttttataagggctaaaaacgaatcacttatttttttggctttttgaccccatattgtagggtggatctcgaaagataggaaagatctccctccaagccgtacatacaactttcatcgaatacggctttccacagaattctatagggatctatgagatcgagtatggaattcagtttactcacttaaaattgagtatccgtttccctccttttcccgctaggatcggaaatcctgtattttccatatccataccatcaagtccttaggtttccgaaatagtgtaatggaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcacccttcctgtccctctacagaaccgtacatgagattttcacctcatacggctcctcgttcaattctttcgaagggatccttttcctcgttcgagagtctccgcccttcttccactccgtcccgaagactaactaagaccaattgagtcacgttttcatgttctaattgaacactttccatttatgattaaaggagaagattgttcttttaccaaacatatgcggatcaaatcacgtcttataataagaagaaatctttctcggtatcaatccccttgcccctcattctttgagaatcagaaggatccttttcgagtttccatttcttcatttggaatctgggctcttctatcttcgacttattttttttttgctttattctttatttatttcatttcgatttttccctcttcctctatccctatcctctaggtacagcgtttgcatcaatagagaaccttttcctctgtatgaatctatattattccattccaatttcttcccgaaacttcccaagaaaaatcccgaattggatccaaaattgacgggttaatgtgagcttatccatgcggttaggcactcttcaaataggaatccattttctaactggctttcgtgctttggtgagtcgtccgagatcctttcgatgacctatgttgtgttgaagggatatctatatgatccgatcgattgcataagacccgcggtagcaatagaacggggaaagtatacagaaaagacagttcttttcaatttcgattatctatatattagttcgtttctatttctagatatctatttctatatattagtattagttagtagtactattctattagttagcgatcccggctctgtgagttctttcttccgtgatgaactgtcggcaccagtcctccattttttctctgtggaccgaggagaaagggggctcagcaggaagaggattgtaccatgagagaagcacagaggtcaaccctcttcaaatatggaacatggattctggcaatgcaacgtagttgggtcctcatatcgatccgaatgaatcagtctttctacagaggtcaatctttgcctattaggcaagaggatagcaagttcgaaattctgtctcggtaggacatggatttctattactatgaaattcataaatgaaaatgaagtagttaatgggagggctaccattatcctttttcttgtatgtgttcctaagagaaggaatttgtccatttcatgtttcgaggtctcaaaaaagggcgtggaaacagatagaaactcttgaatggaaattgaaaagaaatgtagccccagttccttcggaaatggtaagatctttggcgcaagaagaaggggcgacccatatcatcttgacttggttctgcttcccctctttttttaagaataccgagtcgggttcttctcctaccagtatcgaatagaacatgctgaacaagatcttcttcatggaaacctgctcgatttagatcgggaaaatcgtacagattttatgaaaccatgtgctatggctcgaatccatagtcaatcctattttcgataggaccggttgacaattgaatccaatttttcccattatttgactatccataatagtgtggaaagaaagcccggaggaagggtggccttgagtttctcgcccctttgccttaggattcgttaattctctttctcgaggggacggggaagggatataactcagcggtagagtgtcaccttgacgtggtggaagtcatcagttcgagcctgattatccctaaacccaatgtgagttttttctattttgacttactccccccgccacgatcgaacgggaatggataagaggcttgtgggattgacgtgatagggtagggttggctatactgctggtggcgaactccaggctaataatctgaagcgcatggatacaagttatccttggaaggaaagacaattccgaatccgctttgtctacgaataaggaagctataagtaatgcaactatgaatctcatgg

SEQ ID NO: 44100 - DNA, 1927 bp, Oryza sativa
  unsure (1)..(1927): unsure at all n locations
nnnnnnnnnnnnnnnnnnnnnnnnnnnnnnnnnnnnnatggagtttttctcgcttttggcgtagcatgtctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattttcagggagagctaatgcttatgcttattgggtattttggtttgacactgcttcacgcccaaaaagaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaagcatctgactctttcatgcatactccacttggctcggggg

SEQ ID NO: 44101 - DNA, 1502 bp, Oryza sativa
  unsure (1)..(1502): unsure at all n locations
aacctaatttattgataagagtgcttattataaatcaattcttgcaatttttttcaaaaattgatttttgcatttttaggtgtcaaaataaacaaaacccatcctagtggatttgtgtggtaaggaaaaacgggtaatctattccttaaaaaaaaatcttggagattatgtaatgcttactctcaaactttttgtttatacagtagtgatattctttgtttccctctttatctttggattcttatctaatgatccaggacgtaatcctgggcgtgacgagtaaaaatccaaaattttttcttacaaattggatttgtttcatacatttatctacgagaaaatccgggggtcagaattccttccaattcgaaagtcccaaacgatccgagggggcggaaagagagggattcgaaccctcggtacaaaaaaattgtacaacggattagcaatccgccgctttagtccactcagccatctctccccgttccaaatcgaaaggtttccgtgatatgacagaggcaagaaataacgattgcaaaaaatccttcctttttctttcaaaagttcaaaaaaattatattgccaattccattttagttatattcttttttcttaatgttaataaaaaaaagaagaaaattcttcttttttctttctaattctaaaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgcaaggcaagaatttctcgctatttactatttcatattcttgttactagatgttctataggaataagaagaaatcgcaacccctttccgctacacataaaaatggatttcgaaagtcaatttttcttttcaatatctttactttttttcagaatcctatttttgttcttatacccatgcaatagagagcgagtgggaaaagggaggttactttttttcatttttcccttaaaaaataggctttcttggaaataggaatcatggaataatcctgaattccaatgtttatttctatagtataagaaaaactaattgaatcaaattcatggatttaccacgacctcggctgtgaccccatagataaaaatgcaaaatttctatcttcgagaccattgaaaaaaggcattgaacgagaaaaaatcgtccacagataatctatcgtatgccttggaagtgatataaggtgctcggaaannnnnnnnnnnnnnnnnnnnnnnnnnnnnnnnnnnnnnnnnnnnnnnnnnnnnnnnnnnnnnnnnnn

SEQ ID NO: 44102 - DNA, 7724 bp, Oryza sativa
  unsure (1)..(7724): unsure at all n locations
tgcaaaaatcaatttttgaaaaaaattgcaagaattgatttataataagcactcttatcaataaattaggttaggtattgtgcggttacctaaagatacctgctcaacgtagatgcagggagtagaaaggctgatccaaatttattgctgcagctatacattcaatgtagaagaatttgaattttagaatcgaaggttcataatataagacttctcggctcttatccatttttcgaatttttttagaatgaatacatgattcaatttggcagacagagtagtaaagatttcatcgaaaacttacagcagcttgccaaacaaaggctaatagaaaaaagagtacaggtatgacaggcataaaatccacgattggattgaaaatggcataagcttcgggcaatttggcgaagaaaaaactagtcggataaataacagaattaaaacaaatacaggttaaactaagtatattaggcataacaagcgtttcgttcttgtagagtagataattggattttgattgagttatttttctaagggaaaaaggaaaaggaggattcaaaatccttttttcttcggactttcccaaacacaaaatacctccttgtattcgcactctcaaatgagagtggaagaaattcgactttcatataatatcttaatagaattccatgtaatgatcaatgcattttttggattctatattattcgcatgtctagaatcctaccaagagaataccccccatttttatgtaattgaagtaggattgacgaatagaaataaacataatactgtttattagtgtcgcataaaacccgaaatggggcgtgnnnnnnnnnnnnnnnnnnnnnnnnnnnnnnnnnnnnnnnnnnnnnnnnnnnnntccgtcccagattttttctgatgaaacgaaagatgaaatcgtattgtattctgcacgagacataaagtttattaaagagaatttttttctcttataaactcttagattcgatgcagtcctaatgcgttcattttctgtctcagaaaacataatccagtgtcaagtccagtcaaattgaaaatctttttttcatgaaaaaattttaaacttgacgtagaacattgtataaaaaacgagacctattcctttatggtagagatagatttatgatagagataaattttttttatagtattttattagtaaaaaaggttccttcttctttttctttctttggttaagcaaaaacgatctcgatccgcgattttttaaatatccagaatgatccatcccggtaaagataagataagaactgctcgttagatagaatggattcaattttgatttggagttgcttcttttaggtaaaagaaaaaataagtaaaagcaaagaccttaattttactttacaggaaatgcgttttttttacttcatttttttctttcttttggtattcgagtcgaagaaatacgagaattctataactaccaaaaaactttcttttcattgcaatagtttaactagttaatagttaattagttttgttacggaaaaatggtatggaaaaatagattgctaatctaatatattaattaaattaattaaacgggaggttgatagtttatttgttggagaagagtcaattcttctcttatcatttcaggattggattgatcatctcgagtcctctgttgaggatggaaattccataataaataagtcttaagcaaacttgtttattcccttttttcgaactatatttcattcatatgatagaatatgggtttaaataaattggctctttgcggagtctttcccgataaatacttaatttcttttattcatatttctccatagatagcaaagcaagtttgaattagatacaaaaaacgaaactaatgactattcatgattccatccatattggatcaattccctataacactttgcaatgaaattagaggaatgttatgttaaaacttcgtttaaaacgatgtggtagaaagcaacgtgcgacttgaaggacacgatcgattgtggattttgctatccaccattttccatagtaatgaaaatgctcttggctcgacatagtctgttctattcgtcccgaaccgaattttcgctgggttgtttgtaagtaagctaagtaaatagtacacgatggagctcgagaggacagaatttattttttatcaagggaaagaatctagggttagtgaaaactaataaattaggccaactttgtcattctacccttaatatagaaatcgaaataatatagaaatcaaaaggttaaaataagaagaaagtccaattttggaagatatgggaaaactcttttgattaaaagtctatcagaatcaatcgctcatattcgatttctatagaagagggaaatgctttatcgaaggaaataagaaaaaagggtatgttgctactcttttgaaagaaaaaagaataagaattcccgaagtaatgtttaaacccaaggatttcacaaatcaaagataaaggattcccgaacaagtaaacacgattttcaactgtctcaacaatagaattggaccggaataaggaataaaagtgaatttgttcgagatgaggcaaagaaaagagtttagagacgactcaaaaaatttcaaaggatttttttctttcaagtctgtcaatcaaaattagtcaacttgagtcatgagtataaatgaaatttgttttttctgtacggaaattaatgcaagtcatattctcgagccgtatgaggagaaaacctcctatacgtttctagggggggctttgtttatctacatctatcccaataagctgtctatcgaatcgttgcaattgatgttcgatctcgaagagaaggaagagatcttcgaaaagtaggtttttatgatccgataaagaatcaaacttgtttaaatgttccagctattctctatttccttgaaaaaggtgctcaacctacaagaaccgtttctgatattttaaggaaggcggaattctttaaagaaaaagaaagaactttgagttaattgaagaactaaatgaataaaaaactaggagaggctcactagtatcccttgttgtctaactatttagaaataatttgcctctttcttaatcctatttttgactggatttatgtcgtgccaatccaacataagcctttatttttttgagtttttctatctaatttttttcttaccattgtatttccattgacaaaggtccattgaacatctagaatttgtagatggataagtctctttatcctcactccctattaggttttttgcctacactttgctcaaatggtagggttgtccctcttgtttgtactctcatacaagatttatttatttatttaaataaaaatgctaaaaaaatgacaattttacgatcgtgattggtgccacttttaaccttagtgaaatttaaccagacccgttccttttggtatctgagtgttttcaatggtgataaaatctttcttttaatgtcttgctattttaagattttgacaggggtgtgcggtgtaattccattgatttttggatttcgatcgtatctaagatcctagtttatctgggttgctaactcaatggtagagtactcggcttttaagtgcgactatgatcttttacacatttggatgaagcaaaaaattcgtccagactcttggtagagtctataagaccgcgactgatcctcaagggtaatgaatggaaaaaatagcatgtcgtaataaaatcaatttcttattttggatttttggaatggaataaaaaaattctgattttctgggtctaatgaataaatggatagagcctggctccaattctggtaaaacaaaaagcaacgagcttaacttcttaattggaagaactccctgatctaattagacgttaaaaatagattagtgcctgatgtagggaaaagctggttttcctatgagtagacctttgattttttcttttttttttagaaatcctaattattcttgattttggattgaaaaggatgttatggattgaatgtgtaaaagaagcagtatattgataaagagactgtatcccaaagtcaaaagagcaattggcctgcaaaaataaaggatttgttctcttttgtaattagaacaaacataaacaaattggatagaaaaggagcggaaaaagatccgtggattagactccttttcttccccaggggtttgtattaaaaaatgcaacaccctgttctgaccatattgtactatgtatcaccatttgataaaccgagaaatatttctctctctctgattcaagtagaaatacaaatggaaaaattcgagggttattcagaaaaacttaaatttcctagacaatatttcgtctacccactactctttcaggagtacatttatgtgtttgcccatgattatggattaaatggttccgaacttgtcgaaattattggttctaataacaagaaatttagttcactacttgtgaaacggttaatgattcgaatgtatcagcagaatttttggattaatttggttaatcatcctaaccaagatcgattattggattacaacaattttttttattctgagttttattctcagattctatctgaggggtttgcgatcgttgtagaaatcccattctcgctacgagaacagtcttgtccggaagaaaaagaaataccaaagtttcagaatttacgatctattcattcaatatttccttttttagaagacaaatttttgcacttacattatctagcacatatagaaataccctatcctatccatttggatatcttgcttcaactccttcaataccggatccaagatgttccatccttgcatttattgcgattctttctcaactactactcgaattggaatagttttattacttcaatgaaatccatttttattttgaaaaaagaaaataaaagactatttcggttcctatataactcttatgtatcagaatatgaatttttcttgttgtttcttcgtaaacaatcttcttgcttgcgattaacttcttccggaacctttctggaacgaatcatcttttctaggaagatggaacattttgggttaatgtaccctgctttttttcggaaaaccatatggttcgttatggatccccttatgcattatgttcgatatcaaggaaaggcaattcttgcatcaaaaggaactcttcttttgaagaagaaatggaaatgttaccttgtccgtttgtggcaatattctttctctttttggactcaaccgcaaaggatccatctaaaccaattagaaaactcttgcttcgattttctggggtacttttcaagtgtaccaataaattctttgttagtaaggaatcaaatgctggagaattcatttctaatagatactcaaatgaaaaaattcgataccaaagtccctgttactcctctcattggatctttagcaaaagcccaattttgtactggatcggggcatcctattagtaaaccaatttggaccgatttatcggattgggatattcttgatcggtttggtcggatatgtagaaatctttttcattatcacagtggatcttcaaaaaagaagactttgtatcgactaaagtatatacttcgactttcatgcgctagaactttagctcgtaaacataaaagcacggtacgagcttttatgcaatggttgggttcggtatttttagaagaattttttacggaagaagagcaagttttttctttgagttcgccaaaacaacttacttttctttccgtggatcgcacagtgagcgtatttggtatttggatattctccgtatcaatgatctggtgaatcctcttaattaatcattaaacaaaactaataaactagaaatgattgataaatgatcaaggtaaaactttcacagtttccattctgaaatgttctctgtactataataaatagtaagtgaatcaacttactactaaaaaaattagtagacttcctcttcggaatagaaatagcctatttctacatagggaaagtcgtgtgcaatgaaaaatgcaagcacgatttggggagaggttttttctctattgtcacaaggaataattatctactccatccgactagttccgggttcgagtcccgggcaacccatatggaaactagaaaggagcaatctgagttttgatttttcactcacttcatttacaaaattntttggtttggtaaattttgttgtatggatatacaactgtcggngctggcttggttgacattggtatatagtctatattatactgttaaataacaagccttctattatctttctagttaatacgtgtgcttgggagtncttgncatttgaataaaccaagatcttaccatgactgcaattttagagagacgcgaaagtacaagcctgtggggtcgcttctgcaactggataactagcaccgaaaaccgtctttacatcggatggttcggtgttttgatgatccctaccttattgaccgcaacttctgtatttattatcgccttcatcgctgcccctccagtagatattgatggtattcgtgagcctgtttctggttctttactttacggaaacaatattatctctggtgccattattcctcttctgcggcgatcggattgcacttttacccaatttgggaagctgcatctgttgatgagtggttatacaatggtggtccttatgagctaattgttctacacttcttacttggtgtagcttgttatatgggtcgtgaggggaactgagtttccgtctgggtatgcgtccttggattgctgttgcatattcagctcctgttgcagctgctactgctgttttcttgatttaccctattggtcaaggaagtttctctgatggtatgcctttaggaatatctggtactttcaactntatgattgtattccaggcagagcataacatccttatgcatccatttcacatgttaggtgtagctggtgtattcggcggttccctattcagtgctatgcatggttccttggtaacctctagtttgatcagggaaaccactgaaaacgaatctgctaatgagggttacagatttggtcaagaggaagaaacttataatattgtggccgctcatggttattttggccgattaatcttccaatatgctagttttaacaactctcgttctttacacttcttcttggctgcttggcctgtagtagggatttggttcactgctttaggtattagtactatggctttcaatctaaacggattcaatttcaaccaatctgtagttgatagccaaggtcgcgttattaatacttgggctgatatcatcaaccgtgctaatcttggtatggaagtaatgcacgaacgtaatgctcacaacttccctctagacctagctgctcttgaagttccatctcttaatggataaggcttttctgctaacatatagcaatttttgaagaaaggaaagctagaaatacccaatatcttgctgaagcaagatattgggtatttcttttttttttattttgaatctttctattctgaattcagttaacgacgagatttagtatcctttcttgcactttcataactcgtgaaatgccgagttggtacgaattcccccaatttgcgacctaccatagaatttgttatgtaaataggtatatgttcctttccattatgaatcgcaatggtatggccaaccattgcgggtagaatgctagatgc

SEQ ID NO: 44103 - DNA, 6478 bp, Oryza sativa
acgctttaagtatgcaaataattccgaatggaatgattttgaatatcgatttcttggtaaaaaaccttcacccaattttgaattgtcaaaacaagagctttatgcaagagtggaagccccaaaaggtgaattaggaatttatctggtaggagatgatagtcttttcccctggagatggaaaattcgtccacccggttttattaatttgcaaattcttcctcagctagtcaaaaaaatgaaattggctgatatcatgcgatattaggtagtatagatatcattatgggagaagttgatcgttgaaatgataatagacagggtacaggtagaagctatcaattctttttcgaacttggaattattaaaagaagtctatggactgatatggattctacccattttgaccctcttactgggaatcacaatagaagtactcgtaattgtgtggttagaaagagaaatatccgcatcgatacaacaacgtattggtcctgaatatgctggccccctgggactgcttcaagctatagcagatggaactaagctactttttaaagaggatatcttgccatcccgaggggatattcccttatttagcattggaccgtctatagcagtcatatcaattttattaagttttttagttattcctttgggatatcgctttgttttagcggatcttagtattggtgtttttttatggattgccatttcaagtattgctcctattggtcttcttatggcaggatatagctcaaataataaatattctttttcaggtggtctacgagctgccgctcaatctattagttatgaaatcccattaactttttgtgtactagcaatatctctacgtgcgattcgttaaaataggatctttttcctctgaaattcattgaatatttatcctccttttcttattctatattcaggttagtaagttaaactagatagctatatgagtgaaacaaaactgcttattaatttgtagtaaaaagaaaaaatctcatttcctatgtacaagaaaaaatggaagtaaacataagcggtgtaaattctttaccccaaggttgagattttttgattagtcatcatatcttgaagcgggcaataataagggattcccgatacagaaagttgtaatcataagggaatccatcaaaagttagtgagggattagaaacactaaagtacataaaggattagtaatgagggaatctaaagcattagatatttttcctcataaaaggaatcataataaggacttgaaattggtggaaatgagcaagtagtactttcttcggattccgatccagagtatgttcccattcacttgttaaggaaatggctatcaagaacgaattaaccctttattccttttttctttttaaatacccctcggggaaagaagaataggacaaaagatatggaatgcaatacaaaaaaaaagatctttatttattctttccgtcgtttatccatattcatacagaattcttcatgaactaatacccaactcttttcgtttattaattgttataacgagtgttttattccaagattaagttattgctgaacaaagaaaaagtaccattatattataaaggatgagatgaattccgaagcgttttttattattctagcagacagaattcctttggtctaatttaggacgttgaaatcgattttatcttagataattctaactacgcccaagaagataataacgaaatgaaacagtactttccttttttctgatcatagaggagccgtatgaaactaaggtttcatgtacggttttggaatagcggtgggaactgtgatgttatcgtcgactatgattatccaacagttcaagtacagttgatatagttgaagcacagtcaaaatatggtttttttggatggaatctttggcgtcagcctataggttttctggtttttctaatttcttctttggcggaatgtgaaagattaccctttgatttaccagaagcggaggaagaattagtagcaggttatcaaaccgaatattctggtatcaaatatggtttattttatcttgtttcttacctaaatttattagtttcctctttatttgtaacagttctctacttaggcgggtggaatttgtctattccctatatatccttttttggatttttccaaatgaataaaatggttggaattttagaaatgacaatgagtatctttattacattaactaaagcttatttatttctcttcatttctatcacaataagatggactttacccaggatgagaatggatcagttattaaatcttggatggaaatttcttttacctatttccctgggcaatctcttattaacaacttcttcccaacttgtttcactataaaataagataatacaataacagtaagaatattttcaacacaaaagtcctctcaaacaagagaaagaaacatacctttttcatagatatttcgaatatgttccctatggtaactgggttcatgagttatggtcaacaaacaatacgcgcagcaaggtacattggtcaaagtttcataattaccttatcccacacaaatcgtttacctataacgattcactacccctatgaaaaatcaattacatcggagcgtttccgggggcgaatccactttgaatttgataaatgtattgcttgtgaagtatgtgttcgcgtatgccctatagatctacctcttgtggattggagatttgaaaaggatattaaaaggaaacaattgcttaattatagtattgatttcggagtttgtatattttgtggtaattgtgttgagtactgtccgacaaactgtttatcaatgactgaagaatatgaactttctacttatgatcgtcatgaattgaattacaatcaaattgctttgagtcggttaccaatctccataatgggagattacacaattcaaacaattaggaattcaactcaaagtaaaatagacgaagaaaaatcttggaattcaagaacgattactgattactagaatttttttgttagaatccaaaagttctttactaactagaaagaaaaacgaatacctactgcttattgcaaattattcctgattttaaaccagagtagattttcgtgatgtgatttctaactatagaaagaacttatatacaatatacaaaaaaatttcctaatcccttttttcttccttgaatcttttagttttagtcagttcatgaaaaaatttatactattaatttcttcttatccataatggatttacctgggccaatacatgaaattcttgtgctatttgggggatttgttcttctactagggggtctaggggtggtattacttaccaacccaactttttctgctttttcgctaggattagttcttgtttgtatatccttattctatattttattgaattcctactttgtagctgtggcacaacttcttatttatgtgggagctataaatgtcttgatcatatttgccgtaatgttcgtaaatggctcagaatggtctaaagataagaatttttggactattggagatgggttcacttcactcgtttgtataactattcctttttcactaatgactactatcccagatacgtcatggtatggaattctttggactacaagatcaaaccaaatagtagaacagggtctcataaataacgttcaacaaattgggattcatttagcaaccgatttttatcttccatttgaactcatttccataattcttctagtttctttaataggtgcaattactatggctcggcaataagaaatacttagaatgagtcaaaattataagaatttcaaatctaaaataaatcactaaagaaccacaattttgatttagtaaaactcatctactgccaacaaataccttcttttctcttttgttgtgtaattgttctattctaattaattcaatcggttcaattcttgtccccatattgaaatgaatcgagattgataaggagttagttaatgatgtttgagcatgtactttttttgagtgtctatttattttcgattggtatctatggattgatcacaagccgaaacatggttagagctctaatatgccttgaacttatactgaattcaattaatctaaatctcgtaacattttctgatctatttgatagccgccaattaaaaggagacattttcgcaatttttgttatagcccttgcggctgctgaagcagctattggattatccattctttcttccatccatcgtaataggaaatcaactcgtatcaatcaatctaattttttgaataattagacatagaatcttctaaacaaagggacacatataataataatatgaaatagtaacatgaatactatttattatttgagaatatctattttttgagtaggttattccatagtattcttttttacttagttgaatttttgcaattcattgatattgcaatttgaatattgcaataatttatattgaaaagacgatagccaatttattggctaattcgaattcgtatatacaattcgtataattatgattgttgaagcccaaaattaaagtctcttggctcttttcatgctttctcacaaacggattaagaaatatattgcattatttgttgaagtttggataaaccattgcttcgtctggtgtctacaatacatttgattgatatagtactaatttcattttgaccagatcgaaaatttttatgttgaaaaggaaaatttatagacccaatgtcacattccgtaaaaatttatgatacatgtataggatgcactcaatgtgtacgagcttgtccaacagatgtattagaaatgataccttgggatggatgtaaagccaagcaaattgcttccgcgccaagaaccgaagattgtgtgggttgtaagagatgcgaatccgcctgcccaacagattttttaagtgtccgcgtttatttaggacctgagacaacccgcagcatggctctatcttattgatacgttacaaaaaattccacttgaatcgtctgattcctctttaccgaagaagcctgtgctcaaaataatcgagcacgggcttttctggtcaaaacgtatcttgtctttatcactttatcatgagttcttttccttggttaacaatacttgttgttttgccgatatttgcgggttcattaattttctttttacctcataggggaaacaaaatcgttaggtggtatactatgtctatttgtttattagaattccttctaatgacttatgcattctgttatcatttccaattggaggatcccttaatccaattaaaagaggattctaaatggatagatgtcttcaatttccactggagattgggaatcgatggactttcattaggatctattttattgacaggatttatgactactttagctactttagcagcttggccggttacccggaattcccgattattctatttcctgatgctagcaatgtatagcggtcaaataggattattttcttcgcgagaccttttacttttttttatcatgtgggagttagaattaattcctgtttacttacttttatccatgtggggggggaagaggcgtctctattcagctacaaagtttattttgtatactgcaggtggttccatttttttcttaatcggagttctaggtatgggcttatacggttccaacgaaccaagattagatttggaaagattaattaatcaatcataccctgcaacattggaaatactattttattttggcttccttattgcttatgctgtcaaattgccgattatacccctacatacgtggttaccagatacccatggggaagcgcattacagtacatgtatgcttttagcgggaatcctattaaagatgggagcatacggattgattcggatcaatatggaattgttacctcatgctcattatctattttccccttggttagtaataataggagcgatgcaaataatctatgcagcttcaacttctcttggccaacgcaatttcaaaaaaagaatagcctactcctccgtctctcacatgggtttcattattataggaattggttccataaccaacattggactcaatggagctattttacaaatattatcccatggatttattggggctacactttttttcttagcgggaacggcttgtgatagaatgcgccttgtttatctcgaagaactgggaggggtttctatcccaatgccaaaaatttttaccatgtttagtagcttttcaatggcttctcttgccttaccaggaatgagtggttttgttgcggaattagtagtattttttggactaattactagtccaaaatttctgttaatgccaaaaatgctaattacttttgtaatggcaattggaatgatattaactcctatttatttattatctatgttacgacagatgttctatggatacaagctatttcatgttccaaacgaaaattt

SEQ ID NO: 44104 - DNA, 1630 bp, Oryza sativa
cgatcacgatgactggagaacttgatccaaactttctgttgatgccacttgaacttctggtctaacctctcaactaggcaaagagctctagccagaactttcggtcactattactggaacatttttcctacgtgagtgtggtgcattgtgtctcacttaagataaggctagagtaaattctatgtgtactcctgaaaactcactcaatcccttttgtacctctgaaatttacccaatcccttctatacccctaaaatttcaatttgatctcttccatgcccctaccattatattttccatcatttcactattacatttggttgcaaatgtctttttttgcccttgatgctttaggtttgaatataagcttaaaaaatgattaaaattttgtttgagtgcgcagtatctgcaatttatgaaactaatggatctaaataattagtgcataaaattttgacataattaaaatttttatttgaaattttaataggacaatagattttttttatcgggagcattcataaaaaaaattattgtgaacattggtcctatctttgtatgaatgctcctaatttttatgaatttttttataaaaaataaatacattttttatttcattatataaaaatattttttgggataaataatacatcgcacaacaaattcataactataatagtctcatgcgagaagcttttacatttttaataatgttcataaatttctatgttcatccaaagggtaaaatggttatttttatagaaattagacgatcaactgacgggaggggtatggaagggatcaaaatcaaattttaagggtatataaggaagtaagcaaaattcaggggtatagaagggattagctaaaattctaaaggtatacaagagattttctctcaaagatactatgaatacttgggctgaaatccaggccttatacatgaaccactcttaataatacagattttctaagactcaaattaaaattaaaaataatttgcgaaagggcctgtagcttagtggttataagagcctcagtagcattttaggtcctgggttcgactcccataggagcgaatttttcaggatttaactgtattgtgcttttcagtggtaggcgatgtacccatcgacaacgaggtgtctgtggtgactttgtcaatctctagccggtccagtattcgaagatgctcatagggatagggtttgcgtgcgtatgttcatagggtcagtggcggatctagaaaaatgattcattggtgtcataacgtgtctatcggtgttatagtatgctaattatacttagactatagtgttataatatatggataagcaggttttgccaaaagttgtcggtgtcttctgacaccgatgttaacactgtagatccgcccctgcatagggtgagtgtttgtgcattgtgagtgtatgtgttgtactgtgtaattctaaaaaaaaattaaaccatcttgagtccttatgccacttgctttaaatttgagcatttgaattatttttaatttaaattattgtcactaccgcagaaaacgttaaaggtgccggttgggaaaccacctttatgtcagttttcccaaccggcgttttcccaaccggcaccatggaagcgg

SEQ ID NO: 44105 - DNA, 22170 bp, Oryza sativa
attgtcactaccgcagaaaacgttaaaggtgccggttgttaaaccacctttatgtcagttttcccaaccggcgttttcccaaccggcaccatggaagcggcacagatgacagagccggcaccgatcgcatttttaaaaccggcacctttgataggttcatgagccaaaaaaaaattagctcgatgcaccggcttgaatcgagccgatacattgagccgatctcatctaacatagaaatcccaaatcaatcccaatccccaatcaaacaacatcacagaataacaaacatgaaaaacatcactaaaaatctttcactaacattgaatctttcacaaaaatcattcacaaacaacgtaaaaaatggatcgatgcggcagcttcaatcttttactaacaacaaaaatcaggaaaaaccagaggaaagtgccaccaccgccggtcaccaccacctcttgccgccggtccgccgccgcaagtcccccctccagatccgacggagggacggcaccaccactgccggtcaccaccacctcttgccgccaggccgccaccgcatgcccccctccagatccgacggagggagggcgccgccgcctctcgtcccgccgccggatctggcggacgggagggcgtcgcgcccagcccgccgcccctcccacctctgccgggccacagccgcctccacgcctccggatctggcggaggcgaggactggcccaccgcctccacgccgtccaccgccaccgccgccgcacctcccgtccacgcccatcctgccgccgcagagagagagaggagaagaaggatggagagaagggaagtagagagagggagagaaaaagccgagaagacgcagctcgaccgctcgaccttatctccccgtgggtgtgggccccaccgtgggaaaatatctacccgctggctcgactcgatcctgtgggtgtcgattttttaaaaaaaaaccggcacctacaatatattataggtgccggttcttataataagaaccggcacctataattgcttaaaggtgccggttttttgcgatttcaacccgtgggaagtgggaaaaggcatataggtgccggttttagcacttccggcacctataatgccgacacctatttgatgttttgtagtagtgtgtggagtgtagggcggttgattgatttaaaaataatttgaataatttaaaccgtcttgagctctagccttgatcgatctccacagggggttgaaaatttgagatgtctaggaaaaggaatacctgcggtcttgcgaaaattatttctgtatagtagggagttgttcttgtttttggaaccacgttagagactacagagaatgaaatggttaacaaagtactttctcggatggtagatgggcttgcatacttgaagtaagtttggaacatatcttcatgtaattgaccaattgaccacacttgtgcaaataatattgtacgactaatcgcatgacttgtgatcaaattaggacacctctggtgaggagctttaattaattattttcaatgtattttgttttgtttggagagtgcatgcatatatcattgaggtgcctatgcgtatatatgcatagtagtgagtatatgtatgtatttagacatgcatatatacgtatttacacgtatatacaggggccgatttgctatgcgtctgggtcacacatgttcagattcacgtagaatttgatgggtggacagatggacggatggatggatggcaagtggtagggagtgtatagatttgtaggagaatgttccacaatggcatttaatcgccgtggcatcatcaatcagctgtcttaatgcatgcaggttgtggagtatagttggcacataaagccaaacttgaattgaattgcattggatctcctttcatttataattaaaccacacgccatcaatcgaaaacggccacagcattgatgtatgcctcagaaatgcacttcattggcctgtgcagatgctccagaaattcaattatttcgacacgctcgggatgttttgatttgatcgatatgattggcgtgcgaattttgtaacagtccaagattttttttaaaaaaaaaactgcccattttaagaaaacttgaaatatgaacaacaaaaacagaagaagctagcagttttttcgatttatgaacacaattatataggaaatagttctccataatcaagaaggtactagcaagcaggggatgcagggatttggattaatgaaataaattggagccgtttctctgacagtatgcaaaacaatactccattgttgagtggcaaaagcaagcaaaggatggcccatgcaagcttgcagctgcgatgatatatgatggatgcatgcacaaatgcacatataattgttttggctgcctgcaattctgtttggtggtcacccggcgaaaacacaggagactcccttgtcgtctaattgttgttcgcttcttcccctgacggatctttcctctcttttcccctcccgacgacgtcagaatctctctctctctctgctcctgcctcctctgctatggcctctgcctctgtctctctgcgactctgccctccctctacgtagttacgtacgtacatgcaatcacaatgcctgcctgcctcatactatcatatacatactatactacgtacactccatccgttctgatcaaatactacccccgttctaaaatataacaagctagtattgaatagaacatattctagcaatacggatctgaacatacatatccccattacagatttttagtactaagaaaagtctcatatggtattatattgctatattttacaatggatgtagtataaatattttttggattcaaattttgtatataatataagcatttgcataacactaatttaaatatggaggaatctgtgcatttttagccgatcaggttttaggcgggcaatccaagtaattgaaaaacacgactgatcaagtgagactgaaaaggaatttttttccttttatctttaaaatttttgctaaataatctagaaataattatattttagaacagagtgagaatggtgcaacggagctattgaagctagtgactctgcatggcttggtaccacacctactactacaccaacagtggcatactacatgtattcatggggctggagctagcctagggtatatgttaccactgcaactacagtttcttcaagagggtcaggcaggaaggcaggcagctgctaggagagctctgctggaatagagataggaagagagagagagagaggtgtatagtaggtggttgaatgggattaaattgggggggaagaagaagtaaatgccccaatagcaggggatgagaaagcattgcatggctgatgctactatatgcatgatcctcttaatagggcctgcagcggcttatttatgtgttacttaactatgccatgacttctccgtgtcttgtatcattcaatccctcctctcatcaataaatcaaagctagctagcttgctcttcagcttgtagaaaagagagatactctacaaactcctcctactctctggccatagaagggggacagagtgagctaatgagcaagtggcaaaactatcagacaactaagccatcaaaaacattataacttcttttcctacttctcaagttagaatagtatacatgcatgattgcgtacctttgaatcatttcaggtgaccaaatatgaaagaacaaaataaagaacatgagatatatgtatgtatgcatgtgacatctatatatgtatactgtacatgagtacacatatctgaatgtactaaccatttagtagtactttgctgtgtgtaggtgcaatatatctcatatctgtacaatgcatgcaatggtgatgagagccggccggccggccaagatcagctgatgatcaaagctatgaacattatgcatccatcagcatgcagccggcatcctgtgcgtttccgtcagtatgtgcatgcatgcatatattatttgcacatgcatttctgtgccacacagcttgtccgcatgcgtttgtttgcgtccgagatggcatgtatacgtactgacatattgcttatggctacctatctgccatgcattattcccctttaattttctttaattatatatgcagttaataattatatacacgcgcatatacaccattactccgcggtacacgccgacgatcgactgtgttccataaacgcatattcaaataggtacactagttgtttttttttcctaccattttgaatgagctttttctagacgtttaattaatttcctctgtaattacaattaattatttaaaatttggtcaatatataacaacacatgtatatatattctaatttcacaatatatacctcgaagaattaaccaacggcggtttgtcaattttattttgatttttttattgtctctctcttctaaataactccctccgtcaaaaaaaacaaacctcattatttgtctttttttttacggagggggtattaattattgtatcggcaagtgttccacatttaattaattagcaccaaaactagatataaccaatactcctatacgtatacgttatatatgtatactacactcaaataccaacatcaacattatttagtaaacccactactatttatcaccaggccaacctgtcatgcattgtctccctgctctccctaacttcttagtcaatgcaatacttttaccctatcataccgtacaaaaacactgtgtagtgtgtacgatgcatatatgcttgagattttgaaactgatcctcctacctagataaatcctaagtacctctcgtttgttttttaatgtatgacatcattaatttttttatcaacgtttgatcattcgtcttattctcaatttttgtgcaaatataaaaatatttaaatcatgcttatcagaacatttgatgataaattaagtcacaataaaataaataataattacataattttttaataagacgaatggtgaaacaacgtatctaaaaaatcaactgtgtcatagattaaaaaatggatggagtttatatagagagagtatcagaatatacgcgcacactactctgatcaatgcattcaaaattaaacaagggattgcatggacgcctcctttacctatttaagcccctttggtttgtttctctcttgtcgcttccttttgtcaagtttgtagttaatatatcacataaatacattaaggaatgagataattaagttcaggtgaattctaatctaggcaactttcaattagctgcaaattcaattctcattcagctctgggcaggatcctctccttaacatatcacgccattgtacacccaaattattgcactgattagcagcttcaatgcatatagtggtccaaaagaactaactgatatgagacatacacaacaagacacacagcaatttagacaagcactttacgtacacccacttgtttacaagagacatacacatgaagacatataagtgaagctggataaacactttataaccacacatggcatgcttaatgactacaagagacacacacaaagagacacacatgtggaaaggagataggcttacactttgtccatttattcttccctttttcatggatctgtgttttacttcttggactcatcttgttagccaatagcagtttattgcattagccagcagctttatccatgggcaaatagaatgttagaaagaaaggcgataatataggcgtcgttttacatatttatgcaagctaacgacttgactcttagcagccttttgtggcagggcaatagaatgttcatgatcacatgcgatcgatcaagtacactgacacttacaagctagaccaattccactttaattaattcatgaccttaaaaataattttaaattaagaactaaacttaccgtacactatatagctggaatattagcagccataatgttacaagaagtgtacgtggacgatttggagggcatgaatccaagtattccttgcagcggccggcgtgccctgcagtttaattattcccatttattgtgacagtagtgatatttaatttataagtacctctcctccatcttttaaatttatttcatgtataccggcactatattaattgattatatttgaaactaattttctagtagttccaaagtaagccacagaactgaaatatgtgaacttagtttttttctttaatcatcgcaatcacacgcgccttatgttgcatgatggttcaagaacctaatacgtaccctctctgcagattgcttgttctctaatggtacgcttgatctgatgttactacggagatatatcagctacaattatctggatcatatattatacaagatatttttactaaaaaaagttttttcacgcaatgggcatctgtgtataatttttttttaaaaaaaaacatgcatcagggagtatacagtgttatggtacattcttctcccttcctttttctctttatttacttcagagttcagatttttcatcaaccatgcgtgcaagctctggccgtacgtgcccttcaatttggatttaatttatagctagcagaaacttcaatctgcctatacaaatacagtatagtactaacttagcagatcctagttcttctaatcatgtgctgcatgcttgctagctgcagtctacacaagactatatttcagatcgaaagttccatacttatatatattcatctaaacatactttttttaaggaagttaaatgcattctatacggtggtatgtctagctagccagctactaagtgaaacagtactatatggaagcttagatatagatatgggtcatatacatataaaaaaaaataaactgtgcacacatgagtgaccacgctaaataatctagattcacataaatagcattctgatcttgcatgatccctctcctacgatcgattacacccctaaaaagcttcaaacttttgcctgctgcaggccgtgtcttcttccagatgcagccttccagtacatacagtacatgctacgtacacactcagattaactgcatctgcatcgtatctaataaggggtgtcactagctagcatgcaaatgtagatacaatacttgaacataaatgccatggcaatatgtgctgcagctagctactatagcaatatatgatttgaatttgggtgtggctctatacttatttctctgcaaaaagctggggtatccatatatgtgtgtgtgcatgcaggccgttgggtacacgtatatatactgctatactgtgggtgcagtgtaactactacatgccgtccttcatctgttttcaaacaggagtaattttattttttttccaaacaaaaattttcaaataggactagctagatgattgtttacattgtatgaagtcattttcaaaatcttaaatcactagcttatacaaaattaaactatcaagatatatttcagatgcgacaaatgatatttatattataaataatattttattcatttatttatattattaaaatagactacctccgttcacaaatatcatggatccaggctatatatgcaccgggacatattctggatgaaggtagtgttattaaacatatatactaaaataacacgatagaagttgagttgatatccgaaacaacgtgcagtaataatagaaggggattgctaggcttatgctcactggaattcctcacaattttacttacgcaatattcaacctcaatcttgactgatatatgcaggaagagaggagaggaaggaagacggcgactcaccggacatggtgacagcgatacccaaccctaataaagaatctatgcattaagatcttgagaggttggaggggaggggaggtatagaggagcggtgaggacggctttagagggataccgtggtggcgcaaaaagtgacagtggcatcggagccggccactaggatggatggtggggcagagtcaacagtggggggggggggaatatactgtgtggttaggtagcaatgcagatccggcagcacgagccaccagacatgaaggaggtggtactgggcctcgccggtgcaacgattgcaaagtagagggatatgcacagggagagtgagacatagtcgatcggggatctagctagctagcagcggtggaatggaccaggaagggcgagggcgaagggagaggattagtttttgcccgaatcactacgccaaatcggcccatctgtgacggcctattagtgacagaccaaagtgcctcgtcagagataacctcatctgtgacgggttacaataaatcacgtcatagatagggctcaagaaaataacccgtcacaggtaagtactcatctgtgacggatctatataaggaactcgacacacaacatctttaacgtgtctacatatagatccgtcactgatgacctcttacctgtgacgggttttaagtttgtaacccgtcacaggtgagatacctcacctcaaacgtgttggatttttttacccgtcactgatgacttaaaaaaaagaaacccctaccacccacccagggggcccaccacccacccaccttccggccttatctcctcttctctcttccttctccccaccactctctcctcttcctcaactctctccctcacttcctcccgacctcccgcctccacctctctcttattcctcctgacctcccacgtcccgccgccagccgccttcacctcccgaccgccgcctgcctccacctcccacgcctcgccggcccctcggccatcggacgccggatccggccgccaacgcctcccccatcgactgccagactcctcccctgcctcccccaccggatccagcctccacgaggtcggggaatgtggatccgtgtcccgcccgcctcccggccgccagcgcctcccacaccgactgccagactcctcccccgcctcccctaccggatccggcctccacgagatcaagggacgtggatccgcgtcccagccaccagacgcggccgcctcttgaccgtcggacgccggatctggcctccgggaagccggatccggccgccagtgcctctcccaccggatctcgcctccacaaggttgggggacgtggatccgcgtcccagccgccggacgcgggcgcctcccgaccatcggacgccggctctgcttccccttcactccggcggccggatgcgcctcccaccagagggcgctgccgcctccacctcccgatcatccctcgccatggccgccatcctctcgttttgcattgatattatattgttgtatgtggattgagaaattcttgccatcccctttctttgaatgtgtgctatatgacatctatgaatgtgtgctatatgagatctatcggtttgaatttcttgtgtgagcaaagcaattgtgtcaacgagcaccaccatggcagcgtgcgccattttttttgttgctaggtctttcacaccagtgacgggttgcacgctatgtctttcaatttttttttgttgggttaaagacatcactgacgggtcacaaactaataggtcgtttgagataatagtcacctgtgacgggttttatatatggtccgtcacaggtgttggtcaccactaacggaccttcacccatcaaaggtgaggacagtcatcagtgaccacttatctctgaccagggctaaatccgtcagaggtgacagtttgagcccgtcacaggtagccttgtccggtgtagtgaatcttgatgcgatctgagccatccaaaagtaactaaaatttgtggttatttatttaactaggaaggtagcccgtgcacatgcacgggcaccttgtttaatgctgatttagtttttcgaatgtttaatttttttagatatactgattttattagtcttgctaaaatgtttaaatgtttctatttagaattaataatttttggttcaattttcatttcctttcatctcttttttttgggagaattccattctatgaaacatccttgaaatgctttgatccctgtaattcgggatgaaaatatgtgggttgatcctataacccggcatggggtaaaggtatccattctaaattatctctctccaattaagtaagaaaattttaaataaaggtcatagtttttttagcaaattaccactaaactggagtgtcatataaaaatacacgcttctagaatgttctatgctaaatgtcaggaattcatgatgtaccgtatcaagtttaaatggacatttttcttattcctatatggaattagcttatatattgctaaggcgacgtcatggttatttcaatgttaagattccttagtgcaaccaacgtgctctgtacgatcaatatgatattcaactggttacgcgacttcatatatcacatatataatttagatgctatgatcatcttaagattatttatttatctcttaaaaagatcatttattgataaaagatcaatataggaatgtatgggtaaatagctcttatatacatgctgagggaaaaatataattaagtagatagaaagtcattagatgtctaatggaatataagtaatgggtctaccagttttatgaaaaattaaggtgggatattttgatttttagtgagaaattttagaattttcttttatttagtggaggcctcaatatggatgtgggtctagaatgtaaatttttgttagcaaaatatagtccatatgggtattaaattattgatttcacataaataatatggtaattcaaacagatcataaggggcatagggatagctggctggacctaatatatggaggttaaattgtggtcttttctttgcccataaagataattttaattttaattgttatagagatggaataaatagagaaaagtaatgccgcaggaatagggatggagggagggttgggatgtttcttttctttaaaaaaatatttatttaatgatatgaaataatgtgttgatgtttaagtcaaaaccgatggccggatgttttttttttctcagatttattaggactttctgtaatttaagcgagattagtagcagcttactaaagcatttacgtactttaatgtcctaattgtttgggattttttttaaaaaaaatctaataacaacgtaaaataatgtgtccatcgatttaagtgaaaacgaatagttgaatgtttctataatttaaaagtgccacacaactgttagagagatttatagtatgtttagtggacatatgatgtatttttgtgggtcttttttttttccataaagataattttaattttaattgtgattacgatgaaaaaaaaagaaagcaatacttgtgtgctgcacggaggcgcggcgttgagaggttttggtttttaagatacatctaacattctaaaataatcggtccactgatttaaataaaaataaaaatggatggtcagttttctctattttattaaaataccatgtggtggcttgggagtatttttagggtgtcacatgacggcttaggagcgtttataaaaagtttaataaacttttaatatgttatagatagatatgaagataaaattagggtgcgtaaaaaacaattaggatatgattatttgattttaattattacaaacttgacaaatgaatctatttgactttttaaaacaattggcaccttatataaattgtcaaaatttttgtggcgttaggatttgaaatattttgaatttgtccattgatgaaagaatatgaattttaattgtaaattcaaattttatctttgagctacgtaggatatataatttattgacagcgtcctgtatataggagatataatttgctagtcccgtaggagtaactaatctggcttgcctttgcttagagatagatttggtatcttatatggaagaagcatcaaactaatctacataagatggatgcatcgtgcgggaatgcacatgtgggccctcgctttctatacacacagatacacgatacattgagtggggctgcaaatgtgggtccctatatatatcttgttgtgccatgtggcagcttgagatcgttttgaggatgtcacatgtcagcttgagagtgtttataggaaatttaatggacttttagtatataatagatagatagaagatagatagatagatttgttggaactgaaaaaactagacaaaaaaaattgcagaaaggaaataatgtgaggcaatcaataattaagtaatcatgcgtataccgtggtatgcgggcggccagtacagtactactgcatgcatggcacgtacatgtccattaactaatatcgctatcacgtactagctatacgtacgtaatacgtacactacgcagcataagaggatggcagagagaggacagcgatagcatacatatgcatgcaaatcgaccggccggccatcagatctgatgagaccggctgatgagagcagaaagtttaaattgcattggtcggaaaatgtattattgcatatgcatgcatgcatggaccgttaaaattaaagtttggtagatttgtagtactaagtttctaaaaaaaaagatagatatatgtactactactaccttaattataatgtgagacgacgacgctatagcttaatgcatgaggtgtgactataggagtagttgtgatcagtgtaagttaaggctgtcgatttgcaggcagcaggccggccaggggcgcccctgttttgttggtaagttaattaagccgctccctgtgccttttggatacatgtagtaatacgtcatagtgtaatttgtacctgatctgatgcatcgatcagtaacaaagttaacatgctgcatacatgcaggacatatgaaaagtgagaaaaatataccgagcctacttgtagaaaaaaataatttatacaagcggctaatgaaattcattttcaaattaagacaggtgtaggtcgcttggtggaaatggagcaatttccacatatattgccgaacctgttgctgtatctctcaaagaaaatagtcgtagtagttaattcagagcatgcacaagctagcctggtcgatcagtgtgtgaatgaactctgaacttgaatatattaattaattatcccctccacgtacgcgtatgtatacatacgctgtacggtggtggtgtagactatacgcgtacgtatacttgagaatacacaatggactagtactactctagcagcgcagctagctagagcgaggtcaactggcggatcaatgtgttccacatgtaacgagacgacgatacgatgcgaaaggtatgtaggaaatccgtactcctagctatacccctaggtgtctgcatgctagaacgaagtcgatcagtacgcgataacgaacatgcgaaagataacctctgttttaaaatataacaaccgaaaataatgtacgacatgtaataatagttcaaacaaatctggatatatgaaatgtctcattttatttctaggttgttactccctccgtttcacaatataagtcattctaatatttttcacatttatattaactagaaaggtagcccgcgtattcgcgcgggcatgtatcataggttgtgttcaaacactataacgacgtaatataaattggagaacatttccataatatatttaccataaaatagacgatagattttaatatactactaatgtgataagaatgtccctcgaatttaaataaaaattcctttgtcctggtcatatataaactggttgtttctcatcattacttactatcattgttttaagagttaggtgcacttttaataaatgaaactatattagtaccactaaaataaatgatacattattgttacattataaaaattcatcacttattttcacatctatgtataaatagtctaaatataacatatctaccgaataatacgataacatctttaaaaataaacatgaatacctctctaacggatgaagtcaaatgtatctgccaaccaaggctttcatatgtaatgccttgaaacatataggttccgcatcgatgtagccatgccctaaaaaaacatcatagagtactattttaacacttagtttactattggtacactcacaaatgattatattgataagtctatcactttagttacattgtctatggtgaccttaactcaacaatgtgcatgcccatacaatatttacgatagcatagcaagtactgcactttgcattaaaggacaaaaagggacagaaagaagaaggaggtgattgaaacaatttttttttaaagtttcgagtcgatttgtggtagagaatagacaatgtgtatatgaagttagtaataagtgcttctcaaattttaatgcaatacaaacagtattatgtttttcaaatgagtggggttaatcattcggcactacttagaaaaaaaagctatagctaaagagacgtaccaccatgaaaatctacaaaacaccatatcattatttatattttgataaagattcatcctttagtgctagattttttttaacatatattgtttataactaaatgagactcatttactaattgtaataatgtacttattttcacaaacttatttacactatctaattcgctagagtgcacttattgctgagtttcagtggtgtatgacattcatccatcaattatacccgctatattagaatttctatcaattaaaaaatataatataagtagttttatgcatgttttattggattattcattttttccaatactatttggcaaagaacatacataattctcgtgatgaattacgggttgtattgtagcaaaataactgtctaaaatcttatttatttattttttcatatctatccatcttgtatgcttctcactcctcaaatagcaatcaaaaaggtttgaaaaactttcagatacttttagaatctcaatctcacccaaaataaacctaaaaaggtctacttaaaaaccaaagctaaattatattttttttattatcactggctaaaatttaatttaatttttctcatctatctattatttgtgcttctcacacctcaagtaagaaaatttttgaaaacttccaaatactttgagaatctcaatctctcctaaaattaaataaacctaaacagatgtacttaaaaaacaatgataggttttgtttttttaatttttacacatgtagattaaaattaacgttgtatatttttgtcaagtgatatttgacactgtaaaatatgatatgaaattatttgaaacattattatcgtattaactattacatgttagcgtcatttttcatgatatatttatcactataataagtttatattaagtttaattgtgcatatatgtgtagtattatttttaataaaatcgtagattaaaggctgttgacaacaaatcagtgccgacactgatgatttttccttattagtatatatttccgattttactatgtacctatgcatgttttcttgttcttttttggctttattttttttttatagtatatgatgtaggtatttaagttttgttttttttccgggagggagacgatcgtatgacgtaagcgcattatgttttttccgggatagagattagcatcatggtatttttaagagctctaatccattgtttaaaataacgggtccactaatttgagtgaaaactgaaggttggatgcttttctttttttattctgaatttctaggatttctgtaattttattaaagcgccacgtgacaatgtagaagcatttgcagtacgtttaatagacttttaagtatataatagatttctaggatttctctaatttatttgagagccacgtagcagagtaaaagagtttgtacaaagtttaatgtaattttagtatataatagatagatttagaagatggtttaaagaacattgattggatatttattatagatcttaatttaactaaatatatttatacatgtgaagtaatatattttatctttatattgtagaaaatcatattttaaaaacggttgatttttatggatgtatgttgtttgtgacttttttatgtacaagtgtatggtttttttttcttccagcgaaggttaagaaagcttgatcattttattttcaatcatgtacgtttgtatgttacggaaagaacatcagtaacgtttgtatcgtacaatctcatacatacggacagtagcagctagcgtttgtatgttataaacatgtggaagttattatttttttaataatagatctaatctaatggtgtaaaataacgggtccaccaatttaagtgaaaatcaacggtaagattagatagtgccatgtggcgacttaggagtgtttgtaggagtgccacgtggcggctttaaagcgtttgtatgaagtttaatggacttttagtacataataatagatgttaatgaatttggatagatatatatgtctagattcattaacataaatatgaatgtgggaaatactagaatgacttacattgtgaaatggaggaagtatatatattattggacagagggagtatattttagaacggattgcattcatacgcacatatatatacttcctccgtccaaaaaaaaagtaactcaacctaagaatggagattcattgtattaccaaggatcacatctacttctaaattgagttctctttttactactcgatcgatgctccttgttgtgggggattcctatttcgcgcgcgctggctacggaagtagcgcgctgccacgcccccctcaacaccttgcgctgttagcaccgtaattagcggtaatgatgatagttagtgctaattatggtaattagcaatattttcctttttttggaaggtttttttactaatagattgatacgaaatctatacgtgaagtcaaattttgaaaaatttcaactcgaaatttgaaactttcaacccaagtttgaaaactttcgattcggattgaaaaactttcaagtcaagatttgaattttcaaatctttatttaaaagttttcaaattaaaatttaaaaactttgaactcaaaaaattgaaaacacatgctttgaagatttaaaaaatagtcagaaaaaacgcgaaaagaaaacgctagaaataggagaaaatcgaaaaagaaaaaataaaatcgcaaaaagaaaaaaaaagaaagaaaaagcttggcgcgcgcgctgtgctggatcgatcgtaccacgcctgcatgcacagagaggagggagagggagagagagagaggcgtgcagtgcagctaagctagcaaattcctcgtgttttgtgatagatagtactccctccgttcttaaaaaaagataaaccctgggtttacgtgtctaactttgactgtttgtcttatataaaatttttttataattcgtattttcattgttgttagatgataaaacataattaatattttatgcgtgacttgtctttttaatttttttataattttttcaaataagacggacggtcaaacgttggacggggaaactaggatttgtctttttttttttgatggagggagtatgctggagtagatgctggtgctgctgctgttggtatttcgggatgaacgacgacgtacgcgcggtcgccggcccggccggccagcctccagccggcgtacgcacggcgtagcatgcaggtaggtagctgcagtgccatgcattgtgcgcgcgcggccatgtggtgggtgtacgatacgaccgacgtcggcggggcaggcggggggtgtggagccctcgatcggcgtgacgacttgacgctacatgtgttggaaggatccatcaactgccaaaccaacatctcagttatttgctccccgtgtctcagaatacagtaaggcagaattagattagacaccatctaataatattatgaatttcagtaacgctatatctagattcgtaataattaatgtactagatgatatctaatttgatcctatgtttattatattttaaaacggaaagagagaaggagtagctagctagctagggttaattacctgatgtaataaggttatcaccagtgatagaaaattaaggaaatgcatggagtggaaactgactgaaaggtttaatacaaatgaatctcgctagagacgctagtgttagacattactgtaataccctgtatattaaaagatatttagtatttttaagtttgggttgacttgttaaaataaagatgttaacagaaataaataaaagaaaaaatatctttagaagtgggccaacatgagaaggcccataaacccagcccattagttctcccctaaaacctagatagaggggaaccgaatcccacttcccctcatagtgccgccacccctctccctggccggcgcctccttcctcccctcctcctgtgttcgcatctctcccatctacagcaaattgctctccctagatctccaccttcatagcttggatcaagaagcgaagtagaaaaacggaacgaggaggaggagaggagtagaaggaggggttagaccggagtctcccctattgtctcctcacaagttctctaaaaaaaccgtaggtgaggcttatccccttgttgtattagttattctagtatggctttagtgcattaattcgtggttagtgaaggctagagaaggagtttgggtagttgcggttcggtttgttgcagttctgcatgtgggcagatttgcagtgcttcagtttttcgatatttcggggctctaaatgttattttctgcaaaagtgtataactaggaagttgtagataatgtttggatatatcttctgactaaagggcacgattttatcttaagtggtttaggagatataatttttttagtatgattgttgtttttttgtcataatctggatagtagtagactgaactgtttttgaatgggttaaacagtataatcagccaggccgcctatagaaaacattgtagaggtttttcttagcttaccttattggtaaagtacaccctgattgggcgagtagaactccagttaaggttgttttagtgtagacagtctgaaattctggacagattctaaagcctgcattcaagcgcaaattagaccatttaaatggcagaataaaaatatgttttctacatgaaagttgtaggtatttttttgtagattttcaaaatgtatacattttcagtcatagccttttcatatttcaagatataaaggtttgaagcaacagtcttgtgtatagtccaagcgacgttccttgttattgagttttgataggatggggcagtaggtttacctttttcattgttttatacgcatgtttgaatgtgtttgctaatgttttgtttgtgattaggtggtggtccatcagatcgtacatgataccaatccttcgttggaggtaagtgcatgacgaactaattgtgtgattcatcgattgtttactctatctatttatttctgatatatttcaacgtgataagtaactgcttatgttcatattattgttcacgccatttagatttcaagttgatcttttgtgtacgatgttattcttgttttaatattctggattctggttctgcttaaataagtcaagttctctgcttgccatggatgtgtttcaatttggttctttaattctggtttcaattattcaagtaccatgcgtagtcataggagtgcaatttggttctttattcaagttcctgtgggtaagcactgatcacgcttacttggctttgccggcaaatgctaggatgtattcactattgtccgggatggaaactactatttcaattcatacctgcccgggatgggaactactatcttctttgatttggtgtttgaaaatgcgtttcctatcaaagaaagaaagccttctgttcatgctttattgccaatgttgtgtatatgtgttttctagttccatattgtacttgctgagtatttttatactcactcttgtattttatttggttttaggtacgcattgagaccgacatgcacgagcgggaagtagcacccttatatacacattacttgcacactatcaaactatattgcttaggtccataatgacacttaaattatatcctggtttggtcttgtaataatcttttagatttctaatagtttcttccccatggattataaggatggatcgtattgtgggaatgatattgttattagtttaacttataattgcctgtcgtggatgtccgtatttatatgggagactctgccaaaatttctaatatttttgggagttagtggttttgagtgtattttagtgtggcactccaggtacgtggctacctggggcattacaattactccctccgattatgcaaaagttattgatattttggtctggaaagaagataggccatgtttggataatgggtttgggatatgatttcccacccctcaaagggtaaatttcaatcctagccatccattcttctcattccatttcatcctatccctccattcatttccatttcccagtcccacctctcctaacccattatacaaacaaacccgtaatgttatattcgttgcaaaacaaaaactaatgcgatggctccctctgatcgagttggcacagtggatagatgtcaatgtatccacaagcaaacagttgagacatctagggcccatcaatcgattgaagctgcagctatactatagctagctagcatgcatgcatgcatggccatggatcgatgatcatcatccatcaagcatgatatctcaaacacacctcgagccgtcttttccctccacatttattgtacttgcgtcccccaaacatggccactgtgctacacatggacaacggtctactctctctctctctctagattcctcattttcgcaaacattcccctctcttcctccctcctctgcgatcccaacctacccatatttagacaccacaagagaagaagaaagaaagaattgaagctgtgtctagctaggttagcttagcttaggttgtttgcggagatcaatcgatggcggacggcggcggcggcggcctgtgcgagctcttctccgacgaccaccgcgacatccgccacgtcgcggacgccgacctgttccgcatcctcgagacgtgggaggagtgcatcaatggcggcgccggcggcggaggcggtggggtttctttagctggtgtggctgatcagggagccgctgcggccagcaccggcgccggcggtggtgcaaggacgacgacgacgacgaccgccgcgaacggtcggcggcgggagggccgcgacgaggagaaaggcggcggcggtggcggtggtcctccggcacagaagaagcaaaaggggtcgtcgtcgtcgtcgtcgtctccgccggcgttggcggcggcggtgggggacggcgatggtgcggcgaagatgtcgcacatcacggtggagcgcaaccggaggaagcagatgaacgagcacctcgccgtcctgcgctcgctcatgccatgcttctacgtcaagagggtaattaatccattcattctaattactagcttagcttagctcgcactaagcatagtttagtgtcactgtgtgtgttgcactactagctaatgaagctagaatggctcatgggattttgatactatgtatctatagctgtagcatctagagtaacttttttttccctgatcgtgtacgtgctgctgcaacagttgcatgattgtgtcccatgtacatggtacaggaccagcaatcaaccgttgatgctgctggtgctgcatgcttgaactgccctagcttagctagctaccaccagcctaccaataattagtagtacaactactcttgcatcattagagaatctatctagtacacacagctaccaatccatacgagagagagagagagatgaagacacagtggcttgcatcaattatctcagagaatgtatagtacagtgaatcattggttgaacaaattaatggagattaatcacttgaatagatcagtgcaattaatttaaatctgatttgtgtgtattattaattgtgggtgcagggagatcaggcgtcaatcataggaggggtggtggattacatcaaggagcttcagcaagtgcttcgctcgctggaggccaagaagaatcggaaggcctatgccgaccaggtgctcagcccgcggacgtcgcc

SEQ ID NO: 44106 - DNA, 2751 bp, Oryza sativa
  unsure (1)..(2751): unsure at all n locations
gtacaacaagcatgccgccgccgccgccaccgctcgcccgccgcacccggcgaccacgacgtcgtcgtgctcggtggcgtacagcatgtcgccggccatgacgcccacgtcgtcctcgtcgacgacgacgacgacgacgcacgagctctcgccggcgccggcgttcctgcccatcctcgacagcctcgtcaccgagctcgccgcccgcggcggcgccagctgcaggccactggtcatcccctcctccgccgccgccatcgccggcatcgtcggcgtccccgacgtgagggtggagttcgccgggccgaacctggtgctgaagacggtgtcgcaccgcgcgccgggtcaggcgctcaagatcatcgccgctctggagagcctctcgctcgagatcctgcacgtcagcatctgcaccgtcgacgacgccaccgtcctctccttcaccatcaaggtaaaatactaatctactgtatattttattactcatcagattcatggagatcaatctctgcatcgtccataacatgctacactaaatcgatctcgaaaaacactcaaaacacatgcgatattatattacacgagacatgcacgcacacgagtttaatatataatcaatgtacacattaagcaagtgcactgatcagtgatatgatatcgatcgatttatttgaacagtaattggtaggatgtgttcatttcatgtgaccaagagtactacagtgctacagagccacacactgaaactgaaactaagcatgcgtatacgcaggattgcattaattaagccccaaatcaaccttcaactgttcatgtcctgcatggattctccttctttggcccataattccctctcatagatatatataaatctctacggttgtctctgcatgtttaaaacttcttccattattcgatgggtttcataaatgcaggcatacgtatctgcatgctgtataggctaagtttgtgttcagacatttctaatgtagagctcagatacacagtgagtgtgtacgtacatacagggatttataacacaggcctgatgcatgagtatttattggaaatggcacttctgtgtatatatacattatctttgaaagagctcgagaaactgccagagccagagcgggtataagtaattaatatgaacacataaatatatattcggggataaatgtcactactggtgcgaaactatgcatgagcagtcgagcaaagcacgagctgggaagaatatgcgtgtacacaatagtaaaagctacagctttggtagctgtagaacgttgagtgattaaggtcctctttgtttaggattataagccaacttataagccaaaaagtctaagcctaaacaaataagcagctttttcgtttggcttttttgaagccatcagccactcttacactattaagtcaaaagctaggttggagaagattttttggtttatatgagatagatgtatgactccaccactaaacttaggacattaaataagcagacttaaaaatctaagccaataagccaaagcctaaataaagagggcctaaacctgcttgcaagttgcatgcacacacacacacacacacacacacacacacacacacacacacacacacacacacacacacatatatatatatatatatatatatatatatatatatatatatcgacgatataatgcttgtttagctagctagctgttaattctgttttactatatgatatgtgtatgcatggtaatcaagcacacagatcgacacagtagaatttaatttgcttgtatattaatatacatatatttggatgcagtgttaattaagctggctagtgaactgacaatggattcgttgatttggtttgtgtttgttcatacagattgggatcgagtgcgagctgagtgcagaggagctggtgcaagaaattcagcaaactttcttgtgacgtgtaacatacagtgtcagtgcagtgactggctagctagctaagctagctggagtacgtagccgcgtgcataactatacgtgcatgtacacgcgtgcgtaacgtacgtgctagcttagctagctagtagctaattgcgtttggcttaattagtttgcactttaatttcatgggccaatctagctagctatctctatccagcgatcgattgagagagtacgtactgtgtgtgagagagagagagagagagagagagaagggctagctagtagattagatagcttggagttgcagagttgcagcaatgcattggagctatatatatgcaatgcaagctgcatccatgcatgctgatcgagaggttaacgacctacctactagctagagatcgagagatagctatctactagcgggaccatgcatatgcatggatgatctgtttctgtctctgtagctagacacgaacgatttgttatatatatatcttgatctgcttaatttcttgcattaagtgtttatgtgcatgatgtataatttaataactccattcgcgtgtgcgagatcaatcagttttagtagtatttttgtgtagggattttgccgatcccagcaactatctgcgaaagtgggatcgaaatattaatcacgcaatggattagacatggattcgactgatcatcacgagttttacgtatatacaggtcccgaccacaccatatccttactgcagtactccctctatttttttaatatatacgatatnnnnnnnnnnnnnnnnnnnnnnnnnnnnnnnnnnnnnn

SEQ ID NO: 44107 - DNA, 12325 bp, Oryza sativa
aagccatctgcctcatccccgttgtcctcatcgttgatggctgcattatcactgtcgtgtctttgtcattgttgcccgcgctcgccctccccggtctaattaagctcggaaactgtgacttttttagtgattgtgagtgtgacttagcaaattgtttttggttgattttgattcctaaatatgtttgaatggtgaatctttctcttaatgattgtgatttagtgaacttttgatggatatagtgatgtgaatccgctctgcagtgcttgctcagctcggtttgattccagtcgagccgagcgtttttttttttggactcgttcgcccctaaaggtgctagttcttggctaaaactggcaagtatatattattatatatatcgattctacaggcagcaccgatgaccgaagtgatcagtgccgcctgctgggtaccggttggaaaatttgacacctatgactggttcccaatcggcacaaaagacttttttgcactagtgttttgattctttagttttattcaaataaataattaggatttgtgcatctgcagaggtcggaaatgtaagtttttccattatctgaaaaaaccttctctctctctgcacacgctatgcgcgttttaattttacattctaaattgcattttttttctttgttgaattattagaacgtgggaatactcatcagcatggttgatcaatgacatactagtatattttttcattaagtaacataaacctgttgcaggtaagtggtataataataagtacttcctccgtttcacaatgtaagtccttctagcattttccatattcatattaatgttaatgaatctagatgaatatatatgaatgtggaaaatgatagaatgacttacattatgaaacggagggagtaaatatgaggtagaaaatgacttgtagccagaagatttgactgcacgtgctttacacaattacacattatatagattctataatgctagaaattaatatcaaagatgataagagaagaaaggagaaatgagagaatatatatatatatatcaatgatcacaaagctaaaaataatatagaggcggtgtgcaaaattgctagatgagatgatatgatgtgtataaccttatgacagaagagaaacaacgtgcactatagataaattaatactgaaagactaaaaataattaagatgtgtggttttttaatagaaaagagaattagtattaactactgctatcaagtgcaacagttgattgaaactgatcgaggtgctaaatgttttggccatatgcatgaatccgtattgttagaaagaaggatataagattagctcggtaacttctaataattgagacagctgtatgcagagttcatttatcataatatatataaatgtaatagatactactgtttcttttcaggttcactacgtttcacgtatagtttcgtagatcattttttaattattgtttgtgacgctctgaattctaattactgtggacctgaacataatgcatgcatggtagcagatcggctagactaatctaatgttagtttcaaaaatccaatgcgactggacacctaaaaacttccaacgcaaaatgctttaggcctcatttcgatgggccacaaatcgtgtccaggccagaattttgttatttctggtccatgggcaggaaacatggccatcgaatatatgggctgtcatttaagtatttttctagcccatacacttggatgggctagagttgtggcccatccgtataggcccaattaggctgtgttgatcactgcgtggccctggtgtttaggcccattgaaagagatgcaccagagtcccgatagcatgaaaagttaaggtacacgtcagcgttataaaaaaattgccagaaaagatgatacaactttgtattgaaaattttgaaatccttgaaaaacatacttttgcttcacaactggactctatccagatcatgttttgtcatccatttgagctgatgatttacacgtcaagcatgtcaagtatagtacaggacatgaactctttttagtgctagtgatcccacatttacaggtgcaaaaagatgaaaaacaaaacgaaaaatcagaacgcatcaactggatacaccatacccaaagatgtacttaaaaaaaacttgccccccaatgagataatataaggatcggactaaatattgatacaacaaaacactcttccttttgatatcatataaacagctcgattccatctcctctaggcctggtaatatatatcttgtacagatatgccgtcgagatcaacgatgaactcggtcttcagcaacttatgcctatggtgccgatggtgaaggcgacgatggtggtttgaggtctggatactgcattgcaaattcacaaatgtaggtttgatgacaatggcattgattgcagcttatgttcatatggcaatggagcttgagaagctgtagctagcttacattcgggtaaggcgaaagaggtctcggagctgcaggtggcgccgcctctggggcggcttctgctactggtgctgagttaactgcaggtgcagattcggtcgctgcgctctcggattccgactcatttttagtcgcctcagccggtgccagtggcgaaggggaggatggtggtttgagatccggatactgcatagaatttgcaaattcagagtgatgaacactatgtcaaggaatgatttatcaggtgaaagagatgaatggcaatgagtatatatcaggtgtggacttacatttgtatatggtgaaagaggtgtcggctctgcaggagctgcctctgtactggtctcttctaccggtgctgccggtggtgcagcggtagctgtggcggcagctggagcagcttctgctgttgctggagcagcttctgtgattgctggttggctcttggtaccagtagaaggcagcagagcctgaccgatttcctgcagattgcaagagggtattaccattttacagaacaaaaccttgtaacgagtatttactatgtgaagaatgtgagttttctgagttcagaaaaaagggacagcagagtctggcaatgcaaactgcaaatcccatcaggaaaaccaggtaaatatattgaatgttacatccattttgcaccttatccatcttgctaatagtaccaatcacacaatactgtgaacagttggcaacagaggtcatgaggtccacataaatctgaagttctaactatgttttgattggtttgacaaaaatgcaaattcaaagaacttgatgtttagtacatttttggtcttgatgtttctacttacaagacttattagcggtgtacctgctaggaatgctactaaactaaatacaataggttcatgcatgcctaaactctccaggaatgaacttgatcctattaagaaatattagtcagtgagaaacaagaaactgaatattcagtaagatagatggctacctttatttcatcaacaagctcctttggagcaacctttttgttgaagaaatcatcgatctgtttaagggttctctttcggtcctgtaagcagcacaacagtaagagcttgtcatcgaaaaggaacgttgttcatatctctgaagttcattcagaagagtaggcacctcagcatatatgagtttgcttgcaactagctggacaatggcagctgaccccaaaaactgaagcacagtctctatctacagcatagatattacatgatcggtaagaacacagaagcaactccacaaaacataaaaaaaaaaaacttccaagctgatcaacctctgtgtaggcaagtattcccaaaccagtagctgcagcaagcccaagtgtgacaggcaaaccatctgtgccatcctggtatttttgcacgtcataatcagaattcgacaacatatatacaaattcgaatcgacaagagagttgcatcgagaccttagaatacaaagaaattaaatcaaacatagttgacacatcctcaaaaggtcatattgataatgataactcaccccgattagatcgctcaagctgaatcccttcttgggagctgtccagggaagactactgctctgcagttgaacactagccaatggtgacatttttgttgagcgaatgtaaatgtcagctcacagcgagaaaccgagaacaaagctgtgcaaagagttaaataccagccatcctcggcgtccctctgcaccatccttcactgcaaaagcagctttgtaaccattcgctgttacaagctcagcaaccagctcggagttcccatcaaacctggtttgcataatatccaagctaaataaatgttcaggaggagaaaataaacaaattgaatcatgtacacttgatggtataattatttgaagtctgacagttgttcacagatttcttgtgatattgttcaatcttcttcttcagaaagaaaaaaatgtagccaactctgaacattgctattgtgttccatttgcagcaaaaataaaagaaaatttttgtttctttttccctgaaatgaactcggaccatacagaattgatgaacaagagagattattaagaatataaccacattgcaattagcagcaaagatttgaggtgcccacttgtcaaggatgaccaatgtggtgttctcggggtccttgaacctcagcgacagcttcttgaggaatccgttcttgtcctccccgtcgtagggcacggcggccgccttcttcttggcctcgcggaggtcgggcgcgccgctctgccgggcgtcgccgggcggcctgatgtccaccagctgcgcgccgggctcctccaccagcgcccggtacgcggcggccgccgacaccacgccgtacggcttcgacgccccgcccagcacctgcgcgagcaccagcggcagcgccaccgcggcgacccccgccgccgccgccagcgggttctgcgccacgaagtcgagcaccccgccgaggccgaggtccgggagcgcgaactccccgcctccgcctccgcctccgccgccgccggagtccgtcgagagacgcagcgtctcctcgtaggacagcggcgcggcgagcgcggcgctggcgccgccattggcgaggccgagcgcggcgccgaggatgtcacgggctcttagccgccgcctccggccgccgggagcgcgcgcgcgggcgcgaggcggggcggtcagcggcgtgggcgcggcggaggagaggatggtggtggtggcggccatggcataacggtgcggccaccgacggcgagcggtgtcgcgaggagaaggtggcggcaaagcttgtggcgcgggaagccggtggtggggcggcggagatgaggaaggggggtgagctgggaggtggcagcgaatcggaggccgccacgtggacaaggagatcagacgtcgcaagcgaacggctgaaattctacggctttttttgttttcttctcttttccgcggtacaaactgtgtagtgtagtgtagtacgcgatggcaacggcgcggcgcgtacgtcgtcagtacggcggcgcgccggcgtgtagtacgtgtacttccgccgccggtggtgcgccgccgcccgccggcaatgcggccacgtacggcatttgctgggctgagccagtatttctaggcctcattcgggaggaataagttcactttaggtccctctatttgttggttagtctgataaaattacttacgtggcaattttatcagaaaaaataataaaaatcatgggacccatatatcagctacacaaaaaataattaaaaaaaagtgtggcccatgtgatctcacatgtcagcctccctcttatctctgtctccctttctcttccctttcatctgcgctcctaccatgccgtcactcacatccaccatcgatattgacttcgcccagcgtactgccaccttttgtctactgcgcctaccacgccgttgtccactacctctgtgtcatccccaatgcgcccgggttgtcgtatttccgtgccagccctttggtggctacgagctaggccctagcgaagctggttgtttctgttgccgtctggtgagagaggggaaagagagaggaggagagggggaggtgatgaagaagatgatatcagaacaacatatgggtcccatctactgactcaactagtcaaccgcggtcaatatatcacgttaaaaaccacacaaaagtttatttgtacaatatttagagatgggggatgttatatactccctcattccctaaatgtttgacaccgttggcttttttaaacatgtttgaccgtttattttattcaaaaacttttgtgatatgtgtaaaactatatgtatacataaaagtatatttaacaataaatcaaatgatagaaaaagaattaacaattacttaaatttttttgaataaaacgaacggtcaaacatttttaaaaaagttaacggcgtcaaacattttgggatggaggtaaagtagacttatttcatgctacggtgatttaatcttgagcgaggtaaagtagacttatttcaccaaattcaaatcgtttcgaaatttgcgactccgatgaaatattcgaaagcgaagccacgtggtttgaccggcgtcgcgaagcccagccacgccacgccacagtctttccagaagagctcacagctcacccagtctcgcagagtcgcagtgtcctcctctctacgtgccgacgcatgcacgccgccacgtcgcgcgccatggccacccctgctctccgacctgaacctacccgtttcgtcggcgagcacgcgcgccgcgctcttcttcttccccgctctcgcctcctccatcccatcgcgccacgcgagctcgatcgatcgaggtgtgtacacaaggtgttcgacaatggtgaagctggcgacggcgagggagtgccgggcgtacggcttgggcggcggggggcgggcggcgcgggggaggtgggagtacatcaacgccggggcgtacgtcttcgcggcggtgctcctagccggcggcttcgggtggcacctctccgcgtggtccgccaccaccaggtccggcctcgccgcggcggcgctcgggctcctcctcctcctcgcggtgaacgcgcacgacctcctggcgcacgccgccggcgtcgactacagcctcgcactcgccgccgggctcgacagccagttcgctctcgtcgaggtcgccgtccccgccgtccacttcgctggcaccgtgctcaccctcattgcgctcatcttcttcgagattcaggtttcgattaattactttacttcccctctgctttttatttttaagagtgttgctaatagtatagtgctttattcagtagtgatgataaacgttttctggttttcaaagggcaaagttgtggtgaaaacatctcaaaaaaataaatctgtagtgaaaacatttaaaaaacaaaatagtagtgacagagtgtactaactagaagcagcaatacaaatttctcctgtcccataaggtctgtattaattagtctctctgattttaattaagagtgctgctaactagctataacagtctagtgctttattacgtagtggtgacaacatttctaatttcataaggcaaagttgtagtgaaaacatttcaaaaatataatctatactaaaaatattaaaaaaacaaaatggcagtaacaaagtatactaactataagtactccctccgtttcacaatgtaacttattctagcattttccacattcatattgatgttaatgaatctacacatatatatttatttagattcattaatatcaatatgaatgtaagaaatgatagaatgacttacattgtgaaacggaggaagtagcgcacatatttctcctgtcacagcacgaactttggagaaaatgaactaagtcgtgaatcttatagacctgtttgtaaaagaggattttttttttaaagatttctccgcgtgttgatttgtttttctttttgataagtaaatgagtaccgactagtgagaccagatggatatgcaaattaattcctatttacttccgttaaaatgtcaggaactagccagctagctagcataaacgttccaaaattcagtatcgctggtacgattttgagtgtcagttaattccacttatcttaaattgaaaagtttactagtgtaaagtccagaacaataaagatcaattcagaaattcttgctaccatcatattttgtcaagagttcagtaacttagaacacagaagaccaatgatggcacaagtgtcacttaactagcacaactcaattttccattacagatggcaagagggtacaggcacagcctagagaagcacggcctgaacatgctcatcgccgggccggcgctgtggttactcggatccatacaaaacatctgccaggtatacgaacgcgccaacgggcatgtccagatcctccagaaatgtgtccaaacgccgctgctgctagggagcacgctgttcttgatcggcggcatcatcaaccgccacgacatccacagccaatcgacatcccgttcagagctactggtaatttgcacaaacctctgaatgtctgaaagttgcaatgagaacacgacatatgcatgaagccgatcagtgtggatatatatgctactgtacctactcttgagtaataattgtcactctgctctgggatgcaggggaggagctggggatggttctgcgtctccggcagcctgctgttcgtcgcggcggggctgctgaacctcctcaaggtgttcaagatgcagcagatggacgggcggggactggagaagctgcgcggcggcgcgcaggagcggctgaacagggagagggagggcaaggtgcccctcattcttgaggaaggccagaggaggaccccggctccggtgtcgggccaggtcccgccgcctccggctgggtcctacaaggaggccgtcgtcagcggcgcgccggctggctagctagctagcttagcagctgcactgcactgcacacagtgtaacgatgagaataagggaggtgacaaaacaaggtgccatgcattactgccattgccacactgtaatttcgtatttgcagctgtcacgtactgtagactgtctgaaacttagatgtgtgcctgtgaatttatggtcgatatattacatggtgtaataagctttttgctctcctgcatatatttgccaaataaaatcagcatcatcagcctatatatgcaatgaaggttttcactgtctgttgtgttcttgcaaaatggatggagtaagttgtgaaaaccaaaccagccgaacataacaattctggtcaggtctgtcacgtaaatttctgaatccatccacctgtcaaggttcaaattaatcaaatatttgtgtgttctcattggactagaggactacttaatttcattgcctgaattgcaaaattctgaatccaggttctgaccagaaactctgcaggtcttgtgtagaatctcagaatggttctaatgtagcctatcatttttccagaccattgctacggaaaaatcagaagaaggaactatgccatttctttgttataaaaaaaagttcatttttcttcccaacaatttatcagagcacttacccgtcgttttacaccccgaactcggttcaccttactccctaagatatttctctcttttttatgtatcagtcgtattttggactgaagtttgatagaatcaatagctgtatcataacataccttgatatttttaaaatgtttatcactgtttatataaattaaaatcactaagactgatttaaaaaatcaaggttttaaatttaaataaatagttacgaaaataatttggaactttcatagtgatgtcatccatggctttaacaattttcaacttaaaatacgatttatataaagagaaacaaaatattattaagtattaaagtgaacgtctttaatattattttggaaaggtaaaatgaccatcatctcctatttaattggtggtttattgtcggatcgactcaattaaaggtatgtagtatgtacaaaaataaaatctaatatgggctctatgtattaatacatgtcactatactattatatcctattatatcctataatagtagaaattatatcctataatagtactataatagtagaaataacgggatcttttaattattagtgctctatttttttctattatcattctttcgttttctccactatcgtgcaacaaaaaattccgttaataagtgataagaatcgactataagccattgccatacgcaacaacaatgttaatttctgttttatttcctttctctcgtcaccaaatttacttgatgaaaactcgttattgaacaccattttgctcaattgtcatctgcatactatttttgaaactgaccaatcaggcaatatctttgtgattgagatgaagggatatgctaagatgtccaggggaattgtccaaatgctaagattgaggcaaaaggttacatttgggatgtctttatctcatccaattaatccacggataccatgaaattaaatgcttggaattaacgccttctatatatttcagtgaacaaatcttcagatatagaactcccattttgccgaacattaattaccaaggtacaaaaccgaatcgcccctataaattaagagggatcagtcgcacctcgccgagccaacattcagatcatcaaccacaagttcagaaaataaatcagtcagtagctcatccggttgccattgccaatatagttcttgcgagtaatcagttcagtttaagccgctactagtacaaaacaatggcacgggcaggaagcgtctgcgtcgccgttctgctggccgtctgctgcgccgagacgatcctcgtcgccggcgcgacggagtggcacgtcggcgacgacaagggctggaccttcggcgtcgccggctgggagaacggcaaggccttcaaggtcggcgatgtgctcggtgagtagcaatatgtgtatcaacttttacagtacaaattaaaccacagtaataattaactaattacgttgtgatgatcgatgagaagtgttcaagtacagcccgatgatgcacaacgtgctgcaggtggaccatgccgggtacgacggctgcaaggtcggcgccggcgacaagaagtacgcctccggcaacgacaggatcaccctcgccgccggcaaggtcttcttcatctgcggcttccccgggcactgcgccaacggcatgaagatcgccgtggccaccaaatagatgttgtttgttgtgttgatccatttatcaatgcatgtgatcaaaataatgtgctccccgtttgtcttttatttagtttttgggataaaaaactaatatttatactcgtagagcatttgaattgtttgttcacgcacaaaaaaaattcagtttcatcgtcctgttatcgataataatttcacatcaacaattgatgcatttgtaattggttttgacgattgtctctagatatgtcaattggatcccaatttttcattgggctttctcctattagagaacagggatggttagaattgatttcccacatgggatcgatgggaggaatcctgttcctgtcgggttttgcagggaggggagagattccttgtgagacccgaatatatatgggtctaaatttaaagtttttgtgctcgtgacatttgattatgtactacaatgttatgtttttatcatatgaattaatggcatctattatatacttaaaaatctatatctataactaatataaatattcatatttttccggtcgtcacatctaattttcggcctttttcgttcgtacacaatctgatttggttagcaatagggatagaaaaaaatgcaaaaaaaaaaggaaaaaaaatatcgacggccggcgacgccaccaccgccgaccaccgccgccggagggagaagagaggcggcggctcccagcggcggcggcgaccgcgggcggatccggcagcagcggctctacccgcggacgccgtagacgccgtcgtcgccgtcgacgctgccgtagggacggccgtcgccgagggagcacggaccccgatgatgtcgccgccgctcccgccgtcgcccgcgccgtgccggtgagacgggagggagaggggagagggagcggtgggaagcggcaccggtggggagaggcggagggggagaggcggcgtctggggtgggggaggcggccggctcggctaggggggagggtgccgccggaggggagcgggaaaggcggcgtcgggggcgggggaggcggccggctcggctgtgggggaggggaagcggccccggagggagagggggagggggagaggct

SEQ ID NO: 44108 - DNA, 2727 bp, Oryza sativa
  unsure (1)..(2727): unsure at all n locations
nnnnnnnnnnnnnnnnnnnnnnnnnnnnnnnnnnnnnnnnnnnnnnnnnnnnnnnaaaaatacctaaatatttcagaaaatttgtatttcatttaattaaatacctaaatatgttttaattcaattttatcttttttatctttacccgtagcgaagaacgggcattttgctatccattaaaacatcatgtggcatctaaaccgttacatggctctctaataaattagtgaaatctattatataataaagtccattaatctttttagaaatacttttaaaccgtcatggggcaacctacaaatgctcgtaaaccatcacatgacactctaataaattagagaaaatcctagaaattataagaaaaaaagcaaaatatctagccatctgttctaccttaaattgattttatggacctgttattttcaacctttagatcttgagatgatctcaaatatatgtctaaaaaaatctcctttatctcggcatgcgtacttcccctcctcccttaacatacgtgcatgtccatgtgcaaaagttgcgttttgggttagcagaatgaaagaaagggactgtggatgtgaattgttgatcttcgatcaaacggctgtggcactttcaagtgatttagctgaatgtcagcacaggaaaattgatattaactacactaagtggggatgaagtgtataggtttatattcaccgtgctctgctttccccacctcatccgtactcccgctctcgcatcttcccgcgccaccagaccgagtagacttcatggttggcattcaagaaaccatcgccctgcctccacatcgatcatgctcagccgagccgagccgagccccttccttcccctcactgaattcacctcctactgggggtctccatcaccggaaagcgtcgttcaattcggaaggttcgcttgttgaaccatatttgttcactcaatcttttggtcttgatttcttctttcattcacgctctattgatgcaggttgatccgttcctgttgtccctcagattatttaagcattaaaaaatagagagagagagagagagagagagagagagagatttggttttggcaattcttcaggtttctactatccctattcaacaggattcaaactttattcagcctgctgtacactttgttaaaggatccaattcattcgtggtattagatcaggactctaaacatcactggtgggtataccaattttacatcattgctgcacctataatttgttttatttctgaattccgattgcagaacgctgtagtagtagtagcagtgctgctactaaaacaaattataaccgtcagggatgtaacaatccatttactttatgtccaaaaacttacgtcttttgaaatgtgctcaattgaaaagacaaactaaataagctaatttttcatatttataagtggactaaaatatattctacatcctcgtttaatcgactttataagttgttttatataaactttttagtatatcacaaattcatttactttctgtgcactttaatgccattaaaaacacgaagttgtctctgctgattgatttgttggtcttacagccgtgccaagccgccgctaccggccgggaaggggggtgcaagcgacctttgcttgacgccggccttgcattgcctcgtcgccaacaactcgtgggcctctccgccgctggtgtcctgtcccgtgctagctgtctccctttactggacgatcgcctcgcctcatcgcccgccaccccgacctctccaccggccatctccgcaggttgctccacccccaacgctctctattcgcagcgccatccaccggcttgcttgtttaggaaagaagtttggtcccggggggcaaatctatcattttacgaaaattctctctccaaaaatagcaggaaatcattaaataacgcgtatggtgtctatcagcaaactaccacattttgttgagtgtcccaagaaaattcaatcgagttcttacagtgctcccaacaaatgtttttttaagtatcttgtagcaaattttaccagaaaattatgtatatgttgttttaagcatagacaagaaccctaaggcgattaattccccggggcaaggatgggaacaacgttctcccccattgtatttgccggtaataggtacagggatttttttttttgacttgtgagaacgtagatgagaatacatttccatgcgggggcattccccgttgacattcctaattgtatctactggttgtcgacccgtgcacccatatgagcaacatatatttcaatataatatagttttagtaatttcaaatataatgtaggtatctcacaatttccattttttcctctagtatatttcttcaaacaagaatgcctgctttgttcaaatagtttttgtgatcaattttttttagacattgcctcaaaagtgtgtgtatatatatatgatggttttattattattttcttgcttgatcatattcgtgcatagttgaaaaccggtcattgttcaattcagtgagaaaattccctataacgtgcttctaaattttcactctatcccttctctacaccatgagattcggccactctaatattttctttaataactgaaaattattattcagtgaaaacggggcagtatatatagttattttggaaaaaaaaattagtcagttgacagtcaactagcggaataagtgggtagggcatcaatatacaaa

SEQ ID NO: 44109 - DNA, 15251 bp, Oryza sativa
atgaacgtgcaagttaatttgatcctgtattcacaaaaaataaagcaaagaattcgtagttaaatctataaatgatagccgatcggttaggtccgatgacatatcattaacctttgagccgatgtcatatataaacggatcggcggttataaatagacagtgaggaactaaatctattcgatcggctgtagatattaaagacatatagttcttatattaatatatacttaaatcaagtgattgggatagatcggtcatcggtcaccatgccgagacagtataaatcacttagatcgaaatatatattaataacaggattatatatgtttatagcatagccgatcagatagatctagcatgtatcggctaatactccgatactactctatataaagatatcaaaacaagtataatataccaaacaaaagcttaatatacttaaatgcaataatttcttgacataaagggcggatttaacatgtcactgaagcatatagatcgaatatggttaaattagataagatcggctgaaactccgatactaccctaatcggcaaccagaggacaggctagagatcgatattctaagcacgacttaatagatcaaactcaactgatgcagcattaagtatgaaaagaagaacaatatctagacaatcaagccgttggatgtttcataaagtggtagatatcttatataatctaggacaacgtcgctatttaacctaatcggctgccttctattagcagatgttagccgattgtaggttagatgacgatattgccaaagattatgtaagatatatgataactcgatgaattatatagacaagattagagtgtcataaagatggaagcagtaatctcgagaacacaagtcatcataacaagttttacctcttgttgaagatcgaaaccgatgcagctcaacccgaaagcaagaactcgtcgaaacaaaactaaagcaaaaaggtggcgatgcgccgaaattgtattgaacgtgtgtgttaaaaattacatagggctcggggtctatttatacccgagaattacaagatatgtccataccggacacgaccactatctctaacaaacactaagataccataagtctttgcggtagacttttgcccaaacatatctctaaggaagttacataaaatatcctaattaatagatacaattgccttctcaggactctatccatgtgccgataaaatagaatgtgactctagagaaagcttgcagcagaagtttgggtggttccggcaagggtgctgcctagacggcgtcaccagggagagaagcgacgaaagaatcgccactgctgtccattgaggtctcaagaaccttgactaggctttcgcccggcagccctactagagggggcgagacggcacgacaacaccctcaggagggggaatgacgctcaagcgccatcgttgccagcccggccacagccgggctgggttttcacccccccatccaccgcctgcttatccactattgatgcaccgatgctccaccgccttctgaacctctgccagcgcatgggcaccactacaacggtgccgcccgccaggtagcctccgcatgccaccggtgatcgcaccattcgctgcgccgttgcgcgggcagctacagtaccgcaatggcacactcctctcgaaccagtgccaccgccgatcaagcctcctcacgccacggccaaccccgtcgccgctgcccgcgcctcaccgacatacacaaccactagtcgtgttgagcctccacgcctcctcacgtcgtgggaccctcaccggtcaccgcagtcgtgcctccgcctccgctggcagccacaccggctcctccagccgctgttgccgccggccagccacctgctatcgtcgctgtcgccaccgtcaccacgagctccgtgccgctgttgccgccgcgacgtgctctcccgccgcgagttcaccctgttgtcgccgacgccatcgccgcgagtttgccccacaccagatctgcctttgggggggcgcagatccgcctccggcgcggctagatccggcccgctgttgccatccccgccgccatcggtccccaccactcggcgtagctcgccatcctcatcgccgtcgccttccccaccgtcagccgccaccccgccagatccggccagagcgtagcggatctggcgatcaccaccgccgccgccctcggtggcttcctaggtcacccgagcgtggccccgctggcgagaggcgagctccgccggcgccgtccttgcggctgcattgctttgctggcggcagcaaagcggaggagggaggtggggaagagggggtggccggagctcgtaatacaaggtttgtaaatactagtacgatacacaatcacgattcaattccttatttagagccataaaaattgcaaggaggaagaacactgaccccatttgatgccttaaccatgtcattcctagagagaaccctgacgtaagtctgcaaatggggcgggttgcggtagcccgccccacgtccgcatcgcccacaagaaatctggcgggtcacctacatcctgttgctctacccaatggatttgtttggtgggttttgctgacccgccaaccaacccactagacataaaatacgtacaacacactattgcactgcacacacataacatatatacttttccattctagcgcaacatggtagtgaatgaaaattctcaacaaagttgaaatagcaaagaagattaaagttccttgaaatttacactttaacagaataaggataactgaagtgctatcaaatggcattatgacatgcaaattagaaatgactaattcacatccaactcaaaatacatatgacatgctcccatcctactaagaaattgttcaaaatacatatgacaatctcagtcaaggctaacactataaattctagcatcaaatatcatgagaacatggacactaatgacagctcccaaggtgaagaaggtctcgaaattctgcaagctgaaaacagaacaactcccaaggtgttgacggctgttaaataccaaattaacgccgtcaatacctgtataaaaccataaaagtaaaacatcccacatagtggaaggatttatttctaaccatttccatgagtgttggtgtatattcgtatgcaggtaatcaaccaccaaagttgggagagaatgagcatgaagaatgcaaatatattttgcactgatgaacccacatggttttgagctataacatataaaatgtgcaatcattttgaacgaaaatatggtgtaccataaagtggggcccacatgtcagcatcttgaagaaggatgtgggctagggaagccgcctagggttcagccgaacccctagctggcccaatccagcctaactttggcaaggcagttactaccgacctcccaatgatggttgtgcctgtttctatcgatgtaaaccgtcataaagaggacacttgtcaagaggagagtgaagattccatttagatgcttagcatctccacattcccaaggcatctctccacctataaatacccctctctccctcattctcacacacaccaaagcatgagttgaattacaagaggctattgtactttgttgtatattagattagggagagagtagagtagaggaagtcggaggaatttcggagttgtcagcaatcctcttcttatttcttttactctgttaattactctgctttaatcgaatatcattctaagtaattaagatttattccgtgagagttactcttagttagtttctaatcaacgtatgggatcattgttcactatagtccactaaaatataataattgcttattttatcaattccaccacttaatgcatcaagcccatcttgaactataagattgattatatgtgcaccatagcgaaaatgaaagagatcacctttacatggtagcatattattctcaacaaaattttgttgcaaactactcacaaaactatcgtttaccgaaacattatccaatgaaatagaaaacaacttctgttcaatatgtcaatctttaatacccttaagtattgactcaacatagttttgctgtcgtggggcgcctcaaccaaactgaacttaattatccttttattcaagtttcacttttcatctatgaaattacaagtaatgcacaaataacccagcttttgatttgatgtccatatatcagccgtgggagaaactcttgaatttaagccattcaaaacctttagtaaggctacctttcgtttcttatatttcttaacacaataagcttttattgtggttcacggatttaggcttgacgcaaaacttctaaacttgggtagctgaaggacaactcatagcagacaattaattccacaagtaatttctgagaccattgttgatcaaatttccactttattacagcagcagcatctagcccatagcatgatttcagcttagaataaatctggtgaagcctatattcaccctcacaatttgccaaatgcctaaagcaactattagtaacaaccccaccccacgtgtagctttaaacattttaccacaatgagaacaccgagcttccgccagcgcatcaccatcatatattggatcaaaatcatttcatatagttgatgttaatttgtgtttttagttatagatgataaacctaattatttgaattaagcatacattaaaacacatgatcgaacaaagcggtcaattaaattatatgcatcaattgcatgaataaatagcagtagaattacatgaaaaaaaataagtaaagaaaaagatcatgtctttcggatcaaaatacttacattgtcaagtttaattgcttcctcttcaattgcttcctcaaaagatggagacggtgacatcacaatcctaatctccggagatctaacgatttatacaataggtgatttgagccgctttgttgccggagtctgttgcttttctatcgaggctttacgtttatatcccttaaggtacttgaggagagtatctcttttgaggcacaatgggcaacatctacaacagtaaaaggaatttttgtctgccatgaaataaattgtaagcataaactctgctaataacaaaaattcaaaccagcatatagggaacacttcaccttataaaagaaaaaagcaattggaacagtaacatctgttttggtaataagtttctgctaaattattgattcatcagcatgctatgttgagaaatggacagggtataagctatatagccaaaacagttacggttaaatttcagcatagcacattgtaatcatataggtacagcagacatgattattagtatattatcttacttcagacgttatcatgataaaaaggtaggcacgagatggaaccaaatcatgtccttcatccatcccccacatgtttgatgagaaaattccatctatagatttttttttcgcaagaatttggccactacatatccagtaagcatcatgtatgtttttttaccaagcattatgtatgtttttttaccatgatcaagtactaaattggcatgagttatttaacaaaggaaattcatatatttagtaataacaatagggggttgattctacagccataagcaaaaatcattgcatcgccaaaataaagattcaagaactcacctgcgtagaaaccaatggggatggagaagccaatctggtaggagccatagcaagcaggggtgatggaggaagtgagatgggcagcggagtgagcgtcacgacaggcaccagagtgggcgccacgaccggtgatggcgtcaccatggctggttgcggaggaggtcggccgagaggaagatgagcacggccatgagaggcatcaatggacggcgtgtcaacaacggcagtagtggctgaggactgccgttgaggaggcggctgctagggttgagccggcagcactctagatcttgtctagcgtgattcgatcccctcctcccctgcatgcgcgataagtgggttgtggcgccactgggccactgtgggcagtcgcattaactcacatatcttctattgggttgcacataagtgagttagtgggtaagtggggtgggctagcccagggggttagtggcaggcccaccccacttttagccttactctgacgcatctctctcatcatcgagtaggtcagattgctagctgcgcagcgaacaatgcgttgatgtccaccctggccaccagctcatttgcttagccactacaaaaccatcaaatccaaacaactcttcaagaagcagagcagcaagaaagtgggtgacggtaaccaacattgtcgatggtgacgatctgcatgcgatattgcgacttgaagtagaagtagacgtactcgatgtagctgagggagaagttatcgagccactcgccggagacgatgccctctaggtactcattgatagcccatgtgcaggttccccagcaccagggctgccaccacgctctgcagcacgttgagtaatgatggtagtcaactccaaccaatgaagccgccacgacactgagatccgtgttgaggccgatgtgggtgctcaagaaaagggcagaggtatcaggggcggtgtagaggcatctacaccgccggagagcggagagcaaatgcgtcgatgggtgcgcaggggagtagatcgaagcgatggcagcgtggtggaggtgacggcggagcaggaagagcaagagcagctgagtggattgggtgacagtgtgtgggggattgattggaggaaataaggtgcgatgtttgcgttggaggaagttgcggcatgcgccatgcgtgactgaggaatgatccggcgtctgcgtgatttcattgttggatcgcatctcacatcagggatttttatatctggaccattggataggatgatctaatggttagggagggcctgcataacattctatgtgcgttttcgtgggtgcatctagcaaaagagtgaactgcttcttttcatattagtatcaatgatacttgctcttagaaatagttggatatatctattccaataaatgtgcatccttcctccatttcaaatttttaagacaatagatgagactactgtcggtctctatattaacaagtggatatacacggatctattaatgctgcatatcccatcatttcaatgtgcatatctgatatctctccaacgtcactagtagtaaggtctaataaataaatatacaggctagctataaaaacagagccttcccctatagacacaaaacgatactagaaattagaaaaggaaagcagccaagtcgatcatcacatcacctgatcgttcttgtgagctcgggtgacaacgttaattaattcgtaagaaactgcggcaccggcagtagcatcaatggcacggggaagcgccgccgcgccggggctgctgctggcgctttgctgcgcggctgccgccatcgccgtcgtccacggcgaggattgggccgtcggcgacaacaagggatggtccttcggcgtcgccggctgggagaacggcaagcgaatccagcccggcgacgagcttggtgagatcgatgctcgatcgagcaacataatttatactttctcccttttgtattttgtattacaagtttgctttcacttttaagagaagtcgaacatttttaagtttgattaagtttatagaaatataatattttttaaatattatcaagatatatttaataaaactaatttagcgttgtagttggacaaacctaaatttgtcttaaaaaacaaaaacgacttaatccaatttgatcatgagtttgatatataaatacatatggatgtggatacgcagtgttcaagtatgacgcgaagattcacaacgtggtggaggtggaccgggccgggtacggcgggtgcacggtgaccgggccgtccaaggtgtacaactccggcgacgaccggatcaagctcgccggcggcgaggccttcttcatctgcagcatccgggaccactgcaccgcgggcatgaaggtcaaggtcgcggtcacggccaacgcgtaggtcgtacctagctagacttgcatgatgatagtctcgtctagattaagcagaatctattccgaccctcattgattatactctaataagtcaaaaccaaagctaaaaccaaaattgaattttcaacttaaatttgatgctgattttaacatacttttatcagtgtcctctagtgagctccaaatttaaaaactttaaaaacgaccgtaatgagcccaaaattttacttgggctgaactacgagagggaggtcgcaatgcggacatgggctgaaaattggactattatacgttggcccaactagcgcaaaattaaggaataagttcacccgaggtccctcaacttaacagcgagattttttgaggtcccttaaccacgaaaccagaaatgtgtacccctcaattatgtaaaaccgtccaaaaaaaagtccctaggcagtatagacgtccggtttcgctgacgtgacgtcctagttagcaaaaaaaataaaaaaataatatggcacccacgagtgagtgagaaggaaatagtaagggcccacttgtcagcatcatcctcttcctttctctttcttcttctcttttcccttttcttgccgcagaggggagagctgcagtagtcgccgcggcagcaaagcggccggagtggcggcggcggagagcggagtcggcggctgcgaagcaggcaggacggggcagcggcgggcgagcgtggctgcgagtgccgacggcggacaagcaggcaggtggagcgttggagagcggagcaggcgggaggcagcgacgggcgagcgcggctactagcggcgacggcgggcgagcaggcacgcggagcagcggagagcggagcctgcggcgggcggtggccgcagccacccgcatgccgtagctcgacccttccctgcccattatcccgctcgccgccgagccctctcccggcgctcccatcggtgcacgcgaccacaccgggacgctggggagcctgcagctgctgatgttgagcggcgtcggactgcgtgggcagctggagaagcacggcatcctcccgtgttggaccagcccatggacgggcagggcatggtggacaaccccatgaatccggttggctagctagctgcatgcagcgtgcaaactaattaatgggtgtttcataacgacgacgacggcgactggaggcagacggggcagctggggacggtgccgccgaaggagcggacgccggaggcgatgcgtcggctagacagacgcgcattctgtggcgggttccggaggcaggcgaagcggcggcggagcatcgacggcctgcccatctgcctgctcgtcgtcgagccctctcccggcgctcccatcggcgcacgcgtccaccccggccgctctcctccgcatcctctgccggtgtcgcgccgaggaggtgcgcggcgccgtggaggcggcgtggctggcgatagcgagtacgccgttcgcttgctaacccgccgtggctccggatggggagaggcgcgcgccggccgccgctcccgccgtcgcgggcggtcgcgccggccgcctctctccccttctctggcgccggccgcctcctctccccctctcctgcttcttccccgcgcgccgcagcgcccgctgcgttggcaaccgcgcccgctccgctgtcggccgccatcttcccgcctgcgcgtgagagctgagaagttgagaagagaagagaaaaagaaaaaaaaagagatgtggggcccacatcattttctctcactgacatgtggacccctacatatttattttaattatttttgctgactagaatgccacatcatcaaaaccagccatgtatactgtcttgggacccaaattagacggttttgtaaagttgaggggtgaagatttctggttttgtggttaagggacctcaaaaaatctcgctgttaagttaagggacctccggtaaacttattcccaaaattaaaaatcccgcgttgggccggctctcatgccggatcaacaggacatgacatggcttagcatatcaaggaataagtacactttgactcccttaaaagtgacccatatctaatccatgacactaaaccgcaaaatcagatatattgacctctaagctgttaaaattggtgcaatttaactttctcagtggttttagagaacggatttgctgacgtggcgtctacgtggcagtgttgacctagtctgctattgacgtggcgctagggtggcattacaattaaaaacatacatgtggggcccattcgtcattcacacaaaaggaaattttgtggggcccactgtgggtctatcccttctccctcctctctctctaccttatctctctctccctcttcggcatccgcccgggaggggggggggagggagggggcggaggcaccggcaacgccgggagagaggagcccgagatcgagggatgttgggaatcaaagcaactcacgcgaatacaagctacactttctgaacgaggcagcgaggaagaaacacaaacacagaagcaaacacacaggatctttgcggcaccaaaacaacttgtgcccttttcactggttttttctcttaactaaatgattacaatgagcacagcacatacacacacgaagctggttgttccgcttctcgagccacacacgacgcccacgtcctgtttacttggccgcaacttcacaagtactgagtcctcgccgacgtcgttgcttgcaccaaccaactaacctgcatgcatgcaaactgaccacttcctactcctaatcttgtgcaagactcggctaatcactagcccacaattatgcatggctaactaactaagctacatacatgtgctctcatctcctggctctttattggctcactactccctgccaaccactactcactaagccatgcagcacccacgtacatatagctagctcgccaggccatgcaatacacacatgcatatagataaacatgctgaaattaagaaacaacaagattaatttctaacaagggagccgtcggcgcgcgcgacatgtgggtctgtctctcccggcatgcggcgggaaccagcggcggcagaggcgggagtggcggcgatagccgtgagcttcgttggatgcctccataaatgacgacgacgacggggtctgccggcaacttctgcgacgaggcttcacccgatgagatggccccctccggcgaggacgacgagcttgatcgcatcctcccgcccgtcggtccctcccggactccgtagcgctctgcaccgcgcgtccccagctgtggcggcggcgcccctctacgtcgcggagctcgagctcctcatccgccgcgaacattactccgcctccatacactcctttcccaccacagcatctcgggcggggtcggcgggcggcaaacggcgtcgctactctgcgctactgccggggaaggaagcggttcgaccaatccatcctcctccgcacgctccgccgccactgccgccgaggaaggaagcccgccacgcgctcggcgatgagagaccggcccctccccgccaaggttcgaccagtccatcctcctcctcctccgcagctccggcgccgccccggcccctgcccgccgccgccggcggctgggtccctactcgttgtgttcctccaaaggggaggagaaagggggtgagaaagagagggatgaggggggagagagagagggaggacgaagaatgaagacggctgacttgtggggcccacatttatatttgtgtgatacaaatgggtcctgctcatttttttaaattataatacacataagtgccacgtcaactccacgtggaataaaaaccaagtcaacacctccacgtatgcatcacgtcagcgaaacggctctccaaaaccaccgaatgagtcaaattgcactagttttaatagttgaggggttgaaatatctgatattatggatcaggatacgaatcagattcgaccatattaattaactgcattcaacggttaactggtaattttgctcgttaggttcgtttctttttttcggttttgctaggccctatttaatccggcagtgttacgttcgtcaattcctgaatctgctttcgtaaaagctgttggcaataactaattaatcaagccatagccttagcttcaagcaactaatacatactatgcatgtgtcgaaatctagaaacaatggtcatgcagatatttggtaaatccgattggagatttttaaatagacttgaataaatgtattctctattttatattggtattattagctattgtttagttatttcctgttttttacgtgctctatattgagtgaaatatataataagtagatctaacttatttagtcgcaaaggctgagattcttttctttatcttaaaaaatagccttgcttggccggatttggattaattgaagtaaagcccagtcattaggattggtaccagcctttggctttggttaatcagttaaagtaaagtactttcattataggataagggccttccttggaccgaggctcactgtgaccgtgtcacatgcaaacacaaacctagcttagttaacttcggttagctaaacacaccttttgcaaacacgaccctcgatatctggatttgattatggtcgatctcaatattccttcgttaactgacgtcactgcatacgcaaaattgaagtccaaggggagcttgataagggcatggttggcacagctccagctccacctcttctagagttggagctcagccaaatagttttagctccaccaaaactgggagttgagctgggtggagctctcttacaaaataaactagagttatgaagctgggtttagtcagctccacaactccactccaaacccaactcctggagttaaatttaagagttggagctgtaccaaatagacccttagggtatagccaactacaccctccggattaataatacttatcgtttttaacaacggtacggtcttaaaaaataactttgaccgttattttttattataatatatatataaatgttaacaaatatataattttttgaagtattttttaagattaatatatgcatatagtcaccatatttcattgacaaatattttacaaattataaataaccaaagattttaaagtttgacatcacacttgtccaaaacgataagtattattagcccggagaaagtactataactgatttaatagccaattcatacaatagttacctataaacctatattgcactattaatacaaggtttcatatgtcatacaaacattgtgttttagtccgtgctatagctggctacaaatctgtagcccgcttctcttctctcctcttttatatactcaatatgtgtttatagcggcttacagtctgctattgtacctgctctgcacccatctatatatagactgatcgaccacccggttctttcaaactaagggggtgtttggatgggactaaaattgtttagtccatgtcacatcggatgtttgacgctaattagaagtattaaacataaattaatgacaaaacccattccataagcctggactaattcgcgagacgaatctattgagactaattaatccatgattaggctatgtgatgctacaataattcaataaacacgtgctaattatagattaattaggtttaaaaaattgtctcgtgaattagctctcatttatgtaattatttttgtaagtagtctatgtttaatactctattttatatataaacatctgatgtggtaggaactaactttagtaactgtatccaaacatccccctatgtagatgcgttttgtagagacccaagtatccaaccaaacttttgtactttagataaataaatctctagacgaggcccctgtgtgtagttattacacgttgaaaaaaaaacaaaagaatggagagtttgcatttgccagcgtttccttcacatagacgcagggatatgaaaatggtcaatcggaaaactgccaatcccatttccatttctttcatatattttattttgggaaacataagcataatggttaaggcggaaatgataatggtaccgctattgttgggatttcaaagatgaaggggatgtttagatcgagtggtgtcggatattatatatggtgtcgcatgaaatattcgaacactaataaaaaactaattacagaatccttcagtaaaccgcgaggggcactaataaaaaaactaattacaacgtttcttcagtaaaactatttttgaaatagcaagtcatgtactactacctccgtcccaaaataagtgtagccatagatatccgtgtttagcattttgaccgtccgtcttatttgaaaaatttatgaaaaaattaaaaagaattagccacacataaagtactactcatgttttatcatgtaatagcaataaaaatgctaattatatttttttttcaaataagacaaatggtcaaacgttagtgtggagattatggataccccatatctacatgacagttataatttagtcggatatacggtaccaaatatagatagaatatctctataaggactcgggttagattctaaacttgtatgtcaaagaaatacccgggatcttagtcggttacgattgtattttatctataatcctatattccgttaggatatggactgtattttgtaaagcggacctcttcccctatataaggaggggtctgtgtgcctctcggggtatgatcttttttccaatttatagaatcaataacacactcggcggaatcatccccggacaggagggtattacttcttgaataagaaggcctaaacctatataaaattccttgtctccaaacccatccactttcctagcttgatcgcctcccccttttattattgctgaaatcttgtttcgacagttggacatgaacagtgctaaaactgcacttattttgggacgaagggagtaatagagaatacgatgaatgtaggcgaagtgctgttagtgttaggatatgtcatgacctgattcctagtactgggcagtattataatacctccgttttttaatagatgacgccgttgactttttctcatatgtttgaccattcgtcttattcaaaaaatttacgtaattataatttattttgttatgagttgttttatgactcatagtactttaagtgttatttatatcttatacatttgcataaaatttttgaat

SEQ ID NO: 44110 - DNA, 6471 bp, Oryza sativa
atttctacgactttgctcttcacttcgtaatattcctcaacataataatatattactccctctagttttaaaattttaatatttaataccgttaattcttttatatatgtttgatggtttgttttattagcaaaaatacataattattattcatttgttttgtcattaaatagttttttcatatttgtaaaaataataataagataaattaatgatcaaatatatattgaaaagtcaataataccatataaaaaacctaaaaaaactcgaaagaatatacgaataattttacggacttatttaaacactactagaaaaaatgtttttttagcaacgttggccttttatttttccaggcgggtatgaccctcggagctaaatagccgcctagaaaaatgtaaatcggggtggagctcaccatccgcctgcgaaaatcattttttccaggcggaccacttaagaggtccgcctgcgaaaataaatcggaaccttatgtggtccgtctacaaaaatcacacctccaaaaaaaagggtcatccttatcctctcctccaccattcttatcctctcctctccaccactcatcccccctcctctctctctccttctccctcacacacttagcaaaaaaaatcctccaccggctcacctcatccctgcctccgctgccggctgccctcctccctgcctccgccgccggctccctcctcgacgacgacgacgaccgcgacgccgcctccgctcgccgtcggctcccctcggtcgtgagatgatgaccttcgcaacgccgtgaagcagcggatccaccagctcccctccccccgcctccgtcgtcagctgccctcctccccgtctccgccgccggctccctcctcgatgagacgccgcctcagtgagccgtcggctcccctcggccgcgacgatgatgaccttcgcggcgctgtgaagcggcggatctaccggctcccctcctccccgcctccgccgccggctgccctcctcgatgacgacgacgaccgcgacgccacctccgcgagccgtcggctcgcctcggccgcgacgacgacgacgacgttcgcggcaccatgaagcggcggatccaccggctcccctcctccctgcctccgccgccggttcccctcctcgccgtcggctccatctccgccaccggctccctcctcgcccccagcttcctccctctcgacgacgacggtgccaacgacgctaagacgaccacgacgtgacaacggcgccaccagcttcatcctcaacgacgacgaccacgacgcgacgacgatgacgatgcgacgacggcagcaacccctgtggggacggcagcagatggaggaggagagccgtcgtcagctagagggagagaccgacggcggtggtggggcgtcttttttttattcgctgaaatttgctttgcaggcgagtgaatctgccacctgcgaagatgccgtccgcctgcaaaaattgattttcgcaggcggacctcagatccgcctgcgaaaattatctattttcacagtcatttgcttataggcggaacaccggtccgcctgaaaagacggatttggcccgcctgcaaaaaccttttttctagaagtgaaatacacacacgggggctagttatcgaatattatctctcaacatatttttctatcatctattaacttattaaaggaacagaaaaatgagccttcacgttcgctctcacggcctagaaattaccatattaatcggagaaaaagaaaaacatagtccatatagaaatacaatttaaaaatagttaaaattcggaattaaaaaataaggaatagtggaagaggagactagagtccatatagaaataaaattaagaaataacagaaattcggaattaaaaataaggaatattagaagtagagtatagagtccatgtagaaatacaattaagaaataatagaaaatcagaattaaaaataaggaatatgagaagtagagtatagagtccatataggaatttaaaactaattaaaattcagaataaacataataaaattaaaagtagagtttagagttagtataaaatataatttacaaataactaaaattcgaaattgaaaaaaatgggaagaagagtataaagtcaatataggaatacaatttagaagtaactgaaattcaagattaaaaattgaatattgtaagatgaatttagagtctacatagaaatacaattagaaataataaaaattcattattaaaaataaataatattagaagaagagcctagagtctatatagaaatacattttttagaaaacaaaaattcagaataaaaaaaagaaatattgaaattcagataggaatataatttataaataactaaaatttgatattgaaaataattaataactaacacgtatataaaatacaatatgaatattacacatgagtagtttcgtaaagttagtacaaaattttaaattatgttgccattttaatatatttgaataatacatttagaaaacatatatgctattatatgagagaaaatataatgattctagccgcgcaatacgcgcggaccttttcctgaattattcggatgcatatggtacaacatattctacgtgagttacaagttgccaaaatgtcaaagtgcaacgtactatcctctaacccgtctgagtgtttaacttggaactcgtttgttaaaccaatcagatagtgccacgtcaaccatacagcccatcagtgggccccccacccgcggcctacaaagcaaatgcccccgccccccgcctcctctcgtcggtcaacgccgcgctcgatctctcgccgccatggcccgcctcgccgtcgccgccgcactcctcctcgtcgccctctgccgcgtcgtccacggcgaggccgatcaggagaccgcccccgcctacgccaaccgtgaagcctacgtcgagcacaatggtggtgacgccgccggcacgtccgtcgccatcgtcccgccctaccttgacgccgccgccgccggccgtgacgagcccgcggcggcggcggcgagccccgaggggcctgtgatcccggtcgacgacgacgcggcggaccagcagggcttcctccgcttcccctgccgctaccactggcgctaccgccaccacatgcgccacggcggccatcggcatggggagggattccatggcaaggaggagaagcagcagctggtgttcgagatgccagtcgagccggcgacccgcggcgaggagcgcagggaggaggaggagggggtggttctccccgtcgcggagccagatccggactcgcgccgccagtatgccgccgtagccgccgccgaggaggaagacgaggatgagatggcgaggctccaccacggccgccgctcccaccaccaccatcatcgccaccaccatcatcaccacgacgagaacgaggaggacgagcacgagcaggccgacgaggcttcgcccgccgtggagcggttgatcagcttccaccgccgccgccaccaccaccaccaccacgaagacgaccacgagcagcgcgaggagggtgcgcccatgaagcggttccgccaccaccacgaggaggaggaggagtccgagatgaggaccaagcgcttccaccaccaccaccacaaggacgacgacgagcgcgagctggaggagatggcgaggcggtggatcaggaaggcgctgatgagcagcaggatgcaccaccaccgcggctgccgcttccaccaccaccaccaccacctcagcttccgccaccgcgcggaggacgccgccgccgccggcgaggaggaggagaaaggcggggtgatgagttggctcaaggactttgtgaaccgcttctaggtctctcgatcgatcagcctagcttgccgctgcttcttcttctccatcgtctgcttgtgttgttgtgtcgagttcattcatgattcatatggctgctgtgtattctacttttctacggccgtatatgtatttcgtataccgtatttgtgttgtggtactctcgacttatcccgagtgttcatgttgttgtttgtgtcacggatgttaataaattgttctcctatttcaaatgcgtgcattaattaatcatgtttctatgtaacaaattaaatgttgctcgatcgctatataaaccatttcagttgtctgaaaaccgctacgatcaaaatcgcagagaggcaacaacaagattgcgtgcatgaatactcagctgaaaacagacgactgacaagctagcttgattctggcagtcaccaacaagatttcctgaaatcaggggcgttcttaacctgcttaattaaatttcatggacataactacacagcgaccggtctctggtttgcataaagcagcgatcactccgtcctatatttaaatctctttttagcttaaaaagtactatagtgcacgttttttacctctttaatcacttgtatcttttaaatcacatattatttttaagatctatttgcatcattatactccacttaaaatatatgacaaaacgagatccctgttgaataaattaaaacattttattaatttaaaagtaatttatttaaattatagaagtaacttagctatgtaatagaagtaactctatatagcattagaagtaattacgttatgagtgagttccagtaagaaacttatgtggagtaaattcaaaagtgtagagaagattttcatgtaaatacatttatgaaagtaaatttaataaagcctgaaagtaatttacataaatcataaaagtaacttagcataaaatgaaagtaagttattacagtaagttattacgatattagaagtaaatttatcgtaggaataaaaatataagtctatttagaaattaaatttaatcagcacaaattatggaattgagtaaaaaaaaataaaagtaatcaactcaaagcattatgaaattacgagaagtaatttaatcaaatctaaaagtaatttatatataagataaaagtaatttgcatatataataaaaagtaatttacaacataaatgttttttcatcataatattatcatgtaagatcttgatataaagatttaattgcaacgaatacaatggtgtaatcggattatagatcgaataagtaatttaagagaaaattttataagaagaaaaaaaaatgcacaacctaatagcataaactacttgcatgcatgtctgtaacgctactagtgcttctcacgtaattatccgtgtcgctcgttaattctaaatcgagatgcctctcgaaatagattttgtgatatttcatcttgactttgaagcgggcatatatgaactccccgcatactcttgacgatattccctatgttcaatcaccaaagcctccttttgattgaagaaaattacagacattttgggcttattcaatttgttgtcaaaatcaaccaaaccaaattttggtattgctgaattttagtaaagtaacaagctaaacaagatttttaccatcgcaactttcccaatttctaccaatattgggtaattctctacaaacttctattcacaaaactatataccaaaatttgataaggtgttaaattaaacaccaaaatttggtaattctctacaaacttctattcacaaaactatataccaaaatttgataaggtgttaaattaaacaccaaattttggctttaccaataaatgataagttgtcttttaacattgaactaaacaagcccttcattataattgaattcattcataaagtgctgattaaattagttgctgaatagcaaacccctctctcgtattctttctcttcggcagtagtgttagcctccatctttaggaggtccctttcgggtttgctctttgataacatcttcgttagcttataatgcttttttttcggttttaccatccttcatgggcttatgcgtaaattaactgtcatctcagcaaacattatcacacacacacaaaatttgaggtattatatagtctcactttatgcttttaaaaagaatgagttcatgtaaaattactgttaacttccgcgtttaaatggagcaccgacagcagaaggcgcgagcagtgattgtatcatccgtgatttcactggtggagaaaccatctttggtcggtccaccagttttcacaatagtcccggttatattaaaaaccgggactaaaaatatctttaatcccggtttaaaagctctaccaaccgggactaaagatctatttatagtcccgattggtaacaccaaccaggaaaaaagatcgatataagctttactcccagttggtgttaccaaccgggaataaagtcgacataagcgggatagttgcacgcggatcggatcaatacaatctcctcctctccttttttaactcatctcctcacagagtcacccttatctcttcctctccctcctcctttcctctcctcttctccctcctcctttcctctcctcctc

SEQ ID NO: 44111 - DNA, 802 bp, Oryza sativa
  unsure (1)..(802): unsure at all n locations
cctcctcgatgacgacgacgaccgcgacgccacctccgcgagccgtcggctcgcctcggccgcgacgacgacgacgacgttcgcggcaccatgaagcggcggatccaccggctcccctcctccctgcctccgccgccggttcccctcctcgccgtcggctccatctccgccaccggctccctcctcgcccccagcttcctccctctcgacgacgacggtgccaacgacgctaagacgaccacgacgtgacaacggcgccaccagcttcatcctcaacgacgacgaccacgacgcgacgacgatgacgatgcgacgacggcagcaacccctgtggggacggcagcagatggaggaggagagccgtcgtcagctagagggagagaccgacggcggtggtggggcgtcttttttttattcgctgaaatttgctttgcaggcgagtgaatctgccacctgcgaagatgccgtccgcctgcaaaaattgattttcgcaggcggacctcagatccgcctgcgaaaattatctattttcacagtcatttgcttataggcggaacaccggtccgcctgaaaagacggatttggcccgcctgcaaaaaccttttttctagaagtgaaatacacacacgggggctagttatcgaatattatctctcaacatatttttctatcatctattaacttattaaaggaacagaaaaatgagccttcacgttcgctctcacggcctagaaattaccatattaatcggagaannnnnnnnnnnnnnnnnnnnnnnnnnnnnnnnnnnnnnnnnnnnnnn

SEQ ID NO: 44112 - DNA, 1098 bp, Oryza sativa
  unsure (1)..(1098): unsure at all n locations
nnnnnnnnnnnnnnnnnnnnnnnnnnnnnnnnnnnnnnnnnnnnnnnnnnnnnnnnnnnntaggtatcgtttgacgggacttctaaaaattataaaaaataaaacccaacaagaaaataaactctaaaaactacaaagtccaatttctaaaggttcggaacttcttaaaaggtaaaaaaacaatgataattatgttcgattttaatatctcaatgacactaaagaagggagccagcgggcgagccataaaggagtacaatggcaaagccgctgacagtttggcgagacttctaaaaagtaaaaaaatgaacctgaacaataattatgttcgatttttaaaatcccaaacaataaagagaaaaagacagtggacggaccgtagaggaatattatggcagcgtttgacgggacttttacaaattataaaaacgaaacccaacgagacaataaactctaaaaactataagatccaattgtttaagatttaaaggataattaatagaaataatggtagattgagcgagcaaataaagaaggatatggcagaagtaaggggtagcagctggtgtgacttttaaaaactatataattagaaatacggagatgataaggtttggtctttcaaagtcttaagacaacaagatagctatttaataaattttaagcaaaatcatactgaaaatatatgattttgcttgggtgttagccgctcaattacgcggggcacctagctagttttcttttaataagacaaatggttaaatatgtgttcaaaaatcaacggctttatctattaaaaaacagagatagtatgatatatagtggaatttacaaagaatttaatttcgtggggtagtatatttacatgtgggccctagaataatataatcaaacggtgtgccatatgctgatatgtaattaatattagactggttttgttgtatatttttgtatggagaacaactttataagtggaacacgataagcagctaaaaaggtgtttagcatatatattttcaatagaaatttagtggggttgtagatttgccatcgatgtnnnnnnnnnnnnnnnnnnnnnnnnnnnnnnnnnnnnnnnnn

SEQ ID NO: 44113 - DNA, 769 bp, Oryza sativa
atgaaatgatttggattgaaatattatgaaaataatttgagaatgatgatttagcatgtgtatgtttaattttagaataaaataaaataaagtgtagatataattactgtaggcttgcatgttaagctttgtgtgcttaataggttgatgtggcatacttgtttgtaggttttaggagtgctaataaatactatgcttgcatgttaagatttaggtgtttagtgggcattagctttatagaaataagagagaaaagaaaccgtaattaaacggatcggatcagatcgaggtggccagacggacccggcccaataacagcccgtttgacctctcctcccatctgggcatttttggggcccactagtgagcagttcgtcccgttccgacgagcgggacccacccacccattcccgccggcgttcccacccaccgtcggcgtcgatggagggttccccggaggcggcggatcggctggatccgggcgccgtttccggctcgatccggccggtgacgagcttgccgaggaggatgaagacgagagattagggggatcgagatggatgccgagatccgatctatgctggcgctgcgcctgcgagatctgatcgcgagctaaccctatgggtacgaacgctgaatcatactatctgctagagtactaaaatttctggatattatatatatgatgcataagtagcaaggactaatagcaggtttaacaagtatctggggattagcttttgtaatcatcgccagggaaaaaggggtt

SEQ ID NO: 44114 - DNA, 713 bp, Oryza sativa
agttcatcagacagcattcctggagcttgacttccatctaacttgacatctaacttagaacttgcatccgctttgtcctttgtgactgttattttcatatctccaatttgttgcgtgtgcaaatctggatttgtggtgtcattcggtgtttcaagtgaactcttgtcagggaccatttgctgaatagctgcaacagctttaagaactgcaacatctacaaataaactatggagtaggaaagccttcctgtctcggatttgcctctcctcagctgttttgcaaggcattgcagccagtatggcaaattcttttgcccatggcctatggtcatgttttccatctcttccctgaccaccaccattgctaccccatgtttcatcttcagttggaaggggtggaaacaccgatggcaaatcagcaacagcaggagggaccacccaagtgtttgaccggaatccataaggaagatttccaaactgcaaggaaatgtcaataaaatgtgaactataaatctctcaaatgcaattgcaaagttgtgttaatacatgcaaacaaaatatatatataggtacattaaaacaagcacactattcagtttagtgaaacaaaatgcattagcttatttccaattccacgaattcaattgtttccgtggaaaatagggtatgtctcttcaaatgcattgaccaataaacctagaaaatgatctctaa

SEQ ID NO: 44115 - DNA, 24120 bp, Oryza sativa
  unsure (1)..(24120): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcagactatctgtcattatcttacggacaaaatttgtactatattcactctcttgaggagaactttgcaaccgctgaactcctccagatggttgaatacatggtttatgaagcagcatccttaagctgaaaagagataaacatgattgtcatagattttatccaaccaatacaatggtaaaaatagattaagaaaagagagaaagaatgaaatggaccaagacgaacagaggtaaagtaaatcacttaggactgatttgggtaaacccatggtttagaattatcaggttagcataagattatatatatatatatatatatatatatatatatatatatatatatatatatatatataaaatcaattttccaagtactaacctattgacattcagtgcgttgctacctccttcaggctgatcttcaatgtcaatatcatgttgtgctagagaaacagttgtcagttgagcatctgctggaacttgaacaacagctgtgtatccacaatgcttcacaaccaccacaccaagagtagcagtatcctgtaaactaataaaattacatcgacaataaacaggaaaatggataaaagtaaactgcaacagcccgtatcaaagaagaaagtcttacatgtactgttgcactctcgtcagcagtgatgcccttcaacagatttctcttagcaagttcatcagacagcattcctggagcttgacttccatctaacttgacatctaacttagaacttgcatccgctttgtcctttgtgactgttattttcatatctccaatttgttgcgtgtgcaaatctggatttgtggtgtcattcggtgtttcaagtgaactcttgtcagggaccatttgctgaatagctgcaacagctttaagaactgcaacatctacaaataaactatggagtaggaaagccttcctgtctcggatttgcctctcctcagctgttttgcaaggcattgcagccagtatggcaaattcttttgcccatggcctatggtcatgttttccatctcttccctgaccaccaccattgctaccccatgtttcatcttcagttggaaggggtggaaacaccgatggcaaatcagcaacagcaggagggaccacccaagtgtttgaccggaatccataaggaagatttccaaactgcaaggaaatgtcaataaaatgtgaactataaatctctcaaatgcaattgcaaagttgtgttaatacatgcaaacaaaatatatatataggtacattaaaacaagcacactattcagtttagtgaaacaaaatgcattagcttatttccaattccacgaattcaattgtttccgtggaaaatagggtatgtctcttcaaatgcattgaccaataaacctagaaaatgatctctaacctaaagtttagctttgaaattaataatttttaaatagtcacatattcaggcatgtctgaaaataatcaagaaatcaagcattagcaagacctcaccttattatgctcaacaaaagccttcataagagccttgtaagcctacaaaatcgcacacatatttccacatcaatgagataccattcattaataatcaaatcacaaaatctccaaggtcacacgtactccatcaaacgcccggctcgtctgctgcaacagcccaacaagggagtggctgatgagcgctcgcttccctgctggatagaatccagctttggaggccacgatggtcaccggcttcccactacaaacccttacctgcacaccaacacccaattgcagaacgcttggagaattatacaggtgcaaatgagtgtcatattgcatttttttatgacattggccatattgatggttacgtgcgtgctatgataaattaattaattgtagttttcatatatatgagttgcagtctaatctaatgaatatatagttaaattagcatgagattttgaaacaactattggcaaaccttatctagctactctaatgtaatgcaatcgaatcaattaaactaaaaagaaacatcacatttgtgctatttttcttcaagcaaactcacatcgatctggaagaagtcgtcctctgtcttgtcatcaacgaatgggcgcgtcgacctcctaatatctgaaaccaatcgcattttcacttaaacaaaagtggaagaaaaaaaataaatatcacccgaaccggctcaccatcttctgctgttccgaatgcgctcaaataaaaaaaaaagaaaacaaaaatgaatgagaagaacgaaactactagcactcacaatggaggggcggggagaggtgggagaaggagaagaactcgtagaactgtcccagcttcggcggcgggtacatcggctcctctcctccaccgcctccggcgccaacgccgccgccgccgccggcgggcgacccgggggtcttggcggcgtcgggcgaccccggcgggggcggtggcggtggcgcatcgggagacgacggcgatgcgggcttctgctcgggcgcactcttcctcggcccgaacgcggcggtgcaggcgacgatgtcgagcagccgccgcacgtgcgccacggcgagctcctccgtgtagccctctgccgcgcgccatgggagacgagacggtgagttttttatttttttgcgttttggtcctcgagaaatacgggatttgctcgttcagacttaccctcgacgatgctgacgtggcacggcttcagggaggcgacctccaccgtgtccttgagctgggccccacgaacctgcattggtggcagagagggagaaagtacaggctgtcagtgggcacgaatctcgaggcggatgtgagccgttgggatcctctgaccgacctcgtgggacagggagtagttggtgaggtggcatgtgtccacgtggacggccaggagcttccggacgtcgaggatcttgtccgttgatatgccctgaacaaagcaccacaaacacaaaatgagctaggcagcgagttggcacctaccactgcgaattataagtaccatatttaaattgataatttagccacacaaacaacccaatatgaaatttgagatttaaactcggaactttaaccccaaaaataacccagtcttgtttagttttcaactttttcttcaaactttcaacttttccatcacatcaaaactttcctacacacataaacttctaacttttttcttcaaattttcaattttagcgtggaactaaacacagccctaatctaaaattcactaggagatttgaactcaaaaccttgggaattgggacgctactgaggttactataatcagtaggctacatgccattgcacaaaatggtactatgtacttaagctaacacaaccattgctaacttgctcaaaaataattaggatgtgtaaattgcccatgaacttttttgtgtaatgttcgtatagaaaataaaaattctcatcatgtacatttcaacgagtggggtcattctttgccagctttgttaagttgccgcttatgctcggtcgctcgccattgctaattagcacaagaaaaacacgttttctgtgcaattgaaaaaaataaatatagaagtttctaagagaaaagtggtaggcactttcgctttaaacaaagtttttttttctttttttttaaaaaaaacaagatgaaagtgttgcaagtgaaagctagagaagaatttacttaattttgtcgtttaacatgcaagcacaattaaggccatcgaatagaaggaacagtacatattcagttacagtggtcactggtcagaatactgggtggtccatattaattaattaattacgcgaaaatatccatgcgagaagacggagataatacgcgccccggcgctcaccttgagcgtcagctgcgtgtagtccggcgtctcaacggtgacgtccagcacggtgggcagaactgcagcagcatcatatcaatatttccacgcaaaaaccactcacatgttaatactgaaacaatatgaactttcaaatattgaaagaggcaagctagcttaattaattaatccttgcatctgaaaataacttttgtcttgaaaacgaattaaattaaaccaatcatccgagctgatgaattcgatgaaaattcagatgggaagtgaagaagattcagttagccatcagttaagctgcacctttctcttccttcttcttcttgtctcccttggccttgtgcggcttggccttccctgccttgggcgccatggctggcgtccctcaagctaattagctaagctaagctaatgaattgaaacctctcgataatctcgttcttgtcagaaaccaatcaagcgagacgggattaagcggcagctctacgttggccttagcattgcagaactgcaggtcgcttagcttagcgcttaggcaggagatagcgagcgagggaggcagtggagagggaagctagagggtgagaggcgataagaggataagggatatatagctgcttctagctagctagcaaagctgagagttgcagcttctactaactctgaacctcaagcactgttttctctgcagaacggaataggacaaagggtgaaccggtgaagtgtttggtgaattattttagtctaaattaatactacctctgcttttttaatagatgacgtcgttaattttctgccacacgtttgaccatccgtcttattcaaaaatacgtaattataatttattttgttgtgagttattttatccctcaaaatactttaaacatgatttatatcttatacttctgcataatctattatattattaaaacagccttaaatgaaggcaccactttgccgccgtgggggctagaaattcccacattaatcggagaaaaagaaaaggagagtccaaatagaaatacaatttaaaaatagctgaattcggaattaaaaataagtaatattgaaagaaaactccatataggaacccaatatgagattaatcgaaattcagaataaaaataaaataaaatctgaaaatagaaaaaaattaagagtctaagtaggaatacaatttaaaaataattgaaattcgaaatttaaaataaggaatattgagagaagagtccatataaaaacccaaagcgagattaattaatattcagaataaaaataaaaataaaatccaaaattagcaaaacgaaaagaagagttcaagtaggaatacaatttgaaaataactgaaattcataattaaaaataagcaatattgaaagaagaattcatataagaacctaatacgagattaattaaaattcaaaataaaaataaaataatatcaaaaattagaaaaattaaaagagagttaaagtaggaatacaattttgaaacaactaaaattcaaaaataaaaaataaaaatattaaaagaacactatacagtattaattaaaatttgaaaaaaaaataaattctgaaattagaaaaagaaaaaatattttagttaggaatacaatttataaataactaaaattggtgagaaaaaataaagactattgaaagagaagaccatctaaaataaatgacgaggtaaattaagtaacaagcctataaaggagtagagtggtgacggttgatacgacgtataaaaactgttaataaaacaccaaatagaatcctaatgacgattaaaaggagggacgacaggcaggccatgaagcaaacaggcaagacggttgccgggacttctagaaagtaaaaaaaaacccgttgataatcatattcggtttttaaaatctcaatgacagtaaaaaggagaagcagcgggcggggtgtataagagtatagttgcagagctgttaactgttggcgggacttcttaaaaataaaaaataaattccaacgatagttatgttcgatttttagaatcccaatgaaaacaaagagtaggcggcggatgggtcgtaggggagtatagtggtatcgtttgacgggacttctaaaaattataaaaaataaaacccaacaagaaaataaactctaaaaactacaaagtccaatttctaaaggttcggaacttcttaaaaggtaaaaaaacaatgataattatgttcgattttaatatctcaatgacactaaagaagggagccagcgggcgagccataaaggagtacaatggcaaagccgctgacagtttggcgagacttctaaaaagtaaaaaaatgaacctgaacaataattatgttcgatttttaaaatcccaaacaataaagagaaaaagacagtggacggaccgtagaggaatattatggcagcgtttgacgggacttttacaaattataaaaacgaaacccaacgagacaataaactctaaaaactataagatccaattgtttaagatttaaaggataattaatagaaataatggtagattgagcgagcaaataaagaaggatatggcagaagtaaggggtagcagctggtgtgacttttaaaaactatataattagaaatacggagatgataaggtttggtctttcaaagtcttaagacaacaagatagctatttaataaattttaagcaaaatcatactgaaaatatatgattttgcttgggtgttagccgctcaattacgcggggcacctagctagttttcttttaataagacaaatggttaaatatgtgttcaaaaatcaacggctttatctattaaaaaacagagatagtatgatatatagtggaatttacaaagaatttaatttcgtggggtagtatatttacatgtgggccctagaataatataatcaaacggtgtgccatatgctgatatgtaattaatattagactggttttgttgtatatttttgtatggagaacaactttataagtggaacacgataagcagctaaaaaggtgtttagcatatatattttcaatagaaatttagtggggttgtagatttgccatcgatgtgcctagtgtgtgtgagtgtttcatgtaaacacaatactataggaaaattttaaacaaaagaagcagtactaaaatactatagggttacagcgatgttttgttttgggatttgaattcttggtagatatagtcaaggctactattgcatatagcagtgttggttaatgggtgctgtaaaaaaattgacattgcaaataagcatttcctggagagcaagtaattgaggtgagaattgtgtgtgaaactcgggcgctttctaaatagatgttgaaaacttgcacgcaaaaggagaaacgtgattggcatataatcagtttagtaagaaatgatcaataaatttatttggatttttcaaaacaacttctatataaaaattagaagaaaaaaacacacactgtttagcagctttaaaatcgtgctaatgaaaatcgagaaagtagccaagccgaatcctggtttagaacatggcgtaattaattagtggttcgtgtgctgctgatggaggtagctaaaccgaggctggaaagggaaagagagaacaaataatcaagggaggatggagaggcgagtcgagttgagtttgtagtttgtagggttgcgccgcgcgcgtacgtgtggtgagagcaacggggggatggagaggaaggggatgaggtggattttcttggaaggacacgattggggcgaaccaatggccagcagaggcctcatcctcgtctctccctatcggggatttcggccccccaaaatctgcagcgtcgcgccgccatgtcacccccttgcgcccccaccccacccaaaatcccctcgtcgtcccgtcgcgcgcggccgcttcccctgcccccacaaagggtatgcgtatggccttggccatacacatctcggcctcctcctatcccgtccttggtcgcgctcgcactcgcactcgcgtcgcgtccatccatttctcaccgcgggcgcgtgtgcggcagcgcccgcagttctccgcacggacggtggctggtggccgacgtttttcaccgcgccggccgccggggcccggggccaggctgagcggtcggtgaggcgtaggtgtaccgttcaaaaagtctacctatgccggccttggagcgttgtgctggacatggacatggacatggccatgaaaactctgcccttctctgcagctttaatcgagcagagcagaaaaaacgaggcaatgcgtggaattctgtgaggagaggcagagaaaacggagcatctctctcggcctctagactttctttttgggcctgaaaccacgacggccctttgttccctcgaaaggcccatcacgcgtcttccttacgtgggccgttgccttatccagcccagaaggccggcagccgaaattgcgttcttctacgtgggaggaaaaagtacacgaaaaggtccctcaacttatcatcaagatacaaaatcatccctcaacagcaaaaacatatatgcggcatccttacttaacaatcggtcacaataaattcttcagtggttttgattccggttttatcctacctgacagctaagtcagcgtgggatccacgtagactccacctatcaggatgctacgtcatctctctcccttcctcctcctctctctctctctcctctcctctcctgtcctctcctcttctcttctcctctcctcttctgtgggcaagccggccggcggctggggaggaggccgccggggcgaggcgggagaggagggcggcggcggcagccttcgcagtgggggaagctgccgccggcggacgcgtcgaggtattgctgcagcggaggaggacgacgaggaggagatggggctcgtgaggtcgagctcggtctccgcgacggcagtggaggaaaaagcggcggccgtgacggcgaaggcgtggtggggttggcacttcccgagcccgctcaaggcgttccggcaccggagatcatcggcgagcatgccggagtgaggggggattacaggagatttttccttttccctttttttggcttcgcgtgctaatcttatgattaagttagaccaaactccaaagcctgtgatttgggcgtaatgtgtgcatatactcctaccagtggtgttgttcattgttctcttcgtgcttttgctcctttttagagtgcttgcaaacgttgtagcctgtgtacatcaaattgggaattttaaggtcgctgatttgatctgcaccaggagtttcttttttctctttttcgacactgacggaatgtagattgtgcgttgtttttctttcagattggagtgccggtggtggccatcgtcctgtccggcagcgcggcggcgcccgacagcggcgtcgacggatcgtaccgtcggacgacggaggcgagcggcgaaaaggctacaacgttcactggcaagcggcgagcgggtgggcagcaacggcagcgcagctacgccgcacttggcaagcctcacgttcaccgacttgcccttcgccaccacatagatgttgcagtagtccgacgcgcccttcatcaggctgcacggcatggcggcggcaacgaggatgcgggcggcggcgttgcctccgccggcgcgacgccggccgccggacctcctcctctgccctccccccctcccccggcggcctcctccccacagcgccgcccgtcgtcggcctcagaaaagtgagagagaggaggggaaagagagagaggtgatgacatggcttactaacatgtggggcccacacgggtcctacgctgactcagccgccatgtaggacaaaaccagggtcaaaactcaaaaccaccgaagcaaacggttttgtaagctgagggatttcatatatccggttttgtagttggaggacgattttgtaactcgatgacaagttaagagaccttcggtgtactttttcctacgtgggatgctgctggtggacggacacaagacgagacgctgcccatccgaattatgcttatgaaacaaactgataagtcaacttgacctccctcatgtcttgctcgtattgaaccatctacctcaattgtaaaatcggacttaatgtttacgccataatttggctcacggttgatttcatttgagcaggccagattatttagaatagttggtgcaatcgttgggtggtgtgcttaagaattggttagcttgatatgtgcaggaatttgtgatgcacctgaaggtgtacgagttgctggggagctgcagcgtttggatcggcgtggtgatgcatgtgctgctacgaccgggagttcctgctgtgcattgtgtacatgctggattgatttgatcatatatatgcattcagagatttggtgatgaagctttgatgattgcatgccgaataagatatagtagtattccatattttactagttggtttgtttagattgagtagtatacgatgcaccatcctgtcaggcgaggaagccatccgtgaagtaggaggccagccgtcaccttacttggctgtacccacattgcccacatcattgtatctgcacccgacttcaatgggggacctctttcaaggacgagcgtgtggcgacatgtgctacagcggtgggtgtcgtcgccacaggcgatggtgataccctgtggctctctccccgcctctctgggaggaaccagatgcgtcaccagaggtcaacgagatcacgctctcgatggaggtgttccttctatgtgtcaggcccatcactgcccacttctacccgtcgaccgcgtcctctggcgcagtgacggacccctccagtagaggcgacgccagagcaacacatggaggtgccgctgtttggggctcgagagaggagtaggctgaaaagtaggtcccactgtattttttaaaaaattttactcttatcacttagatatggatcccacttctatttttaacctctttaatgaatgggttaccttgttagaacaggggaccaagtcaacctatcacataagcataaatcgtttcccaaaccacagaaagaagtcgatttgtaccggtttttgaaattgagggagacattatacctagttttatgcttgagggatgcgattcgactagagcaagacatgagggaggaaaaataaacttattctgcctacgaatcatctgtctttcacattgggccaattatcagcactgacaaaagaggcttatactagcatgtttgcatagttatatttttcatagacaatgccgaaagagagatgatttttttttcttttttagattacacggtagacgcacacgcacgcacacaacactatagatgcaacactacactcacacatccttgaatgcgtctctgatacccgttcctgatcttaacaaatttatgttgaaagcccatttatatgtgcgtagtacttgtggaaactagaatttgaactgatgtgtaaattcatacacccacaactctaccatcagtccatcacaccactagtgtttctcctaaatcaggatatgatgaactatatataggtgtttagagcttttgtggagcttaattatggtctaattgaatggaccatattatatatgcatgttatttgtctttaaaagaagattatattgtatgtcagaatagagtttaagtgatacaaaagctatatacaagatggaatcaaggggcaggtaaaggttcgtgctttaaggtcaaactcgtggtggtggtgcagcggggaaagaaaagcggtgatgttgtcccctcctcatgaccacactagtgtctcctcctccatcatagggcactcgtagtgcgtttcacccatatataagacctcggagtgccacataggctccatgggttcaaaatctgggttcttcacagtgcaattggctataggagtgattttaattttatatttcacccctaatacttcatgtttcagttcttatgctttttctaatttacatagaagtaccaaattacgtattgcacaccctaaaatccagaaaagaatataaaatccactcaccaccttctctctctcccttatcccctccctccctctcagttcccacaatgcacggcacgacgaacagcggtgacacccgctcctctccgtcaccgccggccacgaccctcttctcctccaacccagatcaatgaccctccacccttagtgcaccgatgagctcgacggcgtggactcggtgtgggagagagggatggcgggagctccgtggcgcagatctagcggtgggatgagctcccctctctgtcggaccgcgtcactgctgcctctcccctctctctcaggcaatgactcatgtcctcaccatcggatggggtggatctagcgagcgtcacctccatctctcttctcgatccgaagttgtcggatgctggctgtcaatctggcgctgcaggagaacggccaggggcaagggtgtggtgctgttgggcaatgagcagattgggctgatcagctccaggtcgtccccacccacccaccctctcccctctctcacacacacctcacacgcttttggccacgaggccatcgatagctttcctcgatgaaactgttttttttttttgacgaggccatcggtactgataacaatccggcccaggtggggttggccgagacccaataacttaaggttgctcggaccccaacagttctttggcataagcccgatctccctaaaagactagtccaataggggaagagtggcttgctaagcaaggtgagattatttagaggctcacacggtcgccgcccgactttagcgtctttgccagcgggtaatagtggaggatgtcctcatcagataccaacagaggatgcgaggactccacaaaaacatggtccccatcccttttcttctccacacatgcaatctgtctatgtggacaaacaatgccactgtgaaatgaccttacattcttacccaacattgagcttggcgtcaaagcaatgttttgttgtgtttcgctccttccaaatttcgcggtggctactaatatctattgaattgatatgttctaagggctgggcgtgaaatccacatgtaggtaggctgatttgtagtaacaaataacgaggagagtatatatgcactgttgaacggaaaatcatgcgtgcgttgaacttgggagtcatatataaggaccacaatgcccctgcaaatggacgaagttccgtttgtctcctaccttttggaccccagcaagagcactgtgcacagcatcgcacacacaaagctggccatatcggtgcatcggccattgggcctaacagtgtcacatggccgtcaacaaacgccaagcgacccaccgctaaaaacacaacacacggccgttttcagtcggccggcttgtcagccaggatgtgtacaagcaaaaggtcctgcatatgtggatattagtgaatttcagccatgcataacttaagcctaccctaatggattatattcatgctacgacattgtcaggtgtataggaattgctagatatatcttagatgataaaattactaagaatctcagtcacattaaaacctagcactagattgagggaagaaggggaggaactcaccaacaataatgacatgaaagtccgctagaaaaaaaacctagagtttagattttggggcgaggggtgacactgggtaacgactacaccagcatgaggatggtggaggccgtaggactaagaggagatcgttataatctctttttcactcttgtcaagtatttttactttcctttttctagaataaacaaaccttagagaaataactaaataattctctcgagttttcctttcatttgctcaatttcgtatttacgatttctcctatttagcttctttttttttttaccatttcagagttttcccttggtctaaatttgttatcataggataggtcaaatcttatcctagataggattattttgggatgcatgtagtagttttttttttttgataattttctttaaaaaaacaaaagcagtgccccaaagagagtgaaaactaaccaagatgttacaggatttccatataagcacttagttttatactgcatacattagctaagcacaatttaatacaatatttaagcagttaataagttttccatagtcaaaattgtgttagccattttttagcaaataaggctagagttgattccttttctggttttttggttgggagaaagctgtaattttatctcgcaacttgtatgcgaggacgctttgattgagtaatacatttctttcttccaaataaaaatgcagcaaattaaaacccaggcacccagcctagaaaaaaggcactgtcgacgctcaccagttgatgcgatggtgactgtgcaaagtgcaaagcacaccatgcaatataatgcaacatcacaagaacgcaggatgatattggctctgctggtccctgcttgatcttctttgacgtctcgtccattaacacgataaaccgctcgctcacacagaagattccacctgctgcacagtcgcccccacctcaattcctccgatccgtgaacccccaattccaagaaagaacaaagcaaaaagtctttttctattttacaaggtaaaatatctttgctctttcatgttaagggttaaaaaaagaaaagtgaattacactttgtgttagaggagatagcgctccagttttgagcagcaaaagagctggagctcgagtgagcttagggaggatgggtggggattccctggagttcactccaactccacccgatagatatttgatcaaatctcagtcgtctctgtataacaacggttgggatgaactaactaattcccactagtttttttttcttcatcctaatatttgtaacaaatcaatgaatactatatatctatatatctaaagaatatacaaactaattttacttgcataacctagaaatttcatggttcatccacaatataaaaatcatattgggcttgtggctctaatgttttagcaatatgtttgtgtgtatattgtttatgcatgtttgcacgtactaaatgtttaacatagttctatacatgaccatagcttcttgtttggagaagaagagagcgtgcaaactttgttaatgttgttggcagaaacatactcattaggaacataaaaagaagaaaaggtaagtaattttcattcaagcatatgtgattgagggagttaattaatataagttaatacgtggcttcatcttagccataggaaacaattgatgtcatggatttggtcaaatccacctggtgaagttatagctaactctaagggatttggaccccatggaaacctcccctttctcgttttatttgttgccaaagagccaacttttttttaaaactaattttttttgttgccaaagagccaacttttttttgaaactattttttttatattttcaataagcatgagtaaaaacccctagacgggttacaagaaaagaaaaataaccaccagttggctgaatacacaaagcacacgccacaactcgctaacaactaaaaacactaacagagcccaacataaagtgtcgattccagacttgaccacgagcagcttaggaggttctgactttacaatcgtgtcatcgttgccaagcttgccgccaagcgacatagcaactctgacttcaagatgcaacatcgatatctagcacgctgccaatgatcaagaggcctcgacatcccacaatggactgccagaatggtcaagcgaccttgataccaaagagccaactagagcttgagcttagcctgctctgctttgctcagactttgtttggtctgagaggagagcaggaagagacctaaaagatatggataacaggttgaaatagaaacacttttgttaacttagctggttgaaagtgaaaagtgttgttaaacactagtccaagttaaaacattagtaaaaaaaagttgtccaatatgcaattcaccatattcatatatgttatgagttgtttagagtaaatcttttttttttcttgtcatgcatatgctcacacaccactacatataaacatctgagagtatgtcttttaataaattgaaagccaatacgcacatgcctaatatttgtagacatcttcttctatttaaggaaaataagccttaatggatagtcaaaccgttgtactcttgtgcttctcctattcatttcggagtaaattaaatgagcatagggaaacatcgcacttgtggaggtaaataattatatacacacgggtattgcttttcaatagaaatttgaagagtgcatgaaagattactagtgcgtgtagtggtgcatccgcacgtgtctctcctatgtaagccaaaaaaaaagtgaatgcaacttttttatttttcaataaaggcaatcgtgttatgtcacattgatcattttaaaaaatgtctattgattagtacattatattataaagagaaggtttgccattttagccaacaaagcttcattaccatgttgatcaagaaagagtaaatttcatataatgtatcacgtaactatagatttaacattaaatttatcacaaaactacaaatttaaggtggaatatcataaaactacaaatttatagtaacaaagttatcacaaaactaccgattgccaatttaatcataaaacttgaacatttataactcaaatataacattagtgctaagaatttaaacttcaaaatctatagttttgtgataaatatattactaaatccatagttttgcgatacttagccttaaaccggtagttttgtgataagtttatgttaatctgtagtttgtgatacattaccttaaatatgtagtttcgtgataatttagctcaaatatatgtagttatgtgaaatttactcttagaaaaagagagaaagatttacactatccgatcagggtgagtctaaattataataacgatatagattttctcaatatagttacataaaaaataattatatttaaatttgctttcaaaaattgttgctctaggaaaacggcgtggagaaatcagctagtgaacttaaatagtactccctccgttttttaatagatgacgccgttaactttttctcacatgtttgaccattcgtcttattcaaaaattttatgaaaatgtataagatataaatcacacttaaagtactatgagtgataaaacatctcataacaaaataaattataattacataaattttttgaataagaccaatggtcaaacatgtgagaaaaaatcaacggcgtcatctattaaaaaacggagggagtattagtacgtatgtacaatgtataacaactcagtcatcttacacctgactgaatttaaattctacaatctacatggcagaagtccatattttgcccatgtatatacgttcaaaacataataccagctggagtgcatgtagagatcttttaatttggtccatgccatgctgataaagcatgtttcttctacctttgctcacgatcccaatggctttaattatgtaccacgatgagaaagcattagatgcaatgaaacgcaagaaaaaagaagatgataaaaaagcagcaaatgaagggcccctgcctctacgccaaatctggtggtagatcaaccgcatgactgtcatgttaattaagcaagaaattccctttgcatttcatctcggtagaacacctgcctagctttcaaataaaaggaaggagattaccttactaacagcatgggagaaattttgatttttatttttaccattctgacacacctgagttgaaaattgcgaaatggagcagccattatatatgagcatgcaagatctgaataaaagcttcactgctttcactggagaccaaaactggctctctttcacaagacattctccattttctttcttctcttcactcacactcacactcacaagagagtaagtgagctagcgagtcacaggtttgctccaaagctgagccaccccatcccatcctctggactcatctgcttggctctcctcacaccacccttggattcttgcacttgggagcaagctatagctttgctttgccttcctctcttcaaccctcactctcagcattgttaagctcaggatttggccacctttctcctatagggatcacacaaacaccggtagaaaaaagctcttcttggagctctctgcttggcctctctctctttagtttagccgcaaacaatttcctctcattttttctttgatggccgcgttgcatgggcatggcttcgcggtcaccgtgctactggtggtgttgttggtgcaatgtgacgcggcggaggcgacgacgtgcgccggtgcggtgccggcgaggccacggccggagacggtgtccatcgccgagttcggcggcgtgggcgacggccggacggtgaacacgtgggcgttccacaaggcagtgtaccgcatccagcaccagcgccgccgcggcggcaccacgctgctcgtgccggccggaacgtggctcaccggcagcttcaacctcaccagccacatgaccctcttcctcgccaggggcgccgtcctcaaggccacacaggtctcactctcacctcgccaccgccatggccatgtttttcttttcctctcttcttcttggtggtgagtggtgtcgttgacatcgacgcaggagacgaggagctggccgctggcggagccgctgccgtcgtacggaagggggagggagctgccgggggcgaggtacaccagcttcatccacggcgacggcctccgcgacatcgtgattacaggtgaagaattgaagctcagcttagctcagctccggtatttctagttgttgcatggtggtagcttctctgctgctcactttctcccctgttgttttggtatactgtgttcttgtgatggtcttgattgtcaattcttaagtctcaaccaactaactttggtctcctggtcagagaatattcaaagagacatgcatacatcctgcaaaaaagaattctgcacacaccgaggaaaaaaagattatatgatagcatgggagtgagtgactaaaggaagactactttgttgcttacacgcatcagacataatagggtaataaataaaaggaaccgaaaagataatagacctagttaacgcaactttagataaatagtagtaagggatttgtccatcatggttaaaatatgtactcttccatggtggtttgtcagaggtttgttattttaaggtttaggccattactgagagatttagaatacaaacataccttggtgggtagcacggtggacgacctgttgtcggtaaagttgaatcttgctcctgttccatatctagtggatgtacatgcatgccaagaacaggaaatggaacagtgaactgatttgattctgtaccactctggtacagtttacatcacttctactattaagttggtgactggtttaagccagcattatatgctcaagcagacaacaagcagtcaggcttactctcaccaggcaactgaactaactgtgctcttatttcgtctgtagcaattttctctgactgttcctgcaaaagaactcattaagattgatgcaagtaattaacatgtcagattttttttatattaaaaaaaaaggtgacaagggaatcatcgatggacaaggtgatgtatggtggaacatgtggaggcaaaggacacttcagcataccaggcccaaccttctggaattcatgcattccagtggcattcacatctccaacattgttctcaagaattcacccttctggaacatccatcctgtttattgcgagtaagcacacgcttgaaagttgaaatgttcatctccttcctgcaaaaatttgtcactgcttaatatttctttcagagcaatgttggaaggccgaaaaatagttgatatgtgaaaatttcaatacaatccattatggaatagttaccagaaataagaaatcttgtgacacagctacaaaattcttgagaatgttcagtttcaaatgcccatttatgctgaaatactgatccaattcattttctacacccagcaatgtggtcataaccaacatgatgatcatcgcaccacatgactcgcccaacaccgatggagttgatccaggtatgcaaattcatcttaagcttctggcacacaaacaaaccacatataaattgattaatttttctttgctacatgcctgaccatccaagagtacatggaacatgctaataatactgaatcctcccacagattctagcaccaacgtatgcatcgaggactcctacatctcaaccggcgacgatctcgtggccatcaagagcggctgggacgagtacggcatcgcctacgggcggccgagctcgggcatcaccatcaggcgcgtcaggggctcgtcccccttcagcggcatcgccatcggcagcgaggcatcgggaggcgtcagcaacgtgctggtggaggactgcagcatcttcaacagcggctacggcatccacatcaagaccaacattgggaggggcggcttcatcaggaacatcaccgttgacaacgtccgcatgaacagcgtccgcaacgggctgcgcatcgccggcgatgtcggtgaccacccagatgagcacttcagccagctcgcgctgcccaccgtggatgctgtcagcatcaagaacgtgtggggtgtcaatgtgcagcagcccgggtcgatcgaggggatcaggaactcgccgttcacgaggatatgcctcgccaacgtgaagctgtttgggtggaggaataatgcagcttggaagtgcagggacgtccatggcgcggcgctgggtgtgcagccggggccgtgtgcagagctcacgaccagcctttcttcagggttctgcagctattagtgtgatccagttgtataatgttttttgattagaaaggttgtgcttgctttttttttaggtttgactgctccctaattgtggttgggattgatcaatatgttaggcttgtgctaatcagttaaggagttttaggtgtctttttgttagagaaaggtttggcttctaagttgtcagtctgagtgcaaatatgttctaatctgaataataaatcccagcttgtgtgagattaatactccgtcagacttgtgatcaaatgagagttgaatgtgcacatttttactcctaatttatctgttggctgttccacaaacaattctagggtcatcagaggcggctcaatggatgaggaaggaggctctctgcaagaggcgattagattttttttttttgagaccaagaggcgattagattgggtctactcaatcagaacaaaggatataatccaacagctaacctacaaagataagtcagtgtgcgtatcaaaaattggaaatggataggatatggtacaagcactgatcgaaaattcctgtttcgtttgtcaggtacttctatatgattgtgatactgacataatatgtgctactaacattctcatttggacaatttctactctgataactgtactatactttaggaaatgtgttctgaaaactgtggcagcaaatcttccagttcatgatcctaataatgatagttcaatcaaagacactaacaacatctaaaatcaagatgtaaatggaaacaaaaacactctggacaggataaaacaaagaaaaaagggctgcgcttcaaaagtaatactcccgggataatgtaatccctaatcttactgctctaaattaaacccccttttccactgacgatgattaacaaaagctaatccccagatacttgttaaacctgctattagtccttgctacttatgcatcatatatataatatccagaaattttagtactctagcagatagtatgattcagcgttcgtacccatagggttagctcgcgatcagatctcgcaggcgcagcgccagcctagatcggatctcggcatccatctcgatccccctaatctctcgtcttcatcctcctcggcaagctcgtcaccggccggatcgagcccgaaacggcgcccggatccagccgatccgccgcctccggggaaccctccatcgacggcggcggtgggtggggacggcggcggggatgggtgggtgggtcccgctcgtcggaacgggacgaactgctcactagtgggccccaaaaatgcccagatgggaggagaggtcaaacgggctgttattgggccgggtccgtctggccacctcgatctgatccgatccgtttaattacggtttcttttctctcttatttctataaagctaatgcccactaaacacctaaatcttaacatgcaagcatagtatttattagcactcctaaaacctacaaacaagtatgccacatcaacctattaagcacacaaagcttaacatgcaagcctacagtaattatatctacactttattttattttattctaaaattaaacatacacatgctaaatcatcattctcaaattattttcataatatttcaatccaaatcatttcatcatttctctaatattctaatatgtatcccgcagcaaagcacgggttatcgtctagttattattactaggagtatcttagactaaacattagcttgattaagctctcaactactccataataataacattacgacgtgatgatcctttttgtttgaaactttacaacacgtacgatcttggtttggtcagtctggaatggccggtggttcccttgtcaaacccaaattgcgcacgcaatgacgtatatatatcaggaatcaaatcaaatgctcttccgaggcttaaaagattcatcgaatttttaaaagataaaaaatgtcggggggaaaagagtgaccttaccattggttaatcaagcatggcacgcatttttctactcttgtgttctccgtcaggttcgctgatcgatgtgtgtgtctgatgtaccaaattgttagtggtatactagttttttttaggggatttttttttgaggggaagttagtggtatagttgcaatcaaatgctgttagccggaaggataaacaatatgtgggtggatcgttgactcaaatcatcgtacatctagctgtgtgcacgctcttgtgcagagatggctcactgataaaaaaaattatgaggatttgttgtacgacaaacatatacatatggagtactccatgaagaacaacctaactgtacacaacagaatagtattaaccaaacacattcttcactttggccttgtttgaatcctctgtgctattaaatatctctacggaatcttactatttagaagtattaaacgtacattactgacaaaatccattccataacccctaggctattttgcgagacgaatctattgaggtatgttaatccatggttaatggatgatcactgtaacccactggtagagaaggagtttttactcccggttcgtaaccccctatagtcccggttttccaaccgggactatgaatccgagactaaagatcgctatctttagttccgggtgaaaaaaccgggagtaaaaatccattttttttcccggttggtgttaccaaccgggactaaagatactaacaccaaccgggactaaagaggctagatccggttgctactttattctatttttttctttattgtttttaatatattgattcactctatcccatcccaaaatcccaaatcaatcatccccgaatagtctctaaattctcaaatcaatatctctaaatacatcacaaaatcttaaaaaaattacatcacaacttctacaaaattcatgacaaatacatcacatattcacatcacacacaaatcaaatacatcacacacaaatcatttcagatccgaatcacagaannnnnnnnnnnnnnnnnnnnnnnnnnnnnnnnnnnnnnnnnnnnnnnnnnnnnnnnnnnnnnnnnnggggc

SEQ ID NO: 44116 - DNA, 1280 bp, Oryza sativa
gagtggtgtcgttgacatcgacgcagaagacgagaagctggccgctgagggacccgctgccgtcgtacggaagggggaaggaacctcccggggccaaggtacaccagcttcatccacggcgacggcctccgggacatcgtgattacaggtgaagaattgaagctcagcttagctcagctccggtatttctagttgttgcatggtggtagcttctctgctgctcactttctcccctgttgttttggtatactgtgttcttgtgatggtcttgattgtcaattcttaagtctcaaccaactaactttggtctcctggtcagagaatattcaaagagacatgcatacatcctgcaaaaaagaattctgcacacaccgaggaaaaaaagattatatgatagcatgggagtgagtgactaaaggaagactactttgttgcttacacgcatcagacataatagggtaataaataaaaggaaccgaaaagataatagacctagttaacgcaactttagataaatagtagtaagggatttgtccatcatggttaaaatatgtactcttccatggtggtttgtcagaggtttgttattttaaggtttaggccattactgagagatttagaatacaaacataccttggtgggtagcacggtggacgacctgttgtcggtaaagttgaatcttgctcctgttccatatctagtggatgtacatgcatgccaagaacaggaaatggaacagtgaactgatttgattctgtaccactctggtacagtttacatcacttctactattaagttggtgactggtttaagccagcattatatgctcaagcagacaacaagcagtcaggcttactctcaccaggcaactgaactaactgtgctcttatttcgtctgtagcaattttctctgactgttcctgcaaaagaactcattaagattgatgcaagtaattaacatgtcagattttttttatattaaaaaaaaaaggtgacaagggaatcatcgatggacaaggtgatgtatggtggaacatgtggaggcaaaggacacttcagcataccaggcccaaccttctggaattcatgcattccagtggcattcacatctccaacattgttctcaagaattcacccttctggaacatccatcctgtttattgcgagtaagcacacgcttgaaagttgaaatgttcatctccttcctgcaaaaatttgtcactgcttaatatttctttcagagcaatgttggaaggccgaaaaatagttgatatgtgaaa

SEQ ID NO: 44117 - DNA, 895 bp, Oryza sativa
ccgcggagaatactgcagctctcccctctccgccaagaaaagggaaaagagaagaagaaagagaagggaagaggatgatgctgacaagtgggcccttactatttccttctcactcactcgtgggtgccatattatttttttattttttttgctaactaggacgtcacgtcagcgaaaccggacgtctatactgcctagggacttttttttggacggttttacataattgaggggtacacatttctggtttcgtggttaagggacctcaaaaaatctcgctgttaagttgagggacctcgggtgaacttattccttaattttgcgctagttgggccaacgtataatagtccaattttcagcccatgtccgcattgcgacctccctctcgtagttcagcccaagtaaaattttgggctcattacggtcgtttttaaagtttttaaatttggagctcactagaggacactgataaaagtatgttaaaatcagcatcaaatttaagttgaaaattcaattttggttttagctttggttttgacttattagagtataatcaatgagggtcggaatagattctgcttaatctagacgagactatcatcatgcaagtctagctaggtacgacctacgcgttggccgtgaccgcgaccttgaccttcatgcccgcggtgcagtggtcccggatgctgcagatgaagaaggcctcgccgccggcgagcttgatccggtcgtcgccggagttgtacaccttggacggcccggtcaccgtgcacccgccgtacccggcccggtccacctccaccacgttgtgaatcttcgcgtcatacttgaacactgcgtatccacattcatatgtatttatatatcaaactcatgatcaaatgggataaagtcg

SEQ ID NO: 44118 - DNA, 888 bp, Oryza sativa
  unsure (1)..(888): unsure at all n locations
nnnnnnnnnnnnnnnnnnnnnnnnnnnnnnnnnnnnnnnnnnnnnnnnntattataatttaaaaaaatgagcaggacccatttgtatcacacaaatataaatgtgggccccacaagtcagccgtcttcattcttcgtcctccctctctctctcccccctcatccctctctttctcaccccctttctcctcccctttggaggaacacaacgagtagggacccagccgccggcggcggcgggcaggggccggggcggcgccggagctgcggaggaggaggaggatggactggtcgaaccttggcggggaggggccggtctctcatcgccgagcgcgtggcgggcttccttcctcggcggcagtggcggcggagcgtgcggaggaggatggattggtcgaaccgcttccttccccggcagtagcgcagagtagcgacgccgtttgccgcccgccgaccccgcccgagatgctgtggtgggaaaggagtgtatggaggcggagtaatgttcgcggcggatgaagagctcgagctccgcgacgtagaggggcgccgccgccacagctggggacgcgcggtgcagagcgctacggagtccgggagggaccgacgggcgggaggatgcgatcaagctcgtcgtcctcgccggagggggccatctcatcgggtgaagcctcgtcgcagaagttgccggcagaccccgtcgtcgtcgtcatttatggaggcatccaacgaagctcacggctatcgccgccactcccgcctctgccgccgctggttcccgccgcatgccgggagagacagacccacatgtcgcgcgcgccgacggctcccttgttagaaattaatcttgtnnnnnnnnnnnnnnnnnnnnnnnnnnnnnnnnnnnnnn

SEQ ID NO: 44119 - DNA, 764 bp, Oryza sativa
tattattttggaaaggtaaaatgaccatcatctcctatttaattggtggtttattgtcggatcgactcaattaaaggtatgtagtatgtacaaaaataaaatctaatatgggctctatgtattaatacatgtcactatactattatatcctattatatcctataatagtagaaattatatcctataatagtactataatagtagaaataacgggatcttttaattattagtgctctatttttttctattatcattctttcgttttctccactatcgtgcaacaaaaaattccgttaataagtgataagaatcgactataagccattgccatacgcaacaacaatgttaatttctgttttatttcctttctctcgtcaccaaatttacttgatgaaaactcgttattgaacaccattttgctcaattgtcatctgcatactatttttgaaactgaccaatcaggcaatatctttgtgattgagatgaagggatatgctaagatgtccaggggaattgtccaaatgctaagattgaggcaaaaggttacatttgggatgtctttatctcatccaattaatccacggataccatgaaattaaatgcttggaattaacgccttctatatatttcagtgaacaaatcttcagatatagaactcccattttgccgaacattaattaccaaggtgcaaaaccgaatcgcccctataaattaagagggatcagtcgcacctcgccgagcccacattcagatcatcaaccaca

SEQ ID NO: 44120 - DNA, 735 bp, Oryza sativa
ctgcaactctcagctttgctagctagctagaagcagctatatatcccttatcctcttatcgcctctcaccctctagcttccctctccactgcctccctcgctcgctatctcctgcctaagcgctaagctaagcgacctgcagttctgcaatgctaaggccaacgtagagctgccgcttaatcccgtctcgcttgattggtttctgacaagaacgagattatcgagaggtttcaattcattagcttagcttagctaattagcttgagggacgccagccatggcgcccaaggcagggaaggccaagccgcacaaggccaagggagacaagaagaagaaggaagagaaaggtgcagcttaactgatggctaactgaatcttcttcacttcccatctgaattttcatcgaattcatcagctcggatgattggtttaatttaattcgttttcaagacaaaagttattttcagatgcaaggattaattaattaagctagcttgcctctttcaatatttgaaagttcatattgtttcagtattaacatgtgagtggtttttgcgtggaaatattgatatgatgctgctgcagttctgcccaccgtgctggacgtcaccgttgagacgccggactacacgcagctgacgctcaaggtgagcgccggggcgcgtattatctccgtcttctcgcatggatattttcgcgtaattaattaattaatatggaccacccagtattctg

SEQ ID NO: 44121 - DNA, 1263 bp, Oryza sativa
aggctcacataaagagaaagcttacgaaagaggagagattagaaatggtgaaggctggaagagaggatagaggaaaataccaagcaagaacagctgtgaaacagaaaaaggtattcgtttatatgatcctcctttttggtgcttattttgacctatgttggctatatggcacaaccttgtgaaatctgatcatgaattgttctttcgtagttgcttttattccttctctacttatatgcttctcattgcgttttagaccggtggcttgagcaataggcagaaacaacacaagaagaaaatgcccctcgctgcaagcagagcgaaggcagcgcgttctcgacaggagaagaaaaaactgcaaaagcgctcgggaaagcaattcagaggacggaaggcgtggaaatgagggattttttgtacttgcgtttgccaattcttgtggtctactggccaaaattttgactccttcagttaatgattttcgtatacaaatatgggtttcacaaaccgtgtatcatcgatttttcaagtgctggtgtattcttttgtgagtggagagaatgaagccggtatatcatcgctcacagtggttgctctatgaatttggacagtactcgtatccaggaagttcagcatcacgtgtcctcctggccagtgtctatacgttgcagtgactccagcgagagccacaattacgatatgataaatgctgtctctgtttctgctttgatgagactgtttcgattaggccagcaacctcacctctcctatataggctgtgtttatttcagcgtaaattttggattttggttaaaattagagatgatgtggctgaaaagttatgtgtatgacaggttgacgtgatgaaaaagaattgaagtttagatccaaactttggatctatacacacagacggattcagatcatgcgcagttatagctattactgcaacttatattctgtgctacagtatttatgctacagtacgatgaatagtgcacctcgctgatctggaccgttccatctacatcgttgatgaaaactggtaccgcctaaattgcagtcccagtagcgactgcagctgatccggattcaacacggacatagtacaccctcttgttgcttcgatgagactggtccttagcacaatcatcaaaccactaccattatatcagtgcttggtgttctattgggttaaggaattctcgatcgttctctgctagtaggaaatcgagccgactgaccagcgatgtcggcggttga

SEQ ID NO: 44122 - DNA, 1283 bp, Oryza sativa
cttgtgagaacgtagatgagaatacatttccatgcgggggcattccccgttgacattcctaattgtatctactggttgtcgacccgtgcacccatatgagcaacatatatttcaatataatatagttttagtaatttcaaatataatgtaggtatctcacaatttccattttttcctctagtatatttcttcaaacaagaatgcctgctttgttcaaatagtttttgtgatcaattttttttagacattgcctcaaaagtgtgtgtatatatatatgatggttttattattattttcttgcttgatcatattcgtgcatagttgaaaaccggtcattgttcaattcagtgagaaaattccctataacgtgcttctaaattttcactctatcccttctctacaccatgagattcggccactctaatattttctttaataactgaaaattattattcagtgaaaacggggcagtatatatagttattttggaaaaaaaaattagtcagttgacagtcaactagcggaataagtgggtagggcatcaatatacaaaagtcagggttaaaaaaaagtgttttacaatattttctactagtagaatcaatctaaaccctttatttttcctaatccaatagatcatagctatttacacaaccacatcaactacttgtattacaatatttttttttctgctggtagaactcgtaaattaacgattggtatcacttctaatatgataatactgatagaaaaatactagtagcaaagagcatcataatggtcttaaaaaagatggcaaaaacttaggaagattaaagaaattgtgaaaaattcagaggcattaagaagaattttctcatccttaatttaccagctgtaggtaacttcctccgtttcacaatgtaagtcattctagcatttctgttgacagaaaacatgaggcctgggagatctgcttaactccagtgcaggtccaaagctcgccttcgaatgtatgagcgtgccagttgatttgatcctgtaatcaacaagaaatagagacaaagaattcgtagttaaatctataaatgatagccgatcggctaggtgccgatgacatatcatttatctttgagccgatgtcatatataaatcgatcggcggttataaatagacagtgaggaactaaatctattcgatcggctgtagatattaaagacatatagttcttatattaatatatacttaaatcaagtgattgggatagatcggtcatcggtcaccatgccgagacagtataaatc

SEQ ID NO: 44123 - DNA, 751 bp, Oryza sativa
tgttctgtaaagatttaaaaagttatatataattgtcagaactatcattacttagtacttttagctttctgctgaagttttatacatgagtgtatatagttggaaccagcattcaagtaggagaattggaacccagatgtgcaatagtttattttttaaacacaatgtctgttgtgagttccatccgatggttaaacgaaaataaacgttaattcaaatttagagaatgttggttgggtgcttgcaggtaaggatgatgatgttaaaggttatagcgaggactattgggctgcatcacttggttttgttgaacttctatccatatcttcaaagatacgttcaggtatgttcttaacttggcatgtgttcttcttgtagcaaccttatggtagatataatgtttatctatactctatactaatataaaagatggtagtggtggtggacccacggactgtgagttgcgtatctcttagcccccacatgccatagatcccgtcgaaaggaaaatatgacaatagaatattatgaaaattttcatctttacgaaatgacagcaaaattagcataatgataatataatagacaattagaaaaaaaaaccgttgcacctcacgtgcattatactagttcatactagttttgataataagttttctacctttctgtgatgcagcctcatcaacgagatgtaacaactttacttgctgcagcagtacaggcttgccatgatatggttgaaacacttttg

SEQ ID NO: 44124 - DNA, 742 bp, Oryza sativa
atttcagaactggagacttagagagcatatatatatatatatatatatatatatcatcagagatgagacaacacaacatgcagtggtgtcgattagagaaagcgcgctaattagctagctgttcacctcaggattctgtgactggaaattcaccggagcggcgacgaggaaggcgtaatcgcagccggcaacggcatcgtcgaagctgccttcttcgtccatgtcagcgcggaagacctccaaggggcctagtgcttccaagtccttgagatgggaagtcttcttcatgtcatctgaatacacaagagtaggatcttcagaggcagaactgaactctggaaactcgtagtagcgtcgtcttgagaattgagatcataacgatttgcatcctttccagcatatttcactatatgaattaggtgcgactatcggtttgaacatgtaaatattttctacattatctaaaaaaaatattttctacatggtgcaggtaagagtggcatttggcatttgctaagtagaagggaaaattctattcatcctcaggaccctggtgctctggtctcttggcagccgtggaaggaacggaacttctgggttttgactcggtgctctcttcagtccctgtggtcctggaatccatcctctcggagggtcatctgtggtgccacttttggggattttttgggagtgtagcgtggctatgccccttcccgctgttaggagttgcgtttagccgccg

SEQ ID NO: 44125 - DNA, 1646 bp, Oryza sativa
ggcatgcttctaggttctcatactcctcaccgcgatataggatacaatcgtttggacatgcgtgaatcttatgaacttccagtcctaacgggcatactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaactagagttttccttctcaactattttataaaaccttgtttagcaaatgaactaaatttctatatattctttcttccccacacacattttctctctcatcaacttacaactaaattttggagacaaaaaaaagtgtgcaaaacataggtgcaaatgtagtatgacaaaaaaaaacattggaggatgaagttgcaaaccttttaggcacctccgatttatatgtaatcaccaaaataaattcaatagaaattttggcatgacctcccctcttttttgaagaaattttaaagcttgttcgggcagctggaggaggaagaactggagaagacatatatatataggggtgggactttagtcccggttggtattaccaaccgggactaaagatcccggtcatctttagccccggttggtgctaccaaccaggactaaagatcccggggggggggcctgacatgacctaacagcattcgaaccgggactaagatgatctttagtcccggttggtaacacaaaccgggactaaagatcaaatatgcccgttacccttttgaaccgggactaaagatcatctttagccctggtttttattgcatccgggactattgtggaaatcggccgaccgacgaaagatggtttctccaccagtgtatcaaaatccacagagacccacgtgacagtggtggcgggtgatagtagatcgattcaccgctcatcag

SEQ ID NO: 44126 - DNA, 8626 bp, Oryza sativa
atatatatatatatatatatatatatatatatatatatatatatatatatatatatatatatatatatatatttacagcatgtggatgtcattttatcttttaggaattatttgggctacctcattggatgagcatatctaggacacacaaaataaagcatatcatcggcgtaagattaattaagtattatatatattacataacccgtgcttatataagaaaaatatataaaaaggtagaatctagctatttatttatacaaaacccgtggatatattatttcaacaattatatatatctattcaagtaatccctcactacgtacgtacaccagagttatcataaaggaaaaaaaagaagagtgtgtatacgatcagctgcatcaagtagttttctttctttctttctttgcagctatgagattttcctcgaattgtgcatatgagtagcgaccactcctgacgagattgtcgaagaatccacgtcgccacagcaccacttcacgccatctcactaattttctaaaaagtatttgtccatgtttgatgtcacaattctggtatttgcatggtatggggatcgttggtgctagggtatacgcgagactgaggtaaaagaggcggagacagggatttttatacaggttcgggcccctgaattgtcaggtaataaccctacatcgttttggccgaagccagtattgctcttattcatgataatcacaccagtacaatatttggggtagcctatctaactgttgtcgacatggcggtctgacgatctgactcgtagtcgacaacagggtagccttcctcctcgaatccgtgcccggcgagatcagagatagcgctttcgtctctcctgacagtatccagagacaccgtagggtactagccgtgcttatccctgaagtcgatatccggcggcgtgtcttggcgtatgtaggcttctatattgtggcttctatgtcgattgtgttgggtgttgatcctccatggtgggtgtccccctgtcctcctaggggggcttgtatttatacccataggtgtccccttgtccaagcagaacgaatgaaaccaatatggatacaatccgggtagtccttatcgtttccatgtagaactctgggtgtctttccttatccggaactcctcctatatccgaaggttgtttccgtataggacatagtatgtggtgggccctgccgagattcagtcaactattattaggtatgtggtatccataaccctgacaatattttttttactaattatataaaaggcattcacgagcgcatatataaatgtatgcacatccatcatataaatacacatacgcacacctacactaagagaaaaaaaatttgtctccaaaagagaggaacaagtacgtgcttagtatttgccagaaaaaacatatacacattcaatgaaagtgtcttatggaaccacatcatatcttcttttaattatgtcattctcatctatataatgttaataattagcacaaataattttgacaatatagattattctatcttataatacccatgaacatgcataggtgaatcaaatgtataataaaagaaaaaaaaacaaaaaattatgaactcatatgtttacaaacaatgatgataaatgagtttatatataaccgggacaattcttaccgtcgttgtagtttaagggtgtaattcagactttttcctttaaaaagtcatttccacataaggatttataataaaattttaatcatcactaaataagtaaggtgcctgcacatgtgctataaacgctctcaagtcgtcacgtggcactcctttaaatgctcctatgccaccacgtggcattttaataaatttaagaaaatcacaaaaaaatctgagaataaacaaaacatccgtccatcgattttcactaacatgcagtggacccgttgttttctatcattagacttatttatccaaatagataaggataaaaaaaaggcccccatatctcaaacctctcctgtacttactccaaccagtatgtaccttcccagtcccaccaattttccttctctcctatttttctcctattttcatcaatttgttagatggaaaaaatatttataacccattattttctatcattagatttgtttatcaaatagaaaaaggaaggataagaaaacaagccccgcatatccacccctcccattcagtacatacgtgcctccccacctattttctttctcccctatttttctcttttagttagatggaaaaaaatgttttatgaaaactaattttaaacaactatattatctaaatcatatagctactttttaattggtgcacaccattagattatttactataaaatttaaaactgaagatctaagttaagtatattattaaagaaattcattactttgtgtcatatatatactacggactaactattgttcaccgattcatacattttgaagaaaatatcaagtagatttttaaaccttctgattaataacatgtacttcgactagaacaatttaaaacaatctaagtggtttaattagaaaatacaacacccaaagtattttctaatcgatctaaaattaaaattaaatgtatttataaaaatatataactcaaaactaggacccataatatctcttaaaaaaataatatcctaacaaccaaaaatttattaaaaatatgtattaattaaactccctcgcgagcgttcataagtcactctctatcatgtcctaagttaaaaatacaactaaattgatgtatccattatttttaactattagatctatttcttaaacataatcttgaattgtggtgtgccacgtcctataaagcaaagaaagtatcttagaaattcttaaaaaaaagtgaagcaccccatcatcggctatcacttaaatcatttagaaaaattacaaaaataaaatctcttccacctcctcctcgccctcacatgcgcacaacactgcccatccccttcatattgtttagatattaaactaaaagaaaaacaatcaataatgtttgatattttttagaaacatattacaaatataggcactcacaacacatgcacactcacccctatgaatgcataaatacatagcctacccctatgaatgttttttttgaaacacacaacaaacgtaggcgctcacaacttaatggacgcacactcacccctattaactcccaaacacataggttacccccatttgtgtatctccaaaagattagacgacatattttgagatttaagaaatcaccacgggcgtctcgctgtcgatggatacgccacccaccactgaaagaataattagtcgtaaatgcgagcacccatgtcaaagtataggacttgaacccggtggcaagttctaatataaggaaactaaccagttgagctacactcactttacaataatattgaattttaatcacacataatttttaagctatatttttggaatagtcctatgccttttaaatcggtggaaccattatttcttatcgttggatcgatcttatataaaaaacaaatgtgtattcatgctatagtaatatgaatactataacatttcaaaattaatacagcacaattatgttgtcattatagtattcatgttaggctgtgtggagtgtctgaccttgtgtacatgaaatgtttatagatggatcacctctcaaatacatcagttatattaggctatataaacccatacatttagtggagcttcatgtcccacccaattctcctctattaaaccatgataatatatatgcaattaaaaaaaaccttactttatcttttttttgacatgttttctaaagaaaataattctacctacttttcaaatgatggagaagattataaataattacttgtagatattactaaaatatcatataagataaagctcataggttagaaaattataaaagcaattaatgccaacaaaaataatttatggagaaatcgtagcagatgttctctggttaatattttgctgctataagtgtccccagcttagcgtacgatgcatgcccgcgcgaatgcgtgggctaccttcctagtttagaaaaagtagctgtgccttatattatggaatagagggagtattatactataatccctctgtacttataaaggaagtcgtttaggacaatgtttaagtcaaaccttgggaatataaatcatgaataactctcaagcaagttgttaagtttgaaaatataaaaattatatgaatagatttatcttgaaaaatactttcataaaagtatatatatatatatatcacttttcaataaatatttttatagaaaaaaaagttaaagttgtgttttggagaccgtgtcgctgttttaaacgacttcttttacaaggacggcgggagtacgataccttttattatcacgagttaaatctgaactgatatcgatgtgttatatttattttgtttatgtttagatagagagaataagccaacaattactcacccatcattgctcacgcacgcgtgctgcccgctcgtgggccgtgcgcggcgcggagagacgtacacgagcggttggccgtgccgctcgcccgccctcgcgcgtggaagtcacgcaggctcgcggggaaaattgctgccgcccaccgacgatggccggtcgaagtggacgtcgaaaccgtgcgcgcgagcggcagctggctgctaccgatatcattcaattcgatcgggccaaaaccgacgatcgcttttgtcatttgcccttgtagatcctacgctaatctagttggcaatgggaagtttcaagggtagatgactcatggtgtgtcagcaggaatcgcaaattccaggtggaattgaatgagtgtgctgtgacacacttgacagcgacgtaacttgtagatagtgatctcgttgtacattagtacatactcctccattcttaatacatgcagttcttagagaaaagattctcattttcaattatcttgttagttaaattttgatttttaaattgtttggatgcctcccataagcacctaattggctgaaatcactactggagaagtgatgtttgttggttcggtccatttccacaataatcctagttgctaaaaatcgggagtaaagatctttactcccggtttatttgtgcaagaggactatgcgatctttaatcccggtttggtaacaccaactgagacttgatctttagtcccggttcaccttgtgtcaaaggctgtcaggtcctcagagatctttaatcccggttgactaaagatcgatcctaactttagtcctggttgttgttccccaccgggactaaaagtttttatagatctttaatccctaaaaatcaatataccttatataatccctttgcacttatcctcaaaaatttctatctcctattccttctcactcttatcctctctttatcttcctattcctcctcctcctcctttctctcacacagtcttatcctctccttttctcacagagctggcaaggtgcgggcggggcgcggtggcggggccagcgaggccggcggtggggcgcagcggcggcggcccgcgcgcgcgaaggaggaggccgggagggcggcgggagacggcggcgggctagcgtttttttttttgaatttgtgattggatctgagatgtatttgatttgtgtgtgatgtattcatgtgatgtatttgtggtgatttttgtataacttgtgatgcaatgttttataatttatgatgtatttggagattatcaatttgaggatttggagatatcttttgttctgtgatctgttggatttgtgatctgtgatgatctatttagggatggagtgaaatcaatattcaatgttaaaaacaataaaataaagtagcaatcggtcctggcctggctacatcttaccgaccgggactaaacatgcatctttactcccgggtatttgaaccggcattaaagaccgccatctttagtgacggattctcccttccagttcgctacccgggagtaaagggggttgcgaaccgggagagaagagggtttctccggtagtgaatactgaaatctttttttttgaattaaaaaaaatactcggattcttgtgtattagaattaatcaatgtccctgaaatatttatattgtgtaaactccaaatattagaaatactaaaatttgagaacggtggagtatatgctttcgtctattgattaagaacctacgtcatgtatttgatcggaccagtcaacttgtaagccgtatgtatcacggcgttgcaaaagtgatgacaaaaatatgatacttggtgtaaccagcatcctcaaaaatattaaacccgaaaaattccaaaatattctagtaagccattgtttcgattcaattcaaggtttatggagggatgtttcactttttttttatctttttagtaaacgtattcatagacttaaacaaacttattctataaataatcgttttcgtggcacaaacaacattggcgtcgtggttcaacatgacaacatcaaagacgttggcgtcattccctagcacccaaatagaaactaagtcattaatgtgtaggggatagcgccaacatcattgacgactaggatatatttgtatgtttttttgaaaaagtacctatttatagaaaagcacttatttgtaataaaaatatttataaatagatccttgacgcaagtgactgtgccagcgtcactgtactgaggatctatttgtaaatatttttttattacaaataggttatttttaattattttacaaataggttcttggcaccaacaatattggcgccgtccctttcacactacagtgacttagctttcacctggaggcgaggggatggccccaatgttattccaatcatcatgttggaccacaacactaatgacgttggtgccgcgaaaaggagtcgaataagttgttttagtgatttatttgtagaataagtattaaaaagaccaaaaggtgaaaaatccagggtttatgatgccgaccaatagagcttaccccaatgatactctcaaccagcttcacccctgcacaggaagaataaagatgatattgcaaatattggtaatacttagaaaacttttacggtacaatatattgccagtatatactggcattatatagacgggtaaatagtattatggcagtatatagatgagtaaataggagttttatagaaaattaaaataagactttttgagtaatttcatggttgagagttaatacggtctagttaggacatactcatgctcaatcactaaatattttttataaaaataatagtctaaagtaatggtctattggtttaaatataatttagtcaatatagatcttaaataatgaatttagtgggtatagaatataacagtgtaaactttattttcaaatagcgtgttattcgaaaataatagaacaaaataatgggtcttccgtttaagcgaaaattatcttataatttagtgggtaaaaattttcagccatgtccctgaacaaaagtgcataacagtacacccttccttcatgacatcacgaccctcttctcttagcaacccggaccattgtcgagcacagtacaccctttaaaataattgttttttagtaaaataattgttttttagtaatttcaaaatattcgagattacaaatgtagatattgacagtttgatgtgttggctgacttgaattatttatttttggtaacattagtaatgtagaaaattaaccagccacttgatatgctttagtgaaaaataggatttagttaaagattagagaagtacaacctagattaaaggtcctcctccccaggttatgtgtaatatacgtggtcctcaaaatttaaagcctgatgattattccctccgtttcatagttttgactttggtcaaaatcaaactgttttaagtttaactaaatttaattttaaccaaagtcaaaacgatttatagccttccccgaaaaaaaaaagatttataacatgaaacgcagggagaagtagagtcatgtaccacaactccagtaccacacattgtcacgttcagtgcttcctgtcaattcttacttcttcgccaggattggttaccatccttgcgatcgatacggtatcacctcattccagtttacgtgcgttcaattattggcgagtaaagtttgatgatgggcaccgtacattatcttcaaatagacatcctaataatagttacgtaccaaagaaataaaaaaaatgtccatattcaaaatatatatcacttagaataaggatcgaaaaggacatgagcaaatcaaaagtaaagttgagatcgcagctcgaatcaccacctgatacctcaaatcttgctagctacaaggacgcggcaaagcaaacggttgcagaatccagattcttctttcaaaaatggtccgtttcactagcatccagcaggaacccgccctgagcggtccaccgtcctagacacaaacggcagcgcgaacccactaaatagatccatgccactacaaatatgttgattcaaacaaataccactagtattcgtgatatgtaatacatgccacgggaattttgaaaaattggaaccatgc

SEQ ID NO: 44127 - DNA, 1344 bp, Oryza sativa
agcatttctggaggccgacgtcgctgaagacgacggagaggaagacgacagccgagaggaaggcgtgcacgaagtcgacgtaccgaggtcccgctaatcgagctcgggctctaggtccttgaacagcttctgctcttctttcttgttcaggttgaagaggttgagcctagtcggcagggcgaagccatagtagaccttccccttgtagaggacgctgtcggtgaaggcgaagaagacgcaggcggcggagaggaagacgacgaggccgaggcttagccaccggttggcccggaagcactccccctggttggtgaaggacgccgacagcgactggtatgccagcaccgtccccgtcggcagaagccgcgccaagttcgccaacaccgcaccttgtcggttgccacattggcagcgtgtgccctcgcctcatcgctctcgctgattggcagttttggatcaatattggcggccgatgctttgtcttccttgttctgcggcgccatcgttgctggccgtaagcccttacttacctacgttctccgatagtgtgtgtcactgtgtgtaatattgtatagtaggtgtttgcatgcagatgcagctccaagagctttgtgtgtgtagtgtgtgtgcatgtgtgtatgtatatatatagaggtataagctgtacagtggtcagtggggcgtcactactgcgagcacgcaaagggcaaattcacgtaatattttgctttataccttcagcctggaaagttaaaaaaatggatacgtacgcacgtttctttagttgtgcgatttgtttattcaatttgaaggaggtttgacgttctgttcggggtaacaatgattaagatatatgcacactggagaaaccatctttggtcggtcgaccaaatttcacaatagtcccggttgcaataaaaatcgggactaaagatcagaaggaggtttgatgttctgttcggggtaacaatgattaagatatatgcacactggagaaacgtcggtcgaccaaattccacaatagtcccggttgcaataaaaaccgggactaaagatgatatttagtcctggttaaaaaaatttaccaaccgggactaaagattatttttagtcccggttcaaagaagttggtgggtacagttaagctccaattatctttagtcccggttggtataaacaaccgggactaaagatctatttttagtcccggttgtttatatctaccgggaccaaaataaactgccgatatctcctcggtatcccctccccttttttctctccttaaaaacaactgagacttagtctcggtatccgcctcctccccttcttccttcttcctctccc

SEQ ID NO: 44128 - DNA, 1097 bp, Oryza sativa
tacagtacttcatgatggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaatctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcaccaaaccacccggtacggaagaaaggcaagcacttcgaacataaggccgaccaccgtacgaagcctaaacatcgcagcgggaaaatagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgat

SEQ ID NO: 44129 - DNA, 12950 bp, Oryza sativa
cgatcaaccaacaacttgccttcctggcgaggggaccgtctgggtcgatcgcgacattctagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgatcttaacaaggttggatactcggaagaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttgtaaatcacacaggtggcaatttcatatgtatgttaattagagtttttaacatttaatttactagcattcatatgctaattataattgactagaggatttttaaaagttttaaatcacgcaagtggcaatttcatatgttaattagaatttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatatatattggaatttttattaattataagtcatatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttctcaacaaccgcgactaaagatatctttagtcccggttgttctcaacaaccgggagtaaagatctttaggtatatatattcccggtgcgccctcgtcttcttcacaaacacttagacgttttcggccgatcgatctctctcggcctctctccttcgccgccactgcctagggcaaatccccgcgccgacgccgtcgtatctcgccgtcgtctcgagctcgtcgtcctcgccgccgcctccgcctcctccgctgccgccgcatctctgggctgagagccgccgccgccagatctaccttcatctcgatctctccgatctcgatcgctctccgtcgcgccgcccgccacgagacgccgcgccacgacgacgacgcgccatgccgacgccgcgccaagccgccgccggcacgccacgccgccgtcttcgccgccgcgcgcgcaatgccgccgccggcacgccacgccgccgccttcgccggcgcgcgcgcaatgccgccgccggcacgccacgccgccaccttcgcccccgcgcaacgccgccgccgcatgccaacgccacgccgccgccgccgtgccacgccgccgccgccttcgccgccgcgcgcgcaatgccgccgccgccacgccacgccgccgccgccacggccccgcaacgccacgccaccgccgccgtcgccacgctgccgccgccgccgccacgccgccgcgccaaccgccgccccgatgccgccacaccgccgttaacgaacgagaacgagaaggatcgaacgaagacaagcgagaacgagggaacgaacgtgaaggagaacaagcgaacgaacgtgaacgagctagggaacgtgaacgagcgaacgaacgaggacgaacgttaacgtgaaatgcaatatatatatatatatatatatatatatatgttacttcgcatttatcctaatacatctttttgtatcttgcagaaaagacgtgttgtcggagtgtcgttcgtcaagcctgagtggaagagctagccctagaagtaattggagcaggcaagtgacgtaataatataaatgattgttatatttgtaatgcaattaattaagattattagacctgtaattagacttatcatataagattgtgtagtggtctaatattatttgagtttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactgcggaagtggtgcgacaagtagcaattgactattgtagtcttaattagacttagcatatacgcacgaaacacttagcatacatgactattctagtcttagcatgtaatattatttgagttttaatataagattactttatttgtaattagacttagtatgtaattattgactacggaattggtgcgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgtgggcaacgaggtgcaacgaagaagcttgagggtcggcacatcataacggaagtggaagaagatggacgtcctagtgccccggccgaagccgccaagaactatgtacgtcatagcggttgggttgtgcgggataacgtgcctgtcagtacggtgtactggcgaagaacaagggcacgcagagatcatgagagctttgtcccagattcggagaaagagatgctgtggaccacaatgctcgagacattcacccttcctgtgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagctcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagctaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgcactgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatctcgctacgaactcaacatgcaagaggagatggcaaggaaggttgatgaacgcatggccgcacatcggtcccatgatccccagccgaccattcctcctgcaatggtgagcccgtcaggaaaccgtagcagctgcgcctcaacggggcaggtagtgtcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggaccctttaggtacttaccactgcaggccgattccagcaggatactcgaaggtcgaagttgagttggtcgaaggcgcgtacgaggacctcgagctggattaccctggaggagacggtgagatgcatctacgagacacatgccatgccattattctatcgcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctccaccgcctgcccacacaaggacccgaggtacgattgcacgcaagaggagcttgacgcttacgttgcatcagaagtcaagagacaattcaagcctcgaagtccagaaaagaagattcctatagaccccagtgtcagaaacttctttaggggtatgtctgcatctgtcaaggaggccatcaagctatcggactatgagcgaatgctgaagaaagcatcttctggaaagtccaaaccagtccctcagcttggagagcaaccaaaccaggagatcgagcagttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggacatgagcgccaccggtagagagatgatcgaagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaaaggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacatagagttagtttaattttacagtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccatcatttggtccgcggcaaatggagagaaagacttaggcggaagttcaaatttcctgtgagtacacatgctctacatttatatttctccgattcaaatacatacaagtgtatattaatttgatctctcgttgtttgtcatttatttgtagtgcgcaaagcaaaagcagggaactaacttgtgcggcttttacgtgtgcgagtattgccactgccttgcagaccaaatcatcaccacaagagagctcgatgtacgtacaaataaatttaaaatttcattacgtagcgatttcttgtttaattactaatcaatttcatacattcatatagtttattcgcatgagggataacctgaccacacacaaggaatttatcgcggcggttcaagaacaactcatgggattcatcaacaaagaaatccttgatcccaagggtgaattctactacgacggaaacacaattcaccggtccttagcttctgagctagcagcgactactactacgtcgaaatcgtagctagctaggacatataatggattgtaattaatacatgactacatatgtttctatatacatgtgtacacattttctataatgtaaatatattttggtcatatatatatctatatacatatgcatttgcatatcatatatatgtataaatacatatatattatgcatgtatatacatataatataatatatatatatacatatatatatatatatatgtatgcatatatatgtattgaaacatatatatgcatggtttatatataaaccatgcagcaaaagggccatgcaaaaaaaaaaggtcagctcgatctttagtcccggttggtaatggctcagccggccacgtggctaagccatctttagtcccggttggtagatcgatctttactcccggttatttcacccgggactaaagatagcgatctttagtcccggattggtactcccggtttggaaaccgggactaaaggggggttacgaaccgggactacaaagggtttctccaccagtgatacttttccaatctcaagccatcaaacatgataattttcttttgaagtgaagcaaaataataacaaataatatgataagaagattttatagtgagaataattttatttgattcttgagactttaaagcgtacaacaggttctgttatttaattatattgcaacacgtgagcattcacctatttattttataggaaggaagaaataagccatatatcccattgtggatgagaagttggagatgatcgaacacgatggataagagggtggtttttgaccatcaccgaccagtgacgaggcctacgacctagctatggacacacacggcgcggcactgtaacgaatcacgtaacctaaagcaaaactccacagtatgtatgcatggagccccattcgtccgtccctgcagctgcagcagcatttaccttttttcctttctctgttcctgatgaattagttcaagatggataggaaattaggagtaggacagggcaaaatctttcttgcctcccctagctacctagctagtggaccgggcctagttccttttagcaaagtaatcgatccacttttctctacaatgcaggggtgacctgatttcctaaactgccggtaaccacgtagttaccgcgcttactgtggatatgataaaagaaaaccacacttactgtggatatggtaaaagaaaaccatagtaacctccttaaattcaaataaatttaaaaataatttaaaattttaataaattttatattgtttcgtacagcttctcatggttaccgcgcgataactgtgcttactgctggggcccagtaaccccggctccggtggtttgggtaaccctcttcttgcacgttcagtgtgacagtgtcaacaaagtcatcacaagagagactgtatttttgaggcactaggtaaatagaagaagctcgctgttcacacaggcatgtttattgcaacgggaagaaaaggcaaaaaaaaatgaggaaaagttaagaaagattcacattatacaattaattaaaatacaaatttcccaaaatacttgggtgtgtataattaaattaatttacaagtaaaataagtgtgggaaataaaataacatggctggattttatttttattaaattatccgtgattaattgcactctctaaattttctcaaaattttcagagcttaatagctagtctattaacttaataaagtaatagaaaaaaaagccaccatgttcattctcgcggtctagatattatcacgttaatcgaagaaaaaaacaaaaaaaacaaatggacatgtattcttttggaaatgtgacataccagaaacacactcatgcattgtataggtttaggaaactgatcacaactcttactcggatgaaaattagaagaaaaaacaaacggacatgattctttttggaaatgtgatataacaataaatacttgtggagattatggatatcccatatctatacggcgatgatatttggattgaatataggataccgagtatagatagaatatcttatgtgtatcctgggtttgtttcctaacttgtatatcaaggaaacaccttgagacttagtcggtcacgactgtattcagttagggacatgattatcttttgtaatccggactccttcctatatataaggggggtccgggtgcctttaggggcagatgttgattttctctaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacagttggcgcgccaggtaggggccgcgtcaagcttttcgccgatcagtgcaatgggttccacctccggcatcgacgacctcgtcttcccgcccaggcagacgtttcggttcggcagcctcgacttcgtcaccaacaacttcggcaagatttctctcctcgactcggaatcagaccagtcgggagagaaccgaatttcggtcccgtttggattcccgaacgcggctgaaagctacttcaagaccatctcaaccgagtcggcttcaaaccacccggccgagatcgcatcttctctaacgacaccagatcaagatgatggggcttacccaccagtcctgatgaagctccccgacgatttagcggccgtctccaccacgactgcggcttcatcccgtaggcctaggcggaagtcggcttcaacaccgatttcgcctagcttcagggaagtcggcgtcatcctccaaccactcggcacggtttcgacggatcagctggatgactacaacagctctcccaccgtcgactcacgtcctactgatatcgtggagtacgacgaatttagttctcgctacaacgacttcgacgacttcgacggaagcctagatgacaactacacccctctctactttggcgttttcatggccaataatgagacggaggagcaacgccaagcccgggagaccgaagaacgtcgccgactggaggaggagcatcaagcacaagaacaagaacggctacggcgtgagcagcaggaccgtgagcagaccgcgaaggaggctgaggatcgacgtcagcgagctttggaagcagggcgccgagcgcgtgatctcatcggccagcaagatgtcgaagggacaccggttttccgcacccctcaacagaatgcggttgccgcgatcacccttctcgacatcctcctcaaccaaaacgagctcaatcgatccgaccacgtcgtcaacatcttgaaccagacgaagaccatgattgcggcttcggtcccagttaactccgaaagcgtccacacaccgactggcagccgagttccccacttccgatctcatgactaccgtcatccaagcctcagcatcaccggcgcaggatccaaccgcaggagcaggggtcacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccagaccgccacgacgacgaccttgacggagtagcagccttcaccgacgacctgcgtcgagtggattggccagccggcttcaaaccgactggaatagagaagtatgacggcaccactaaccccgaatcgtggcttaccgtctacggtctcgcaatccgcgcagcaggaggagacaacaaggccatggcgaactatttaccagtggctttagcggattccgcccgatcttggctccatggattgccccgtggtacaattggatcttgggccgaactacgcgaccacttcatcgccaacttccaaggcaccttcgagcgtcccggcacacaatatgatctctacaacgtcattcagaagtccagagaatcccttcgagattacatccggcgattttctgaacaacgtaacaagatctccgacatcaccgacgacgtcatcatcgccgcgttcaccaaagggattcgccacgaagaactagtcggcaagtttgggcgtaagcctcccaggacagtcaagctcatgtttgaaaaagccaacgagtatgccaaagctgaagacgccgtcaccgcatcaaagcagtcgggtcccagttggaagcaaaacaagggtacgccggctacgggaggaggtggaagtaacaatcataaggaccgcaagcgtaagcctgcggaacttgttgcaaccgccagtcactcttcccgacagcgttcgcgcgtcaacacgttcgataagatcatgaactcccaatgcccgcaccatcctaactccaaccacatggccaaagattgtttcgtctataagcaattcgcggatcaatacaccaagactgcacggaagaactccgacgaagaacaaagcacgtcgaggaagaaggacgacggcgacgccccggcaggatttcaagaccaccgcaaggagctcaaccatatcttcggcggccccttggcttatgagtctaaacggaagcaaaagttgactgaacgggagatcaatgctgttcagcccgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccttggatgatatgcagattcctcgctccgagctaaaaccaagcaatgcgccttttcacggagtaattccaggactatccgcaactccactcggccagatcaccctcccggtcacttttggtactcgggaaaactttcgcacagagaacatcagcttcgaagtcgccgatttcgagacagcataccatgccatacttggacgcccggcgttagccaagttcatggccgtcccacactacacttacatgatgatgaagatgcctggtccccgaggagtcctatccctacggagtgacatcaagcaagccgtcacatgcgacaaggagagttgcgacatggctcaaacccgcgagatggcgtccgcccgagaggatatccgactggctgcagccacggcgagcgaaggagaagtgcccgctaccaagatttcaaagagtggggaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacacgtcaaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccagttctagttcggaagaaaacagggcaatggcgcatgtgtgttgattataccgacctcaacaagtcttgtcccaaagatccttttgggttgcctcgcattgaccaggtagttgactcaaccgccggctgtgagcttctcagttttctggattgctactcggggtatcatcagatccgactgaaggaatccgactgcttgaagacttcattcatcacgccctttggagcttattgctatgtcaccatgccgttcggactaaaaaacgcaggagcaacttatcaacgtatgatccaaagatgcttctcaacgcagatcggccgcaacgttgaagcctatgtggatgatgtagtcgtcaagaccaagcaaaaggatgatttgatctcggatctagaagaaaccttcgtgagcatccgtgctttcaggatgaaattgaaccctgaaaagtgcacct

SEQ ID NO: 44130 - DNA, 15861 bp, Oryza sativa
ggttcagaagctgttatatggtattctaattactaccaggaagctatctcactactttcaaggtcactcggtaacggtggtcacatcatttccactcggtgatatactgcacaaccgcgaagcaaacggacgtattgctaagtgggctttggagttgatgtctttggacatatcatttaagccccgaatttcaatcaagtcccaagcgttagctgattttgtcgccgaatggaccgagtgccaggaggatacccccgcgaagaacatggagcactggaccatgcattttgacggatccaaacgactttcgggcactggagcaggagtggttttgatttccccaactggagaaagattgagctatgtgctttggatacatttttcggcgtcccacaacgttgccgagtatgaggccctccttcatggactacggattgcaatttccttagggataaagcgtctgattgttcgaggcgattcacagttggttgtcaatcaagttatgaaagagtggtcctgtattgacgacaatatgatggcatatcgacaagaggtgcgcaaattggaagacaagttcgaaggactcgagctcagtcacgttcttcgacacaacaatgaagccgccgacagacttgccaattttggatccaagcgcgaggcggcgccctcagatgttttcgtcgaacacctttatacaccgaccgtacctcataaagatactactcaagatgcggacactcatgacgtagctatggttgaagccgactggcgagagcccttcatacgatttttaacttctcaagagctccctcaagataaaaatgaagccgagcggatttcaaggcggagcaaactttatgttatgcatgaatctgagttatacaagaaaagcccttcaggaattctgcaacgctgcgtatctttagaggaagggagacaattgctgaaagacatacattctgggatatgcggaaaccatgctgctgcacgcaccattgtcggcaaagcttaccggcagggttttttctggcctactgcagtgtccgacgccgacaaaattgtgcgcacatgtgaaggttgccaatttttcgccagacaaattcatctaccagctcaagagttgcaaactatcccgctgtcttggccgtttgcggtttgggggctcgacatggttggcccgtttaaaaaggcagttggctgttacacgcatctctttgtggccattgacaaattctccaagtggattgaggccaaaccggttgtcacaatcacagcagataatgctcgagacttcttcatcaacattgtgcatagatttggagtgcccaatcggataatcactgataatggcacacaattcactggcggagtttttaaagacttttgtgaggacttcggaattaagatttgctacgcctcagtggcacaccccatgagcaatggacaggtggagcgagctaatggcatgatacttcaagggattaaagcgcgtgtctttgaccggctaaaaccctatgccggcaaatgggtgcaacaactgccatcggtactttggtctttgcgaactacacccagtcgggccacaggccagtcaccttttttccttgtctatggggcagaagcaatgttgccgagtgaagtcgaatttgagtctttgcgctttcgtaattttcgtgaagaacgctacgaggaagaccgagtagatgacttgcaccaattggaagaagcccgcgaagcagctttgattcggtcggctcgatatttacaagggttgcggcgctatcataatcgcaatgttcggtctcgtgcctttttagtcggtgacctggttttgaggaaaattcaaactacacgagatcggcacaagttatctcctctatgggaagggacatttattatctttgaagtcacccggccaggttcttatcgactcaagcgcgaagacggtactcttgtcgacaactcttggaacattgaacatcttcgtcgtttctacgcttaagtttatcattgcacttccctatcttgactgtcaacatcaagttttcttcttgccgttgtcagtcgggggctatcatcataataatggagtgtgattttttatcaatttaatttgcttacttggtctatcattaccttgtttgattttttctacttagtctgcgaggactgaaagtttttaatagcttctttgggttttaggctcaacaaagcttgataaaagcttttaagaaatcaaagacttggttagaactatcaagcacagcataaatacaccagcattgtacaaattaagcctccatttgctacatttacactcagtcagaatcagtcttttcatcatcagagttattattgctcggctgaaggtcgttgttgcggaattgctctacaacatcacttgcaatcttgtcagctgcattttgagcattactgataagatcaagagcagcttcttcgcttgtcccgtctgcaaagccatcaatggcgtcaatttcaatcctcgggtacaaggatttggtcatcgccaatgccatactagctcccatacttccagctttcttgatattcttgaagtatacatccggtgctactctcagcttgtcaaagatttcggttgcgtcaagtgcactcggaccactgtcattaaggaacatagcttggacaagtggtgtagcgacattggcgacttcgtctcttgctccttcaagcttcttgatcttaccaaccaggacatcaaactgagcttgagatttgattttacggtctacaaaacacatttataataagaatttgctgcattaaagagaggaaagttcaaattgtcagctggcagtaccttcaacctccttcaaggctgagtccctttgcacagctagttctactttgtctcttttcaaggcttcaatctgtttctccatttgtgccatcctggtagcttgtgctgtttgaaatccaaatatttgaggatacagttatgacagcataaatcaatggaatagatctggaaggttaccttttgatgaaccacttagctcgaagtttgaatcctggagctgggcaattcggtcccttaactccttctctgtctttttagcatactccttggcctcatgcagctggtccctaactgcttcaagagctcccaaatgaggaaccagcttttccaaagttgtagtcttggcctcattgcgaagatggattctctgcatgatggatcatgattcagttctgctaaaagagagaacaaagttattaaaggcagtcacccggaagatttacattcacaatgcgagtggcttctccaagtactttcttcagctggcatacttcctcattttctttttgacgatttataacgatgccggcaacttgcgagttctcgtcccaccatttgagcaagataggaggacgggagtcattagccgcctttatgcgaggaattgcttcttcgtcatcgcctagtgttcctgatgtatttccaagacattggacgagtaagctgaagttatttaaatcggcatcacttgagaagatgtgttacctgaggatgttcctggctgaacatgaggtggtccttgttctgtatttagagacccaatcattgagtctttaccagcctctggtccttgggaagttgtcgtttgcgcttcaacttcagggatttcttcatcgggacctacatccgactggtttccagtcgggggctcttgtgttgttgcagtttcagctgttcccgactggtctccagttggcggctggtcactcggatcggctctatcatccgaagcatgggcgccagtcggctggctttcggcagtcggccggctttcggcagtcggttggttttcggcagacggctcagcgtctttggataaatttggctctgtcacagccggatcaggatcttttccagttggatctatgtcggacggtttcctgcaaagtgtcctttcgatattcagtataatttctatgagagaagcatatcaaagggagacggtaccgagaagtttatacctggaagatgttctaatctttggcatttgacggccagccagttttttcctgggcatggtatgctttgggagtttgttgggcgtgcccttgtccccagatttgttgctgtcatcgccctcgtcgtcattaagcaccagctttctcttacgaggacctgtctgaccagctggtttggaggtttgaggttgtgggtctgacctgtttgtcggccctccgcttccctgaatggtgtgctggcgaggagatcggcgctgagcaattgggggatcagatttcatcaatacgtattcctgaatgagatgcctccatggttagttaactcaacatgaagacaagatactattttggtcataagttgaagatttcagatacatacctgcggaggcggattgaatgcattatacggcacaactggcagctggtgtgagtagctgacgacaatggcatttgagaagattttatacattctctccttcatgattttgaaatccagagagtctggttcttcgcgattaggatcatgtttgccgtcaaactcaaaagctgtacgggatctttctttaattggcgccagtcggcatttgatgaagtgccgagtgatctgctctccttgcaagccttgttctttgagttttaacatgcgatccaacaattccaaggcttgggcagcttcatctccgattggaagagagttccaagtgtcttggtacaccgggggaagacaagagtattcgggaagagcaggctcaagattctgaacataaaaccagttcgcatgccatcctttgtttgaagtcttgaagggcattgagaagtatttctggctcagagttcccctcagctgaaatccggcccctccgactacacatggcttactcttgtttggttggggtttgagaaagaagattcggcggaacagggcgaagtgaggtttaattcctaagaaggcttcacagacatggatgaaattggcaatgtggactatagaattcgggtttaggtgatgcaagctgattccatagaagcttaatatcccgcggaaaaatctcgaggtcggaagagcgaagccgccatagaagaaatgcgagaagactacgatctcatgtgtatcaggggtcggaaaagcctcaccgcacgctggccgccatccgatgatctccttggctgggagaacgccgtgcgccaccatctccttcaggttctcttccgttacgtcggacggcgcccattggccttcgaagctttccttctcttccgccatcgattctatccgaatgcgctgatttgattcgagggatggctagggagaaatgagggattaaggcggtggatcacgggaaggattttgatgcatttttcgaaggtggatttgagtggagtggtgaaccctagttcgccggcgcagttctgcactgtagcaaggagtggggaaaatggcgagagttccggcggggaagacgaagcgtcgcttggatctcgggatttcttgttaagggtatcggaggtgcgaatgggcctaggcctgaacagtacttcggcccaatacttttaacagcgtggcccattgtgttccttagggacttaggcatattttgctttggcaatattatgcgcacaatagtgttgcccaatgctgataaaatcctttttatgcggtcatataattctttggaattattgcaatgcaaattaaaaggtgcccgacagaaaggtgttatactgctttttgttagttttattaggctacaaaagctgtctgggttaatttggaatgacttgtttttatcatagtcacttccttggtatgttatatacctattttcattatggtaaatagtcatagcctaggctattagacttattcattaccataatttttataatacttggtgggtaatctttagagttttaaattcggatgcctgtccagtgtgttcattcgtgaacctttttagagtgtaaactactcggactcttttcattatggctaaaaagcggtcggctagcatgcctatttaggcgctgtgtgtgcttttgtcatatgatgcacgatcgtgctattatttggtctctcaactatatgtttagttcgttaactaatcacatagttgggggctacacctaattaggtgcatctattcgatgcaccatatttttatcttttcgccctttacagtctttgtcttcgctactcggcaggccttggcacgaaaagtttgaagcactcggattattatttttgagaaggctacgacgattgactgcaaaggtctcgggggctactgtggagattatggatatcccatatctatacggcgatgatatttggattgaatataggataccgagtatagatagaatatcttatgtgtatcctgggtttgtttcctaacttgtatatcaaggaaacaccttgagacttagtcggtcacgactgtattcagttagggacatagattatcttttgtaatccggactccttcctatatataaggggggtccgggtgcctttaggggcagatgttgattttctctaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacaatactcatgtatggttatagtgtaggaaacggacaacagttaacaaaccaatcgtaattagattcatacatggaattagcatccatgttggtattagtttatacgcttctgaattatacacgattcatatagtaataaatagatcgatactcttagcaatgaaagcaaaacacaaagcacaaatatccagccatacatcttttagccacaatcagctttgccaccaaattagcaagacagaagttttgccgccagaatccacttcattaacaaattggcacccgagaatgtcggaatcttatagcaaaggatcgtctaacaaataaatttgtgtgtagcaaattaacatattagattggtaataaaaggaacctccatgttcgttcaaattatctaggaaaacaaacattaattaaaaaaaataaaagatagaaatatgtctattgatttattaaagtaataagaaaaaaaggctccacaatcactctcacgacctacaaattctcatattaatcaattcgaaattaaaaattaagacatattaaaagaaaagtctagagtctatattgaactaattaaaattccgaataaaaattaaaaataaggaatattggaagaagagtctagagtctatatatgaatttagagctaattgaaagacgaatttgaaaaataagaaaaattaaaagtaacgtttagagtccatataaaaatatatttagaaatagctgaaattcataaaaaaattaaaaaaagaagattgaaaaagagtctagggtccaaatagggatataatttagaaataactataatttgaaataaaaaaataaaatattggacgaagaatcttgagtccatataggaatacaatttataaataacataaactcataattaaaaataagaaatattggaagaacaatctattgttcatataggaatacaatttaaaaataacagaaatatgaaattaacaaataagaaatattaaaaaaggagtataaattatatataaatacaatttagaaataattaaaataaaaaataattactttcatgcacatgcattacagtatgaatattgcgtattggttagttttatcaagttagtacataatttaaaattatgtttttatttcaatctatttcaataataaaatgtaaaaatatatatgatattgtatgggaaaaaattataacgatgatagccgcacaatctgcgtgggccaccatgctagtttttataatacaaacatcatttcagcatttatttaaataaaaatcctcctttttatctagactatttttagttcattttcttctttcgctgttcaatgctgcctgaagcccctccgtgaaattcggctgcacccttggaggtatttcaaaattgatcaaggggttttttatccttatctgctcttttcatttttctaagaatcggagcaaacccacatcgtattatgctcggaattaaaatctatcctaaacaagtaaaccctaaagtttagcccgtttcgcttgaaaaaaatcacatagaatgcgatgacaacaacaaacgaaaattatccccaatgccttatgtattttttaattagatacatagatatctaattaattaagtattcttacgaaaattatcactggtcactggaggcgagcgcttacccggacaagcagccatcaacaaagcatcaagctttaggacctttgtattgttattagcttaggatttacgagtgcgtggcaaaagcgattgttggtcagttggtggcttggagcgaatgatcggtagcagccggacgatgttaattttgacgtgcgacgcagcaccagccgtctcgctggcgtcgccgccggccgtcggcgattttccccgtgagccgcgtaattcccacgcgcccgagcagccggccgagggccgaccaactgctcgtgtgtacgtcctatcctacgcgcgtgtgtgcatgcgtgtcgttggcgtaagttaattaattagccaccgcttgttgagagcaaggctaacagaagcgctcgctgcttaatccagtaattgccacatctgctatagccatggtaaaaaattaatacatacaacaagtagtctatccatctttctttagttgcaatagtctattatttatttattctatcttttctctcattctacgtcacatctttattctatatggtgtactccctccgtctaaaaaagaaccagttcctggctatgagattcataaccaggaattggttctttttggaacggagggagtagaaagcatgcaacgggtcccacattttttggagagtgtgatgctgcgcttaattagtcgcctgccgatcctctctctatcattagctttttgaccaactcagcctttggatttgttatcgccggctcttcagccccctattatacctgctgagagcaggtacaatagcaggctataagccagctataaccatatatgtagaagaaaaaagaagatatagaaaaaagcgggatatagattagtagccggatgcaacacggattgtaatatgatatgtgtgtataagaggtgggaccgggtattaatggtgtagtatatttagatagttaactattgtatgaatgaactattagattggctatagatattttggagtcgatagttggctatattattggccttgctctgaggaagttaattaagttggagagtgcagaggggggcgggggggaggagggagggggggacacggccgtcgatagagatacacgagttttcattgtttgacccatcaccggcaggccagtcacaaacacgtactgttacacttacgatgccagcacggtaacgaatcacccgaccctgtctatatatatcattcgacacaggtactaatttgtgaatcacgataaaggcttttgcagcgatatatttgaaaagagaattaatgtccatctagtaacaatttataaattaatgtccatctagtaacaatagattaggttgagcgtttcctctgtttcaaaatataataagctattactgaattagatactagactggtacatttagaaggcataaagtgagaatttatatacaaaaatttgtgaacttctttttgttatgtctttcctttgctgttccgggttcaaggtagataggaaattaggtataggtgacagcagctagccgctggccaaaaccattaattcttgcctgccctagggtttagaaccaggacgtgctgggtccagggtttctcaaactgtcgggaccggggttaccgtgtccggcaataagtacggttaccgcgtagtaaccgtaagaaatcatacaaaatcatgtaaaacttatcaaaattttaaattatttttaaaatttatttgaatttaagaagattaccgtggttttcttttcaccgtacccccacggtaagcacggttacctgcggttttgtaaaccccgtgggcctagctatatgatctcccattctccccttttttttcaagtcgcaagcttgagcgacctgtccagccaatgtcaccgaagacaagacaagagcttgcagttgcgaattgtgaggcactaataggttcataagcaacgtccaatggaaaaacatgagaccattattgatgtgcgcctgcctttctccaagtgatcgatggatcaattggaaaggagaaggccgtttttgaccctaacccatatgagatccatggttcctgcaactctgcacgagattgttttcctgttccctacacatatgcatcgacactaactggctacagtttttctgatccatagccttttcttttcagactagcctatttaggagagttcgctataaacttaatctgaaaaaactaggtttttcaggtccatagtttattttattttggattatattgctatagataatcataatatggatgagaatatacattatctacgagagatggagattttgagagtagttacagctcctataagattctcaaacactggctaaaagaaattggggaggagaccagcactaatttttctgctacgtataagagtcaatccaatatatcttctttaagaatcatgttaatgggggagacaaatattgtagtttctgctatgcaaaaaagacaatatccaatatctttatttcagcgtcatgttcttagatttttttttgagatgcatgtttttttcttttaatatctctccatcccataatgccaaatatttttgttaattggcttaaaggtgtaactagtctataaaaaagattattctaattggagtgttttatgttagtcaatttgtgttgccttaatgataaagttcttttttatcttcatgtctttctgttagctttattttttatgtactatgctagtacaggggaacaagaaacactctgaaaataagtagtcaaaggtctcttatttcactgtaaatagcgtagttccattagaattactagctaaaaaaaatatatggtttagcactaccatgtactaataaaagagacttaaggatttgtcccatcaccgtatgtcttatttttctttttcttttattcttcttttaacaaacttgtggttgcgtgtcttataacagaaattgaagatgtaaactattttcattattaaaaaaaatatgttcacaaaaagggccttagccataaattgagctagcctacagtaaataaatcatattatctctattttataatatatgatgccattgatttttacatcaagtttgaccgttcgtcttattaaaaaatttaagtaaatatcttttattttgttgtggcttgatttatcactaaagaaacttttaagatttgcataaaatttttaaataaaatgaataataatgttgtaaaaaaataaaataacgtcatgtattaaaaatgaagggagtttatgttctcattcctcgtcagctccaatcaccaactttttttctctcttcctctcatcagctaatttatgtcactggtcactggagatgaccacaaagcaacacgctatacatctcgatcggtctgaaagagatgatgactgcaaaacctatccacgaaaccaattgcttgagagagacgacgacgtctctaactacagaatggtttttttagataatgaactccagaatggttaacgtacggattgaattgacgaataattcgtaataataatttgaggataaaaaataaattaactattctaaagttgaaaaatgggtttaaaacagtatgtatgatttacatacacaaatatatatatatataggtaaattatatagatatatatatagagagagagagaattattgtaaagaaaacttatttttaggagatcgagaaacgtgtgcattcatcaatgtattcatttgttaagcacgaaagaacaggagggaataatttggtgctacacgcatggacagggtgaccaggcggatttccaagacagatcgaaaaacctgacggagggaatggaaaaggagtggctggtctgattggagcattggagggatggggacgcctcggaaaaagggctacgctacattctcaacgaagtgtttcttttcctcagctgaaagagaaaacctttttttcacatcaggtccatacctatacaggtaggatgttaaggtccatgaacagtactagctacagtatagcgaggtagtacaaattgatggttagtttcggtttacctgtttgcaaattgcaatattgttaaagcgagaacggttattcgctcccgttaattccaaatctaaggccgctttcggaagtgagggttgggcctggcacgaaaaacaaagcagcgattagtgcatgattaattaagtatttgctaatttttaaaaaaaatggattaatatgattttttaagcaactttcgtatataaatttttttgcaaaaaacgcaacgttcagctatttgaaatgcgtgcgcgtggaaaacgagggaaggaagttgggaacctttgatatcgaaagcagcttaaggtggtgtttggattcagggatttaactttagtctttatatttagacactaatttagagtattaaatatagactacttacaaaactaattacataaatgaaagctaatatgcgagacaaattttttaagcctaattaatccataattagataatatttactgtagcatcacataggctaatcatagattaattaggctcaatagattcatctcgcgaatcagtccaagattatgcatgggttttattaatagtctacgtttaatatttataattagtgtccaaacatccgatgtaatagggacttaaaaatttttgtcccatctaaacagggtctaagagcaagtttaatagtatggcccgctactagcttcaattcatctatagctaatgtaatagttaattcatacaatagttgcttactatactattaatacctggtcacacatgtcatacacacattgcgtcttggagtccgtgctgcagctggctatatatttgtagcccgtagctcttctctctcatcttttatctcattaaaatatgtttatagctggctaatagtctgctattgtacatgctctaatagagagcacgaatgactttgttgtatggtttactgtcctagcgttaagaaaggtaaccacaaactgtgaaaacccgggtaaagtttataaaaattcagattaatttttattttttgaaaaaaaattgatggagttaagcaaagttaccattgctgtacctcgatggtaagcccaattaccatgtctatgaatggatgctggctatgtacgcatggttctacctacatcactactacatggtgccgtactaatttgggccggtagaaaggaaagatgatttgggcccgtaggaaagaaaagaaggaatgggctgaagagagcggggtatttggcccataatgaatagtggtgtttctcaataaaaataagttcactataggtccctcctgtgtcgctgagtctaaaattcatctctgaaccaaaataccacatatgacgtgtccttcaattcccaaaactagtgcaaataaggtctcaaggcagtttggatagcggtttcggcagatgtggcgcttaaagtcagaatgaaccgtgggacccacatgttaatgagtgtttggttaaaaataacaaaaatgcagtgggacccatgtcatcacctctctctctttttttttctcctctcccttcctcttttctctctttgtcggtgaggggcaggtaatgacgatgaccaggatctggtaggacgctgaggcggtcagcgacctagggtcctccagtgccaggaacgaccggaccggcgatggaaggcggtacctctggtggaggagtagcacagtgcatgacgaacgcgatgccccatccttcctatgaggagaccaagaaaggggacgaggtggaggactccgcgtcgcgcttggctggcgggctcgacacgcatgtcgccgccgttgccaccgccgcagtggcgtgctgcagcttcgccacgccgctgttggtttgacgcgagtttgttggattggctcggctacaactgcgagagaggtggcactggcaacgatgccgcctcgagcgcctcgcggtgggagaacaatggagaggtagaggttgagggagctgttgcgctcgaagacgaagaggatgaagtcggaggtaggaccgaagtttccgttgtagttgaggaagacaccattggtgaggcggagctcagaagcggggttatgagacggtgcgaggggagggagcagataaaggtctggtgcatggctggcgcacgacgcctcaccatcgcttccacctcactgccaccggctttaggacaaggtggcctccccggacccatccctagccatcgccgagctccgtcaggctatcgcgatgcttgcacacgcgagagagaagagagaaagagagaataaggaaaggagagaagagaggaaagagagaataatgaaactagagaagtggggagagagagttaggggtggcagaggggcgaggcggggttaggttggacaacgggtggaaaacctcacccgccctcacccccacaggggacccagcgggtgagcgggcccctgcaccacccggatggccaacaactgcgatgcacctattgtggctgctggaggtggcgtgccgcgacgaggtgacggttgaggacggtgacaaggtgtctacggctgaggacggtggccactaggcggcgccggcctggggcggcgtcagctaggagtagcacgctacaaggaggcgacgctggccgggggcagtggaccatgaggaggcggcggcagttggtggcagcatgctgtgacgaggcggcggcgaagaggcgatgccgtgtcggggcggtgacagctaggaatggcgtgcgaagaggcaggctggttgggacggcgcactaggagggagagacgtgagagtcagagaggagagagtggtggcttggtagggatttgggaaaaattagggttttgccgatatagtccttcacctaatgggtcgtttgggccttagaatgtactatcttttgatttgtaactcatatctttggagcgccgcgggtcaactcccatccccgcccccacccccgcatttttgtggggcctcagccccactcatcacccgtggtgagaatttcccctcacccccagccccatatggctggtccctgccggctccccggccccaacggggaaattgccacccctagatagagtgatgatgtgggttccattgtaatgcttttatttttttaccaaatactcactgacatgtgggtcccatgtttttttttttactctaagcgcgatgtaggcaccacatcagcgaaaaccgtcatctaaactgtgttgggaccttatttgcactagtttggagagttgagggacacgtcatatatggtattacgactcagtcaaactcgacaacagttgagcgactaaagtgaacttattccttctagattttagatcctatagagcccatccaggatgtgaggcccacgtgtggccatctggccctagcaatataatgtgggctagaggatggaggtgcccaagggggcaagaagctgtgggcttgagccccgggcc

SEQ ID NO: 44131 - DNA, 9794 bp, Oryza sativa
tattactatcgtgcaatcaaccatttcttatataaatgggatgttttttttttctcatttttcctcatttttataggctactatggttgactgttttatgttggtgaggcttgtcatcacttgtgtgttttgaaacttcatctatcacatcctggcgcttttcctacaattagtactacaagccgaagactggaagactactgctatacatccgaccctgttgttcgacttctgtccgacgctgccgtatctgccaatcaatttactccaacgagccagcttctctccatgtgggtcagagcaaggagcaggtaagtactggtcagatgctaagtcgtacaccccagtcggatgtgtagcaatttccagactagaaatcttagttttggtaagaatggcagctgctgcatattactgttgaatatatagcatatactatattatttcaaggtcggagccaaggcccggccaccatgggcaagtgcctgggctccgcccgctgtgctagcacgtaccctgcttaattaacaatgcaattagcaaagtagttaaggctaatgcaaaagaatatactagtctctcatgctacattaatcgatataacctttcacgttgattttagtctactcaattacaaattaaattttatatatatatatatatatatatattgtatagattttatatgtatgcttatatcttattagatttgtctaggtaaaaaaaaatttctagatccgccactgtattatttaatattgagagtatgaacgatttagttgtgatacatgaatactctgtgtcattttgttctcgaagtactcctaccggtttagttttaaaaaaaactgttgttgattctcgcccttgcaaattaactaatataattacaacaaactgattaattatcattgttaaaactttttctttccattttaaattatctgcaaagtaagaaagtaacactcccaagttacaacagcacaccatccatatatccatgcaggcagcctgtttgtgcccttgtgcagatgcatttcatttatacaagtagaaggcactcaaatcagccaccacatgaacacacacatgttccatcatcgatcgatctacacatgcatcacccggtcatgcacttacaaacaaaagatctacttgaagaagtacgggaggtcgagcacgtagaggaggaagtaggcccagaggacgccggagatgccgccgaagaagaagccgccggtgaacttggcccagccgtcggcggtctgcagcttgtcggcctccttcttgcggccggtgagcgtcagcgtcggcgccgtggacggctcgccctcgccgaaggaggcgacgccgtacatggtgaggcagacgctgaggatggcgacgaggcctgcggcgccgagggcgccggcctggccgtgcaccggcgtgttgcggagcgggccggtgagcgcgaagggcccgacgaggaggtagccgtgggcgaggccgacctcgatgccgcggagcagcgggctgacggcggtgcggtacgccgggaggttggagaggtaccaggcgaccagcgggctggaggtcaccggcgtctccaggctgccgatgaaggggtcgccattgatgggctgcaccacctggtacgttggctgtgtacaacgccacaagaatcacacatatcagatactccctctgtcccaatttattctttaggattcatactccctctgtctcaaaatggttatcataaagaattattacttgtcccatcaatcacttctaattcaaatttctatcttttctacccttaaccatcctcctacatccaactatacaatatttaattaggagtattatattttttttcctcaaaccttaatctatgctaaattatctaaaacgacaggtaatatgagacgaagagagtaaatgtttcatttatcgttccatagaagtagacacgtgtaaatacacaccaccatatatatttcttttagataatactatatttcaattcggcttctgcgtcaagatgtatccggcctacagacgccgatatagtcacgctcacacaaataaagctatttaattaagcctctagaaaacgtatgctcttgtttcttgcatatattatggacttatggtttacacttatcatatagctagaacttatacaaagttaactataaattaatgcatccaattttggctaaatttgtgtaactatatcttctaaaatcgtcatgctaataatccaaccctctctcccaaaaaggggatttgtgatcgaaataacgatggcaaaaagtttaaggatgtactatgcaggcaaacttattactcccttcatctttgaaatttttcacatttcatagtactacgatgcgtctaatctacagagggattacaacaattcaatattatattgctaattgaggaaataaactagtgaacagagcaataaaaatacaacaaaatgaaaaacgattatgtctgaaatctaccatctgattttaattaacagagcttgttcttgagaaacatgcaagttttacactagctttgatgaagcgaaatgggaaatctctcaatgctctttagcagtctagctagctctactgaccttctcagactggatggccttgactgtgaagcggggcctccttgtcagcgaagcaccagacagccccctcggcttggagcacaccaagctgctcttcatcagctggctcgccatgggagcataagcagtggccatctctctcctctcgtctcttcctttctctccctagctagatgctctctctcccggccaaaaaaaatggatgtgaaacagccttcttggcaactgccctagaaattaaagtttgtgatctttacaagctgcaggagagaaaatctggagtatgtgtttgggtgggtccctgaagatgagatatggttgagagctgtgtggcgttcattggatggaggatgccagcaaccctatcccttatctgaattcctggagatccccctccttacgttggacgcctagctggcggtgccgcccgtcgcgccaagtggaaaacagaatctgcagcctgcagggcttgtggttggggcaaggttgctgaatcaatatatctggagatggcataacagaatggtcgcagactcggagtttggtcaaaaagattacttttggatatttttgaggaaatattttttcgaagtttggtcaaaaaggattacttttggatatttttgagaaaatgtttttcaaaaattagtaaatttcatgggcatgtgtttcaacggaatctcatcagtacaattaaacacatcttgcataagaaagagcagagcaaacgaactggcaatttataggttctcaacttctctagtgatccgcggggagactatcacaacatctaatgtgatccgcggggagagtatcacgagaaagtactccctccgtttcaaaatgtttgacaccgtcgactttttagtacgtgtttaaccatttgtcttatttaaaaaatttaagtaattatttattcttttcatatcatttgattcattgttaaatatactttcatgtacacatataattttacatattttataaatttttttaataagacaaacggtcacacatgtgctaaaaagttaacggtgtcaaatattttgaaacgggagtatatattaagaccgcgtgattaattaattgccagggatctacttctcgaagaatgtaaggactggcaaacaggtgtttggttgttatatgaggatgcgcactaccatagcaatacaccacacttaataatcataaacttgcttagacttatatttagggtggtgaaattaacgtcaaagaccatgctcaaagaatatatatatatattataaaaagaaccaaggcatgaagatataaaaaaagaatcaacagatgcccggtaactcgagtctttgtgttacaactccgaccaattcccctccaaaaaggaaaaatagtccgaccaattcttctccagggatatactcatgacacaggagatagtttccacagtagtttatctctcgctgtatgccaggcgcttgcttttctgaaggcaaccatggtagtggtagatgagcctgagcaggcaatccgtcatgcagttgacatcaaatgattcgataaacttcagatctgacaaccgtgactttccagcagcataccgatggtactcttcaaagactgatgagagacaccaattctgcagctttctgaagcagcccacaagacatccagtacggtgctgcggtcgaaacagataaaatatcaagaacatgtggtgtggacaaaaacaattatggattttgaacagatgagtgctttttggtacctttcctcttttgcaatggattagaactgggtgattccttacatctgaaaccaagaatcagtactagtaagtcaaaattattagcttgatggtcatcagagagttttagtatacagcaaagataaacaggacagaagaagcctaattcagtaccaagtatgaccctaagagcccccatgatggcatccacaggaatggacacgttagggtcctgcagatgcaaacatttaagagatactgaacttcttcatatatgtaatcaagaatgaagaaacaagcaaacatcaagggttattttatccaaaagcaatgatagaacagagtaacaagcacaagcacttggtgaatcacgacaatgtctattggagtgtctgacagaactaaaaaaaacttacttcttcacctgtagtaagacacaactaacaacagtggaaaggtataatgagcaaacatcaaagtgaagggagtgactactgatcgacaagaaaatgcaggtgctcttccaacattaggagtacctaactggatactaccacaaaaggaacagaggcggttctaatcattcattcagcacaaaaaatcggtagtttgtacttgcaaccgtaaaatcatgctaaagttgtaaacgttaattagacattgaacattggtcgccaaatttttatttcagagcaagtaaaaagactaggaaaatgagcctcaacttttgatttaaacttttttttcaaacaatttctagaccatgcctcacctatacttccaagaaagaaaatgtggaaaaatccattttagtcaagccttttaggccaaagtacaagaaagtatgtaacatgaggcttcttgtacatcagcaactaaactatcaaataactaaggaacaaaaaaaaactatcaaatggtcagcaaaaaacaaatacttctttttaaaatagcattgcatcctgaatagaagagggaaggaaaaaaaaatctaaatcacgtttactggcttaggctatttccatgagaaatggaaaaaaatagattgtactttcttctgacaaaaatgttggacacaactactccctctgtttcaaattatttgtcgttctaggtttgtcctaagtcaaacatgtctattttttaccattagtttttaaaaatccatgcagttcatcatgtgaattatttattatgaaagtatttctcatcgcaaatccaaaaatataaaccttatgatgttaaactatatgagtttatagaaattgatggtcaaattaaaatgcttgacttaagaaaaacatagaacgacaagtaatttgaaacaaagggagtattggacataaaatttcacataaccctatgtaataatggaagcaactttgtattcaattcatgtttaaatataaaaaaaggcatattgaaaatttaataatgcatgttttgcaggggcataattgaaggaaaaatgaatacaaatgaaggaccatgaaaaaggctgcgatgtcaaaaaataacggatgtccaactatctgtccttgctgagtatagaaagttatgttaaaaattcattctacagaccatgtatgactgaagaaatttccttacaagaaacattccggatgcattatgaaactgcctaatattagcagttacaatggtgaaaatgacactgatcaacttcaattcaataactgaaaaggcatctcctaattaagcatcaaccagtataaattgcaacagagaaattctaaatcaacttccttttgaagtttgtggattgttactacaaacatcacttgacactaaacatttaattgttctatagttatcatttatcaaggcaaccttcaatcatcaaattagcaccaatttccagaaatgcctgtaaattctatgatccctacgatttgacaaggaaagcttaggaccccacactctctggaataagtacttagtgtacagattttatgacacataattacttaatcatgcattaggttgtgaggtttaaaatcaatattcgatgtgttccaactctgattggggaatgttgttgtatatttaaagaacaaaaacacgcccttctcagcatattgcatcaggattccacacccatcagagcacaatcgcacctaaacaacatgcatctattaaacatagaagttaacaaacctaaagagaaaattcccacaaatatcacacacaaacatgaattaggaagaaaataaataaaggaacagcgtgatcaccttgttcccctcaatcccaaattgccacaaatatcacacaaacatgaattaggaagaaaataaataaaggaacagcatgatcaccttgttcccctgaatcccaaattgccacatatatcacacaaacatgaattaggaagaaaataaataaaggaacagcgtgatcaccttgttcccctcaatcccaaattggaagaggcggatcccctccgccttcaagaactcggcattcgtctccatgtaaggttcagggcacagatacctaaatccagatgaaatccaccacatgagcacatacaccgaaggaataataccaacagcaatccaatccaatctaaacgaacccaaccccccgagaaccgctcacacgacagatcggaggccgaggcccctgaggaaaccgaagctggcagggtccgggaaccccgaccggtacacccccgtgtccaccatcccgaagttggacggcggcgccaccaccatcgccgcatccgctttctccgccgccgactcgtcgaactgctccaagatcatggctgacccggcccggattccgcggatccgaggccggattcggcggcgatttgcccgcggggtggggggatcgagatcggtgggggtggcggcgagggcgcggcggcggcggcggcggaaactagggctcggcggagtcgcaacacgcggacgcaacggtcggctcgtcggcgaactccgtttcgtggaggcgggtggggcaacttgtactgggcgcgatcttaacgggctaacgggtgagcggtttcggttggtggatttggtggttggtctcgtagataggttggtcttcgggtttggtggtttaagtacggagggcatttcagtcacgtggagaaaaagaatatagattatgaatcagattaggcatgcaaagggataaagaaaaatcagttatactgctctcccaaactatttcgtcagaaaataccatagtgagattaagtcagtatttttctaaacaataatctgcagcattattagcacctgtaacgatactaaaataaaaacaaaatcagcaaagttgtgaatgggaaatgatcggtgacactaaggctcagttctattcttcaacttccttatttttcgttagcacgattttcaaacggttaaatagtgtattttttttcaaaaaaagtttatatatacaagttgttttaaaaaaagcaaataattcaattttcaaatttatgatcgttaatatttaattaatcatgtgctaatgaggtttctcattttgcgtgcaacaaaaatccaactcccaaaagagagatcaaacggggcctaagttaattaagtagtgtgaattggaaggtgattgagtgaagatcaagagagggtttccctcccgttataattaaggagataggtaggctgtcaaggcaatgagatagtaatggcaacgtccagctctgtaaataaaactaaggaagaaaagtgcgtggtaataaagaagtacagtgagaagaaggcaaagttttcttacgaagcaatgatatacctaaattatagtcgttgtagataaaacaggagtatgggctggcatcaaaattattgtgctgaacttgatagacttacatgaaggtttgtatctttccatcacgaaataggcagattctctttatatcgttatatgtaaaatttctttttaagtatggttctgctgttgatcatttatattggacaatataccatggagtatttatgttttaggtgaaaatttcttactgatttgtggttttgattttttaggaaaaaaacttttctatcataatgcaaaaaagttagggatgcaagtgggcagacttgtggcccactaagccggagtttgaaaatgggtttgcatgttgctaccgctcgtttaccatatgcatgtttcccaaactaataagcgttgccatttttttttcaaaaaaagaaaaataaacttttttttcaagtttggaataatcaatatccaattaatcatgtgcgagtgactcgtcttattttgtgtgccactaaaaatctaagccaaacttcactttcaaagttaattttagccatatttttacatcgattttatagtgatgggtacaaaataaactagcacgtgggctcttgtacgcctgtacggcatggtgcaaaataaactagcacgtttgaatgtgtagtgaaagtcgtttcttcgtcttacatttctagactagttttctcctacgaaagattatgtttgtaggtgagtttttcatgcattttttttaatttatactactaagtaaaggcttagtatggattttgttttatgtgttacgattatgaggtgttctaattttcaattgacacaaagattctcatgtttatgtaccttaatttatatagacaattcataggtttatttattttggttttgggtgaataagcacaaaacaagaaactagttcctcatattccaaatttcatcttgtccatgtttgagcctagcttacgtagaaaagtgatcggctaaaagtctaaaactatcatgcttctttttttatataattgcggcacattattgattaaggagcatcagaacaacgtactttccagaacaagagttagactcgacatagcgagctattaagtatatatgtgccgcaacattagacaactgactaacatggataataaaggaacaaagtaggaactcagacgcgagcttctttatgtagcctatcacacaaacgatgttagatcgatctcggatcatcttttggacctactgtatgacagaaaggcagtctaatgccaaaatcagcttcaggaagcctttttcttttgcgcgttgcagggtgcactggatcgcgagggcttcagcaagctctgggttgacaatcatgggtatatgctcattgctggtaaaaatacaactgtcattatggtaacaaataattagacctgcactcatgcgacgagaaccatgaaaaattatagcatcaacattgaaaagaattgttcctgcagacggtggaatccatcattgaacaacataagagatacagcttggtgcattcataggtttaaagcagtgctgctggattatatcatgtaagtcgtgaatatcatagccacccaatgaggacgccataagtcattgttgttctttgcctcattccttgcttcccaaatgtgctagaaaatt

SEQ ID NO: 44132 - DNA, 1571 bp, Oryza sativa
  unsure (1)..(1571): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagcatatgctagatgtgttgctcaaaactttcttttcttaggatttttttctctcatataattcctaaatttatctcaaagattaatactgccacttggcccaagcggctggcagtgtgcgccagctttaaaagtacttatttattgactgatctgcagaagcagaaaggtgatcaaacttaaaaagtcgagacaatgtacaatgcccattttccggtattttgtcgaagctcaaattctcatatgtatttcctcggtttcataaaaaataaatataggaaggaatatgatagattattcgtagtactgtgatgtgtcatatcttgttttatgtttggtttttataggacggatatgaagtacttggattgatgagctacaaaagaaaactagttttttcagttttttccttccccacgtgacaattgaacacttcaaacgcttcactgtcaggtagtaatacactacatctgaataggtcaacttacagtagatcaaaactaaggtcacgaacgaagaaagaccacaatagcgacgcaatagtccagcagtcacttccagccttccagggatcaatatcccgtgaagaattaataaactacagggaaatctcgcgaggtcgggcaaaatcttgttgagagaagttgatttttttaatcagattttatttgaacttgaagcagtttgaacaaaatttaataaaatttagagaaattatattgtattgaactcgaaattttcagccaggattataatatatagcgatggctcgagagcgaaatttcgttgagaaattaattaatccctggtcacatcacataacacaaccgtgggaggaagtcatcacaattgggaccatgatagcactccaggtgagtacatttcgttaattgaagttttcaaaggtaagtgtagctataattttctatcacatgtttgaattgaggagggatgcaaagttaggtgcagtattggcctgtgtcatttgctcataactagatgataccccacgcatagctgcgggacttcttgtttctaaaaaaatattatccacgctaagaatgctaaaaacaaaattaataatgagagcaaactcaaacatatgaagaaagttcaaagttgtaggataaaaacatgtactcatgaaaaaagagcaagattacatttacaaattgacatgtgcacctcttacagctcgcagagttaattaatatggataggactactatataaactcaaaagcactcaggaaagcatggccaaatatgttttcaatgtacaatgagttcagcaagaatgaaactgcttattatcttcactttttaaacgtacacgctgatatgtttttaggagcagtcttacttgattaagtaccaagcatcttcataagatcagacttcccctagcaaacaacatgatcaatggagccacgatgtatta

SEQ ID NO: 44133 - DNA, 10226 bp, Oryza sativa; identical to SEQ ID NO: 39337

SEQ ID NO: 44134 - DNA, 2440 bp, Oryza sativa
cgggacgtgaactggacgtcgatcaggccggtgtacatctacggcccgatcaactacaaccccgtggaggagtggttcttccaccggctcaaggttggccgccccatccctgtccccggtgccggcaaccaaatcacccagctcggccatgtcaaggtcaattcgatcagtgatcattattcagagaattcagagtgtgtatttgggtgtcgacctgaaactctgaatctttgtggtggtttttgcaggacttggcgacggcgttcgtgctggcgctcggcaacccgaaggcgagcaagcaggtgttcaacatctccggcgccaagtacgtcaccttcgacggtctagcacgggcgtgcgccaaggtacgtggcatcaacgaagctgtagcggccaagaaatgacatgggactttccggcaggattgccatgaatcttggtgtgtttgaaatttgatcatgcaggctggaggattccccgagccggagatcgtccactacaaccccaaggacttcgatttcgggaagaagaaggccttccccttcagagaccaggttatatattatatccagcaatggcttctctgctaaattgaagaaaaatttgctgctgctgctgctgctagtgttctgaattcgatgtgattgcaacaactgcagcatttcttcgcgtcaatcgagaaggcgaccttggagctcgggtggaagccggagtacgacctggtggagggcctcaccgactcgtacaacctcgacttcggccgcggcacgttcaggaaggcggccgacttcaccaccgacgacatgatcctcggcaagaagctcgtcagcgtctgagctcgccgccgtcctttccggacagcggacggattgcttgctgcgcgacgcgagcggctgaccggccgggccgccatggccggtgggcaggagcaagcggagacggtttcagttttgttatcaacgctggtttggtacaatatggatagttggatacacgcgtacaggcgtaagctgcaatgtattgggattgggaaactgtaagatgtgatacaagggagactaaacttcatctaatatatatgatataactagcaaaatgcgtgtgcttcactacgagtgaaaagaacgttgaatgctaaaaggcacaactaaacatgagcataaaacccaatgatattcacggctgatataaacagcagtattgcaaactgatagactcgtatatatgtagtagattttatatgactccataataccatagtatgtacagtaattcatctagctactagttccttcttggtctgcccaaccccggcggaacgagatgaagatggggattttccatatgcagcgaagaggccacgtgtgcctcaagagtagagcagaaaacaggtagtgccaaatcagacaatgtgtcttccttgtcaggtgtcaatgcctccggttttgattcccaaggctcctccggaggacctgtccgactggctgcttcgagaaaccgaggggtaggattcaaaccacgagggattgatgaggggcggaagcagggggaccgatagggctgccagggggcagggccaggggacgggccaatggcttaagggagagatctgttcccagaccaagggacattgctggtggtctcaagttagaacaagaaatctagtaaagttatctcgccgagggatgattaggctgttggggcattggaagttgtcagcttggctttggtaccaccgggcaacaaacctcccctctcaagctgtgggcggaggatacaggtgaaatcgactcgaacaagaagcgagagtgcttcaaccttgatcagcggatcaagcggtggttgtggagtagtctcgccagactcaatgagtatcttgtgctataactgttgtgggctggggtcaggtgtgatagtgagtgagcttcgctggctggtgaagactcaccctcctcatctttctctctaagccgatgttcggcaccccttttttccaacccctctcctcgttttccatacgcacgtttttcaaactgttaaacggtgcgtattttgcaaaaaagtttctatacgaaagttgcttaaaaaattcaatttaatccatttttgaaaaaaaaatagctaatacttaattaatcacgtgctaatggaccgctctgttttccgtgcgtactgttccggttgggaactaggaatggcaaacacaccctaagacgataacaaagcaagaaacatgatgtggtccttaggattctcaagctcttttgccttcagctgcaatataatagcctcaccagggagcttgtcctgttttgatcatcagtttcaacggaaggggccattgtctatagggaaccaaagcaggaattgagacatgtgttctggacccttgttcgccgtctccatcgttaatggatcggcccatgtttttgttgtgggg

SEQ ID NO: 44135 - DNA, 24033 bp, Oryza sativa
  unsure (1)..(24033): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacataaatgatctagcaatgcacagtttcacacacattcagacaacgatgaatctgcatattcagctagaaacccaaagggaaggaagagatgacagtgaccttgtgggcttggaagcagtggcgtagctttgttgatgtcataatcacagcatagagtagcttttggatctgtgggtatctagtttttgcgtcgtggagggcctcgctggtgtagtacactgggtattgtactctttccctctcaacgacaataaccgtactcacagattaaggtgtggcaatgatatacaggaataactcttcattaatttgtggagcaacgagtacaggggggtttgacaagtagcgcttgagcacgatgaacgtgttcttgtcttcttagctccacttgactatgtcctgcttcttgagcagggtgaagaaaggttgtcctcgttcacccatccttgcgatgaaacgactaagcgaagccatgcatcctgtcaaccgctggacctccttgagtcttgtgggtgacttcatgttctcgattaccttgatcttttcagggttggcctcgattcctcatcccgagactaggaagccgagtattttccctgacggtactcctaacgtgcacttctcctggttaagcttcatttgatatcgtcggaggctgtcgaacgtttccctaaggtcgttgattagcgaatcgctcgtcttggttttgacggcgatgtcatccacataggcctcgatgtttcgtacaagttgatcaccaagtgctctctggatcccgcgctgataggtatttcctgtgcttattaatccgaacggcaccttggcatagcagaatacaccgaagggcgtgatgaatgccatcttctcctcatcctcttttgccatgttgatctggtggtagccggagtaagcgtcaagtaaactcaagagctcacaaccggctgttgaatccactagttgatctattcgagggagagggaagtgatccttgggacacgccttattgaggttggtgaagtctgcacacattctccacttcccattggctttgcgtaccattactggattagcgagccacactagatggaagacttctttgatgaagccagctttgagaagtttgtcgagttcttctcgtatggcttgtttccgatcgggtgtgaatctctgttgtttttgcttaactagcttggcgtcgggtcgtaccatcagttgtgctcaattacctccctggggctcccggcatgtctgacatttgccaagtgatcacgtctgcattgtcgcggaggaaggtgatgagcgtgagttcctatttttcgtccagtgttgccccgatcttgacggtcttgtcggggttggagctggtcaacggtatgattttgatcgcgtcgtctagtttcggcatcttgttgggcttgctcattttcttgggttgctcagttgtggcgagcaggttaggattatgctcgaccatgtcgaggttccgcttatcgaactgtaccaccaacttttccctggatagtagttgtcccttttggtcctggcattttgagcacttgataggaatagtgagatgctgccatgaacttcgtgagtgcactcccaataatggcgttgtatgtactgtcgaactctgcgacatcaaagatgatatgctttgttcggaagttatgggtttgtccaaaagtggcaggtagtgtgatcttacccaacggcttcaatgatgattctggagtggttgtcagctcgctttgtggtatccccatggcgtctaaggtactggtgaaaagcaggttgatggaactgccgccgtcgatgagaacccgtgctaccttgatattccgaatagtgggctcgaccacgatcagatatctgccaggtgtggttgcaatttttgggtggtccgcctctgagagctcgatcttgtgttgggaccatttcatcttggtagccgccccctgtgatgaggagcatacttcgcgttctatcttcttgaattccctcttcgaggtgtatgatggaaaagcgctgaagatatgcatgatatggaggtcgaagtctgggaatgcaaagttggagttggggtggctgcttcagtagtcgcctcgacaacacgtactcgcttccccgtctcgattactagttgtcgcgcaagttccttcttgaagacatggcagtcctccaaggagtggttgtttgtcttgtgtatggggcaccattgttttcatgagtcgtctgtctgggagtttgggcgtgtgtttggaccatctcatcttggcaatagcccccacgacgtggagcagacttctcgctctatcttttcgtactccctctttgaggtgtacgatgtagaaccgccgaagatgttcgaggcatggaggtcgtattctgggaatgcggagtccaagtcgggagtggccgtctctacagccgtttcgacaactcgtactcgctaccctctctcgattgctaattgtcgcaccagctcctttttgaagacgtaataatcctccatggagtgattgttcgtcttgtgtatagggcaccattgttttcgtgagttgtcattctgggggtttgggcacatgggtgggtccgtttgcttggcagcatggacctctcccgaaggtttgcgcttcccactcttatgacttctcttcttgctcgactctggtgcgtctttgttggctggcttattctcttcccctaccttgctttttccttccttccatcttagggcgtcgtctgtgtgagcgcatctgtcgataattttgaacagcttatctcggacgcctgacttgaatgcatggataacaaaagcatcgatgatttcatgcactcattgaagcaccggatatagtccctcaatgattcaccttggttctgagttagagcatgtaaatagtcctcgatcgcgtggcgcttgtttgttacttggaaattggcgacaaattgctgccataagtcttcccatgagggaattgagtggggcgggagatggaccaaccatgattgagcagaacctatcaacgcagctggtaaataattcgctggtgcgttgttgtctgcgccagcagcgtacagaattgtggagtagacctgaaggaactcctctgggtctgtacttccgttatacttctcgatcgctcctggtcaaaacttttcgggccatcgtacgtctcgtagtgtggttctgaatgctctgcatcggccatctagagcaaagggtggcccgcatttctggtgtcgttgagttggtctgtctgatgaagaatatgacgtagatgaagacaagggatcacttgggtcgggggctcggctacccgatcagtggtcgtgtcgtcggtctcgtcccaacgcgggagattgagagttacgttcccatctgtcgtcgccatctcgcctctgatctcgaccatggtctccctgaactcgtccatcggctccctgatctcgccgattgtcaccgccaccgtcacaacaatcgttatctcggcgatcattgcgggcctgcggatctcgatgttcattggggcgtccttctcgatcgttgttccctcctcaacgtgaaggggagcggtgtcggtgtcgacggtagatggtgttccctccttgtcgagagggagaacgacgccgatgacagtcagtgtcattccgatttcgtcgttccctctgccggtcgtctacatgttcgcgaaggttgcgattctcacgaagtggcggagttggatatcgtgttgcccgtggtgactgagcacggtgaggacgctctccaatagggttttccgcttccgcgttcccattagctggttcaccatttcctcgtgatggatcttgaggtgaaggctcgattgttgtatctgcaaacgcgctattgagattggtcacagtctctcattgtcgtgttgcccacatatcgacgtcagggtttaggatggggtcaaaagggctttatctcaatatcacgtcgaggttctgcagttgttgagcaggcgtcctagctgttgcggacgtacttgtctcaccaatattgatcacgtttacatctcgtggcaaactcgacgaagaggactcttgatcttccaataggtgtagtacagatggctcgtcagggttgacactgacaaaacccacgaaccaatctgaagtcattgctacgtctcgttccttggcaacgcactgaagttgaacttgtggttgttggacataaggacacgtcgacttgagtattttaaggaagattttgcaactcgtgagatagtgagatcttgacttatggattgggcagtatgtgacacccgtcggtgaagtgcgttgaatcccacgctcccaacaggcgtagagttcggccttcgtgtggagtatcaccgggcaatcttgtacagtatgcttggatgtcttatgaacaggacaccaagatctgggtttctgggtagatatccttgtcggctctaggtttctgtgcagccacttgaggatttcttccaggtgttggggtcgtcgatattccgttctccacttgcgtgggaggaattgtcggcgagatgtcatttctcgaagtcgagattggcgtaacggtgtagactagagaggcaatagatccgacttaagtccacaccagcaatgtggaaactccttgattgacgccagtattggtactgttggtactgttgtcaggatggcttgaagtcatattggcagaaccttgagcaccaagtccccctacctagcacgccattatcaacgagtgatactcgtagaccggatgattagggtactggggtacgttgtgttggcaactttttgtgacaagttgacaagcatgattgcaacacctgaacaccttgcggtgatcctaaagtcgccaaccacctcaatctagcaaaagataaatcaagatgggttttgataactaaaccggctagcagagccgattctagataactacccgtctcgtgggcaaaacggaaggttttcaagacaaacctacaaaggggtgtcacactctcgcagcggtggcggacaatttacagcgcaaattaacaaagatggacaaactaagagaaaactaaaagtaatatgaaaaacgattcgattgattgattgtagattgattagttacaattgaaccggccatgtcccttatataggggttggtcttgccctctataagccctcctacatgtccaactcaggatataatccaaaggaaacccaaaacatgccttcccgagcaaggaaacttcgagacccgacgaaacagtccatgactcggactctgccggtcagaccggcccacacaccgccggtccgaacggccctcactcggcggtctgaccagcctatacacggcggtcagaccggccctcacataggaaaaccgacagactttcaaactttggcaattttccctattttactcctaggtgccaaatttgggtgtaaacacatgccccctgccttttttatgaacaacgtgaatctaaaagcacagaacatgttttttggtcttagggcgataatccaattaccgaccattgaacctcctaagcatcttgccaaacgctcgggaagtatttcgtcaagtatttcccattaattgctcgctgaaaacgctccccttgaagtgtctccaaaaaatatgcgttccctcaaacaatgccgcatactcaataaggaccttcccaactaggagaccacttactgaacttcctggatcgagtacccaaaggcaaaattgtcttccaaaccaagtctccaacttgaaacaactttgctttcacccttttgttgtacgccttggccaccctcttcttctctggtgtatgtagtccattatattgtttaagttgattaagtaagcaacctagtataattacacactcagcactgaactacaacaatgttgggaatgcaaccatacctacacacaagcaagcaacaaacgttctaccctactaactattcttcaaagtcactttggtggtttaggttctatggtaggatccaaacttcatcccattatgaaagctctgcacttcagttcgaccgtcatcttcttattccttgattcacttgacttggcctccataagtaaaccacattgacgtcttcgggtttctccaataagtttaacaactactcaagttgaaagagggaggcgagaggatgataaaatgatttgcagagaattctggagaaagaagaaaggaaatttttcacaaatcatgttttcggaaaatttgtccttaaagtttgaccatttggcttatcctacagtccagatggctctgataccaacttgtcacgcccggaaattcacaagtaatttccaaacttatttgtgcataaaatcctcatccaggaatcagccgaggtacacaaactggtaatttaatatacaaatccatcataataataacattacatacttacaaaagaaaagaaaaacaagagcagcagaataacggtctagcgaagctctggctctactcccacaggtagctcaactggggtataagccaaacgtcttctccttctggatccttcttcttcaactgaggtttgattgattattgtaaggtgagtacatggaatactccgcaagccacacaacaaatatgcaagtgcacaaggataccaaaggatggtataatatagactcgtttgcaaaagcagcatttagcaaacatttaagaattgtaatacaatagagtaattaatcatcaatattaatcaacactgaacagcacatccatgctgcacaggcccaaccaaacctgaacaaccaaccccggtcgtacagatcaaacctccaaaccagaaattagccattccaaaccaggagccaaattaattatcacattattatcattaatgagcagtgtgggactaatcacgaaaaacattgctcaccccgcccataaccacaggaacggctattcgaatagttttactatagccagagatgtacatatttacccacaggacacaactccacaaaatgtcaccatatcattatgtgcccatgctgaacatgtcaccatttatgtagttgtgacaagacccctcgcataactcaactcaaagtagtgcaccttttctagatcataatcaccccctgaataaccagaggcatcacgcacttctcgccgcttcacagtctggcgcaccacaatgagccttgctacacaaagtgtccagccattgcccaagctggcttgtggttagtacagttaatgtctcacaacagtagctcgcgaatcgttccttaattgtcatgagcacgaccatcaaaactatgtgctcacaacctaccattaatcaaattttagttggcaagtaattaataaccaatcacgattgaccatcgtgagctaccattaaatatccattattaagtaacagtgaaacattaatcatcccaatagtgtgctagtgtttctaagcatggctaagcatctattataagcatctagctgaaccaaaccaatatataaggttcacgctaatcaaattataacccataggaaaataaagtcatcttcggccataattaaatgggaaaggctcaccacccgatgacattcaaaaataatgcataagttgaaataaaacaatagctttaaacgggttcaatatgctcaaagggttatttgggatccgtgtgacttgccttatgaaaatcaatcaaacctcagttgaagaagttgtgaaggagaagacgtttggcttataccccagttgagctgcctatgggtatggagctaaagcttcgctagattttattttccgctgcagttttcttcgtggtgaggactaagtgcctcttatataagtatttattgctttagttattttgataaatccgtatattaaattgtcagtttgtgtacctcggccgattcctggacgagggttttaatgcacaaattagttcggaaattactagtgaatttctagacgtgacatgtggtctcctttgcagttttgttttgttgcaggaaattctgttttgtttccttttgcaattttgttttgctgcaggaaattcgattttattttttggaaacatgccgaataatctagtgcatgaaaacggaataaagtccgaataagttacgcacgacttatctagttcggttgcgcggagtggagatcgtgcaggtgcccctgatcaagcgtcctgatatctctatataaatcgagtcaccgcctccacgtggcacatgcaaaatcaatatagggttgcctcctcctctatattatgccctcgctcgtactctactccatcccgctcgccggcgtgcaccggcgatcgggagaacaggtctccggaaccttcgccttagacgtccttcaccgggaaaaggcggcaataaggattttagaaagcgctttgcacgactgcttcatattcgtccacaacggctggtcttcctcttcgctcgcgtgatgtgcactgtcgtcaacgcatggtaccacgagtccttgctgagaagctggttttccaaaaaccttcggtatgcattcaacatgtttcacatattcaatctgttcatggtttgctgtctagtttacatgtgtagatcgtatgatacgattatgctagtttacatctgcaatattgttggtatttcttagcgacattaatggaaatataattcccagcaatagcactagaaataatgctggtatattgcggttacagatatgatccgcaagcgcatggatataccattgtagcatttcacccggttgtagagggtgggaggagagggccaggaacgtaacagcagatggacgcggatgtcgaggacggtgcgaccagcagcgatggatggatgcgaagaacaggatcgagagaggaggggagcacaggagaagactttgatttgttgattgtgcccaaaaagttttaaatattttttcatcaatctgaatgccatgtcatttgccacgtaggctaaaaccatcagatctgaaactgggggggttaattcagcggttttgacagttggagggtgttgaatacccggttttttagtttgggggtgtagtttagacaaaagtaatagtttggggggtgtaaaatggacttatccctaagatttgcttaagttaaagttgtttcctctttctttgtcaaactttgcatcaacatggtatagtttacttgcttgcaatttaatttctacatggtcacaaatggagcatgagtttcatgattatttcaaagatgcaagcttgatggagcaaagaccgattgatcattcatcagtcatttgtgaaactatttcggttacacctatgcctaagaccagaattgttagtaatcctcttcatattagtcctattgattttgacaacaagaaagtagtgattcagtctagtcaaaccgaatctacgaaagggaaaagtgttattattggggattttcggcccgagacaatgaagatcaataatgtgaaggctgaagatcgtaaggttacaaaagatgagtcatctagttccaacaagaccaaaaagccgaagctcacttttgagatgtttatggctaagtacaaaaaaggattagctggtcaacgatttgataatcaaactagtgattcgaaaagaccaagatcatctcgtaggaagagatttggtcaaacaccaaagcaatcggagccatcaactataccaacttcatacaaacctctagttttaacaccgtgttatccatatccaatgtcactatacggttatccttttatgtattacatgccgtggatgcctcaaccatctatgatgtttcatcaagaatggaagcaatcacctaggtcagtaccaagtcattcatttaactctagtcaagaccatttcccacaaaagaatcggtccagtggatcaaaggtgaaaaaggtgaagaaggtgtgggtgagaaaataagccaaagctccggaggtcgttgctatcaagtaggagtctcaagatgttcaaagacctactggagatgcggtggaaaccatacaagcaaaggagatcggagccgacaccgtgattgtcaaaagtggaggtctgaccgagacatctcgccggtctgaccgccaacctgtggccggtctgaccgaccctactgactggtctgaccgacaacttgtagccggtctgaccaggcctagaggccgatctgaccggggggaattggagaagagtgggaaaattgagagtaacacaggagcttctacttcaaccaaatacatcaagaatcattgcttggttcctgaaaaacaaccacagccgaagtggataccttctggcttatctcgctctcaaatgaggaggctacagcgtcttcgagccataggtcaaaaagaaaagaaggccaaagatgtgaaggacaaaactgtgaaaatttagagcctcgaacaacacctaagcaagtgtgaagacctaaagaagtaaaagttaagagaccggtgatttcccagagtagtggtaagttcatgagagaagaatcatcggtcattagagaaaactctcctccacatgatgctatggatgttggtgcggtgttcatcttgccttcgaaatcgtgcaatcaagagagctgattttgctcgggggggcaagacattaatatgcttatgaagaaatcgagagagatgaacggcgatggatacaatgtcacatctttgagccgccgtttgttggatgctaaggcaaggtatgggtttattgtgttcatcattatattatatgcctatgccatgttagaacattgcttgctatctagcacatgtgtgtttttgcttatcaaattgatattatacatacatgttgcaaatgctagttctaagtagtggaattggtaagttggcatatgatttgtttaaagtctaatttggctcatgagtctttgatatttatttaaagccaaatcatatgtgtttttatggatcaccatataatatatataattcatatttattgcaccatgaaagttttgcttattagtaattcgtctaatgtcaatggtcaatgtgatgatttgttctagagttgttatgtttcgaacattggctttgttttaatattttgccaacatgctcaagccgattactaacatttgtagtttattagagttcatgtgtgagaggcatatgactttggtgattcgttattgatcatacttcaagtggctaagtgttttgataccttgatgattattgtttcaaaagccacttaaattggtattcatctagacatattagttgggtgttataattttctcatatgtctagaaagaaggaattttagtccaataatttgatacaccaagcatctggttaatatgtgaagaaaggagtatttttgatattagaaaagccagtgcttgattttaaatctttgggcaaaattggtgaagttccagattggggatggcctgaccgtcgcattatagccggcctaaccgcggatgaccggtggtctgaccgggtagacagggcggtctgaccggcattgcgtggccggtctgaccgatcccgggcagagagctggggggcatgttacaattggttcaaaggccaaattaattgtaaattcagacatttgtgcccaagagtcagaagaaaactagagaatccctttgatggaatatttgaagattctagttttagggttgatcaaaaattcggcggcaagcattcaaatacactttgcttaatggagagttatatcgccgaaatatagacgaagtactttttctaaagttgctatgggagtacttaaagggattcgtggaactcatcaatcggctcataagatgaattgattgcttaggagagcggggttctatcggccgaagatgattgatgattgtttcaagtactatagagtaaagcttgtcaacggatcggcaatgttcaattggcgcctaccgctatattgaatcctatcatcaaaccatggccgttccgaggatgggctttgcatttcattggtcaaatttatccttcgacatcaaaagggcatcggtccgtgctagttgcgatggattacttcaccaagtgggccgaagcgctcaagaacatgattcatatgaaggtaattgactttatcttgaagcatattgttcatagattcggtattccttaaactttgactacggatcgaggagcttcttttatgtccaaggaggtgaaatgttttgcagaatcttacgagattaagttgttgagttcttttccttactacgcttaggctaatggacaagccgagtcaagtaataaaacattgttaaaattagtcaaagagaagattgaagaacttcaaaagaagtggcatgaagtgttttcggaagtattttgggctcataggatatctaaatatggtgctaccaaagtcactcctttcgagttggtttatggacaaaaagccgttttgccgtttgaggtaaatcttggctctcttcggtatatcaagtaagacgatttgttggtcaaagattacaaaaccttaatgcgaagcaattttgaagacgtcatcgacaagcatttgaaaactttgaaagacatagagacacttcaaggacagcatttttctgcgagcaatcaatgggaaatacttgaagaaatacttcccgagtgtttggcaatatgcttaggaggttctatggccggtaatcgtattatcaccctaagacaaacatgttctatgcttttagattcacgatgttcataaaaaaggaaggggggcatttgtttacacccaaatttggcacctataggcgaaataggggaaaattgccaaagtttggaaagtgatgggtttccttcacaggaccggtcagaccgcaggtatgtgggcagtctgaccgcggcctgaactccggtctgaccgcaggtatttggccggtcaaaccgtcagggtccgagcccgagtctgtattcaacgggtctcgggtttccttgcttgggaaggcatgtttcgtgtttcctttggttctatcacgagttggacgtggagaagagtctgtagagggcaagaccaacccctatttaagagggacaaggccggttcaattgtaatcccccgaacacacaatatacttgaatcgttttctcttttatgtttacttttctgctatgttttctactttacactaattttagtccatctttatctatttgtgtcgtaaatcatccgccgccgctgcgagagtgcgacacctctttgtaggtttgtcctgaaaaccttccgttttgcccacgagacgggtagttatcctcatatcgatctaaatcggtctagagactgattttcatctctaaatcggctctgctaaccggtttagctgtttttctacaaaacccatcttgatttggccttttggctagatcgaggtggttggcgactccatatcaccgcaaggcgtttaggtgctgcgatcatgcttgtcgacttgtcacaaaaagttgccatcacgatttttggcgactccatattaccgcaaggcgtttagttgctgcgatcgtgcttatcaacttgtcacaaaaagttgccaacaatatgtagagcgagatatcaaaagcatgaaaatcttaaatcgagaaaaagaaacagtcgggctcggtctgctggatgtgctacggtatctgcatcttcatgcagaaagacaacatttagtatatcgtaagcagaaagacaattttgggctacaaaaccagaaagaaggaacaaaacatactaacaatgttcagttataacggccaattcaaaaggccagccatacgcagcaaactataacttcagagaaatgaaccaagctgctatttactgtatctgaagaaccaaagtggaaaatgcatggaaaagttggaagaatagtgtgctactattatggatgcacaccacttttgtataccagagaccgcacgaagcaccgggcatccaacattcagatttcagaccatgtggattctgtacttgacctaagaactcaatgttttcacattctcagctcactgcaagcgtaagtagacagctagagtttacaactaaatttgactgcatgcaaattcacttcggacaaatcaaaggacatccaccaaaaaaggatgtgttctgacacagaaaatttgagcacaaacatgcacatatccacacagaaattatcagctgcaatccaaaatcacaaggggaaaaaggcacttaaggcagcaaaaaggtgcaaataaactacgcatccatcattgctggctatctgcaagtgaattttgttcgaaaatgagttttgttcagttaataatactggactaacaagtaactatctctgcagtacagtatcatctacatcagaaacaatgaagtggaataaggtcaatcctactacatattaatatttctgccagctagtgctactaaattcagcactgcagatcattagcgctgcatcatgttacaactatcgatcataaagaaacagaacaatctgcattttccaattcccaagacatttgtgaacactgcaacttcagtaaaagaagcttgaattgaaatgcaaatttgagaaaaaacatgaagacagaaactaagggaacggtaagtcacctgcagatcaatttctccactgaattgagcaatcctgcttcagcttacaccagtaacaattttaacacgagaaaaccatccaaactcaacgaataaacacactaacacagtacatgctgatgaaggcatgaaagcttagcaacgatcacagactagcctgatcaccggcaacaatttcaacaaccaaaaacatgtgtcgtgcgcctcatgggagaatccaaaccggaggggagtagttcgacggaccttgctctgggaagcagcgctctacctccgctggtggcggtgctcccgaccatctcccgttgtcgctgcagggataccgccgttgggcggcatccttgtacacaaccatcgggtcgtggaagctccggtcgtccaggaagtagacgccctccatgccggggtacccatctgccgcttcgtacgatctggagcagcctcttccgacgaacagcattcggccgccaaggtcgggcagcttggtccagtagttgttgaacagctcgtcttctctctcgaacacccggaacgtcgtggtcggcaagcggccaggctcacgatctcctaacctgacgaccatgagcagcttcccccgggactccacgaggtagcgatcaaggaccggccgcccgtcgtcgtcgtcgtcgtcaccgcgccgctcgaagtagagcactgtcgtctgcatgtctccgagagggaatatcggttgacgaaacacacggatgttttcccctcgggtgaggaagaggaaggcgccagcgccatggccgctgtacaggaggtccaccacatccagttccagctcctcgtcaatccacctcgactcgatggactgcgagaacgcctcatcgcccatgcgccagaacgcgatgtgccgtgggttgaggggcctgcgtttgaagccgatgatgctggcgccgacgcatccctgatcagtcggctggctagagagggtggcggcgacgaaggcgacctcgaagtcaaatgtcaatcccggaagccggaaggaggggaaacggatcaggttggggaggttgagctgctggtgggtgatgaggttgaggaggacgtggttcgccgcctggtcgacggcctggaagatccaggcgccgttgtacgagccgaagcaccgcgcgcggagcgcggcgggcgggaggacgaaggggtgggggcggcagccgctggggacgcagtagaacgcgggcccgtcggcttccgggaggacaagccgcgggagcggcggaggcgggggccggagttgtagaagcgcgtcgcgccaggacctgcagaggccatccgcgtggtggcggtcgatctcgcacaggaggtggcggccgatcttgcggacgatgtcggggacgagctccgcccatggcggagactcgccgtcagccattggtggggcgagtagtagtggaggttccggagggatgggaggggatcgagtagtggaggtggtggcgatggcgaatggcacgcgacacgagagaggttgaagacgacgaggaggaagacgctgctgctagtagtatatatgttggatagttgcgtgctccagtttgcttcgtttcgaacaaattctggaagctgcggaggaagcggagcctgcttgcgttgcaagacttgatcgatggcaacttgcaggttgcaatttgaattcaaaactagttttgagaagcaccttaatttcgttctgtttaaaaggtattggaaaatttaagttccagagaactggcactctgcaaagtgcaaacctccacatgatctgggactgaatattgggtacagattaaattcagtggtgcagataaattggcattgtaacatttctttaagatggcgaattagcgttgtacggttgtaccaaggagtctatgagtaccggttagcaactacagcaatactgatgaaccaggacaatctgcagattaaaaaaaatccaattatctttcccccaaaaaatccaattttctgtattcctttgcagctgatcgatatgctcatctgcaaaagattactgaaatgtcaaataatgttgacgattatatcagactagcttagtagttcaattaccaataacacgagcggactttacattatatgcataaaaatttagatcattcagtgaaatgcctgacaccatctatcaggaatgcctaagaactgacaagcatattttcccaccgaattatccatttcagcaccaaaatgatgtaataccagcacaaccatttctgcatgaaacttcatttctggaacctgcagactaagggtgtgtttagttcacaccaaaattggaagtttggttgaaattggaacgatgtgacggaaaaattggaagtttgtgtgtataagaaagtttcgatgtgatggaaaagttggaagtttgaagaaaagtttggaactaaacttggcctaatttcagcggtgctgataattggcattataccttttagataatactgaattggcattggcatcgtactaggtataaaatggataatctgcagtctgcagactgcagatagcaaaaggtacaattatccattatcttatctgtattccacaccgttgagatggtctacaaatcttcagtgaagtatcaaagaactagtaactcttgtggacagaaaatgagttcatgttactcttatgaacaagatatgagttcaggttagtcagtcaatttgtttcatgtttgcagttctgctttgaccctctcatttcacagtgagttaatacctgagctaccagataccacaagcacactttacatccagcaatgaagcactgttcaattaaattttcacatggaattaccaatttcaggacaataatgatgtaagcccaacctaaccgtttctacatgcaacttcataggaataaaaatgaatagggtaccagaaaatagcaggtacagaaaacccaatgactgaatcacattcattttcagttcaaattaggaggattcctagattactacagctggcagtatgggaacaaaaacatttcaacaatctgcattgctagaatcttcaatctacatctacaggtgagatgttatcatgttaatactcttttttggtggcataacctagcttcacatgaatgatcttgcaatgcacagttgcacacacattcagacaacgaggaatctgcatattcagcttgaaacctaatcctgttgacgtttttttctcaggttttactcagagagctctgcacatggtaaatcaattaaaggaagataaacccattcagaattcttgcatcctctagcaagtcaaagtataataactccatcgatcaggaaattacatggactggccacaaaaatcaaagcataaccatgcggtacatgtctgcaaattgtccattgaaacacaaagcgctaagtagtaagctcatgaataatccaaatgcgaaagggtaccagaacaatagctcaagtatgatctaaaaaaaggagatggtaagtgcagagtaacacacacaaacaaaattcttggctacaagtgttcagttttaaaagcctatttacaaggtcaactagccgtatgcaacaagccaatacttcagagaaatgaaccaagcagctacttttcagaagaacaaaaaagggacagtgcatggacaagctggaaaaattgtgtgttactattatagaagctcacaggtttgtaaaatcgacataagaagcaccatgcatcccattaatgttcatggaagactttgtgagttttgcatttgagccaagaacctcaatgttctcgatttgagcacataaatgacttcaacggttcaaccaaggaaagtggactcaattaacatacagaaataatttgactgcatgcaaattaaaccagcttcaaataaaagcaaagaagtaaaaaggggtgtgttctgcgtcacaaaaggtgtccgcactgaatttatcaggaatcaaaaggtgtacaacaattgaagtgcaggtcgatcatagctggctttaggcaggtgatttttggtaaatgagtgcagtttcaggtttcagctagaataatttcaggattatctcaccagcgcaataccatcaaactctctatcagccactcgatcagcctcattgtgcacatgatttaggactaaatatgcagacaaatcaagttcagcagtgcagatcattacaactgtatcatgattaccaaggtataattatcaactggctgtcataaagaaacagaagaatccgtgcattgcaatatcgctacaacttaacaaagcttgaattgcaatgcaaatttgttaaaacgagtacagagaaacaaggtgaaaagtacttcttcatcttcagaatttcttcactgaattgaggaatgtttcatcagcttgcaccagcaagcaacaatctcaacacgagttcaccatcgatgatagaactcaacaagaagcttgaaacaaacaaacagcacggcattgaattgcagtgcaagtacagagaaactaagtgaatggtaattcatcatcttcagaatttcttcacccaattatgggatttttcgtcagcaaagctacaatttcagtatttcaacacgagatcaccatcgaactcagcaagaagctcgaatcaaacaagcaacacagcattgatgaaggcatcaaccacgcactgcactaactaactacttgatctgttgccaaaacatatcgctaacatgatctctaactaattaactacttcatctgttgccgaaacttatcacctcacttaggggagaatccaaaacggaggggaggttttcgacggaccttgctccggtaagcagtgcctgacctgcggtggtgatcccgaccatttcccgatgtcgctgcggtgatacttccttttgtcgtcattcttgaacacggtcgtccggtcgtagaagctccggtcatccaggaagtagactccctccatgccggggtacccatccgccgcttcgtaggatctggagcagcctctcccgacgaacagcatgcggccgccaaggtcggccagcttgatccaggagtgctcaactcgaaccacgccgtcgatgtcgttgatgcttttgactttctggtcttctcgctggaacacctggaacgccgaggtcggtgtcggcggcggcggcggcggctactgcgagcggccacggcgaggtcgagcagtacatgacttacgggtacccaacctgacgaccatgagcagctcgtctcgggactccacgaggtagcgagcaaggaccggccggccgccgccgccgtcgtcgccgcgcggcttgaagtagagctcgttcctgactcgcttcgccgtgcctgggggcgggaatatcggttgagggagctcacggatgtgttctccgttggtgaggaagaggaaggcgccagcgccatggcggctgtacaggaggtcctccaccacttccggttcctagttcatcgccggaatggacttgtcgccaatcttccagaacgcgatgtaccttgggtggtcggggaagctgtgcaagtcgatgatgccggcggcgacgcatcccggttcggttggctggcacgagagggtggcggcgacgataacaataaacttatccgcttccgctgtcgtcggccggatttggtatagccgctggtcagggaggctgaatctgaagcgcttggagttgacgttcttgttgatgttgtggaggccgtggcggctggattggctgatggagaggaagagccagccgccgtcgtaggagccgaagtagcggtggtgcgcgaagcgtggcatggggatggggatggggtgggtgcgccagttgctggggacgcagtggaacgcgtgctcgccggcgttcgcgacgacgagcagcgggagcgggggaggcggcggcccgacttgcagaaacgcctcgcgccaggagcggcagacgccttcgccgaagcgacggtcgatcttgcacaggaggcggctgggatcccgcggacgatgtggattgggaggtccgcccatggcggcggaggctcgccaccatcagccattggtgcagggtgaggaggacctggtggcgggaactcgtcagccattggagagacgggagtgggagcagtggttgtttggggatttggtggtggctaatggcggcacgagacacgagagtcgagaggttgaagacgacgaggaggaagacgctcgctgatggtggttagttacgtgctccggtttgattccttctggcttctggaaggcacggtgcacggaggaagcgagctgcttgtgtcgcaactcgcaagccaacttgcaattcaaattcaaaatcagcttcagacggattcgtatctatagattctagcacgaacaactcgaaatcgcaacctacacatgtctcattttaatttgtaaggaaaagctggttgcatatatcaggcccgtacagtcacaagcagtgtttacactttcgtttttcaaaaaaaaaaaaggattttctgtggtcaccaaatttttgggaatttagaaactcttttggacgaaattatttgataatttaacaaagtttgaatgaatttgaataaattttgactaaattcaaataaaaacaaaaagggggaaatttttggcgaaatgtgattgccgatggagtgagaaatttattatttatctatctatctatctattatctatctattatattattaagactagggatggcaattgtacccgtttgcccgtttacccgtgggtaaaaaccctattagggttgggtttgttctccattttatacccatgggtatcttattggttcaaaagctatacccgatgggtaaatgggcatgggtatgggtaatcactacccatgcccgctttgcccgtttacccgcgaaatctaacttacatgtaggctaggagcaaaatccactagaatacataagccacgttctttgttttctacggtttccttttatttcccttattatttctctcctcttactctatcgccaccagaggagagacacgacaccgagccggagaatatttgatgttttaagttcgattcgaacttagtagcttgtagactttttgttccactgcttttgttgtggcgggtaaacgggcacgcccgcgggcataaggcgccggcgggcaatgggcatgggcaaccatccttacccgtgatgtagtaatgggtatacccacgggcacaaataatctcacgggcatgggtatgggtaggcactacccgtgcccgtcgcgcccgattgccatccctaattaagacagctttgaaaggaggctccacgttcgctgtgggggctagaaattaccatgttaatcggagaaaaaagaaaaatctggaccgttagattatactgtgactagactttgatggcgtagattaactttgataatagaagtccaaatagaaaacaactaggtagtactagatcaatcggacaacattgatcatgtacactagaatacaagtccaaataggtggacgtactgctgcttctgattctttccttattctagacggataaagagttcaggggattaggattcaaacgcatggcatgcatatagattttggagctggtataattagaatttaaatgtgtttttttacctatggctgaaaaaatagtaaatacatgtgatggaagatggaagggattttttttctcatgttcatcaaaacatagcatgcaaatagaccagaaaacatgcattggtagagatacatactcccaacatccctctcactaaggtgtgttcaaaattatcattggtattcaaaactaaactataactttaaatttctcacatactacaaagtttgtagcaacaaattaaatcataatcatataaaattaaatttaaatgacaatccaatgaaactacttttaacaaataaaatttaatttataataaaatatttactggtcaaatatttaaagagttgaattttaaaatgcgtgagtatcttagtgagtgggacagagggaatacatactataaaaaggtaaatctatgcacgtgattttaaaaataaaattccaatcatgattaaaagaaggggcattgggtaggccgtaaagttgcaatgttgggatggttgacggaacttctaaaaagtaaaaaaggaatcacaacgataaggtttgatttcaaatggatatgaaaattaagaggggcagtgggcaggctgtactaaagtaccatggtgatgcttgatggaactcctaaaaacatatgaagggaatccgacaagacaatgaactctaaaatctatagggtctgttttcaaaggatccaagagaatgattaaagtcatggtaggctggacaagcaaataaaggatggcaaatgagtaagggatgatgattggtgggacttttagaaactataaaattgaaaacaccataatgataactttcgatctcttaaaatctaacgagatactatttaacatttctttttagaaaattatgtatgggtgctagccgcgcaattgcgcaatattaaaagaacacaatacgatattacttaaagttcgaaacaaaaaataaaataaattatggaattagaaaaagaaaataagacttcaactacaaatacaatttataaataagtaaaattggtgataaaaaataaagactaccgaatgaaaagaccatttaaaacacatgacaagattaattaagtaacagagtagagtgatggcgtttgatgggacatctaaaaactataaatagaacaccaaatataatcctaatgaggatttaaaggaaggacgacgggcaggtcgtgaagcaattggtcaaggcggttggcgggacttctagaaaagtaaaaaaataagccccaatgataatcatatttgatttttaaaatcttaatgactgttacgtcacaaaacgactctaaaatacatcctctaaattatgcctagaataattaaaatccgtgtgaaagcctccaaaaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggctttataaaaagaaaaaccctaaaggtcccctttccctccctccccc

SEQ ID NO: 44136 - DNA, 13987 bp, Oryza sativa
  unsure (1)..(13987): unsure at all n locations
gcacctcatccgtccgtttccgcctctcgccgcccttcctcctcgccgaaatcaagctcgcgtcgtcgttctctctctccgccgtcgccgccgagctccggtcagccgccgtcgtcgccccggaccacctcccacataggcgccgcctccttcggcttcgccgtatcctcgccgacctcatccacccctccatttcgctcgccgaccgccggaacaccgtcgaccccgtcgacccgagccgcgccgccgccttcctccgctccggccgccttttttcgtcgtcgccgtcgacctagggtgagccgtggaccgccgcctcttttcccccttcccttcccctctctcggccgccgctccgccgtgcctatggccgccgctggcgaccataggggcgcgggcgccgcctcccgccggctgcgccggcttggccgccctcgggcgcgccgagtggctgccgcgtggggcccggctgtcagccgcccgtgccctcgggtgcggctgacgcgtgggacccacggcgccggccggtgtgagcccgggtgcacccggtccaccgtggaccgtgaggctgccgcgtgggccccacttccgtggacccggtccgcgcgccccctcccctcggctgacgcaataaaccctttttaaattaaaatttaaataaagaaattcgcaaatattcatttaaagagcatataaacttcaaatgaccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctacagcttcggaagatccgctcttcgtggaggttgatgccgacgtttgggaaagcgagcaaggcaagtcacatcatccttgaacatattgaatcccagtttataaaattattttgatttaaattattgcattaccgctttatttaaatttccgcgttatcactgttttatctagccatgcctatttacctttgttatgaccttattattgttattgttattatttcgttgttcaccctagaataaacaaaaccccaactagtggacactctactcatggtaccactagtatgattttaggtagatgtttcgctaattaattaggcaacattatgtggttttataactctagactttgggaatattctcatcacctggacactatggaatggttggattattgtggaattggattcacacctccccctctattcaaaaccctcaaaatggttttaggctaggctcggggtgcatggttttgatagtagcacctcggccatataaggaccggtcttcgggcctctgttggaaagcactaccgtccttccacatgtctagtgggtaaggcttagtttgtggctcagtctggttataaacaaaagtacacggatggagatggatgaagtcggtggtcgatggacatctctaggacaaatgaaggctacacgagctgcggcccggtagtcgagatgacatggcacagggccggtgtcctgctgctaggggctcagtcctgcctacttgtcccgggggttccggccgtaggtggggttgggtcggtactcttctctatggctaggatgggttggaaactatgtcacgtcttccgtccgtataccgtggtggtatgtggcacgtggttacacgtgaggaagatgtgtattgtgggtaaagatgtacacctctgatcagagtataatctattcgaatagccgcgccctcggttatgggcaagccgagcaatgtacccaagttagttttttaattcttaaaacctgcttaataactaaaatgtggaatggttggcctgggttggcttgggacgagctgggacctagggtcgggttgccagttcggtctgaatcatcgtaggccttgggttaaggcaggttcgtgtgggttcacggccttgtttaataatattgtatagctctagaatcgtgtttacaaaatagctttgagcaactaagtgtcttttaatgctgtttactgcaaaccctaaccctttatattataacgcccttatactcccttgcatttatcctgcacttgtgggtgtgtcttgttgagtacggtggttgtactcagtcttgctcaatttttcccaaacccagaagttgatttcctggaagatgaaggctttggtgtctagctcgtgtctgccgtcaagcgcctgtggtcgtcgccctagtcttccgctgtttcccgtttgtctttgtgtgtgctgggccttcgccgcccatgtaataaattatctatttacgcttctgcttgataaactctgaaatgtatcaacttttggtgtaccttgcctcctgggacaaggaataatacacgcacgtaaggagcgcccgttgggttaattccggtcgtgacaagttggtatcagagcccccttgaccctaggacgagccgtagatcccaagccttagcaatattttcaaaataaaaatcctttcttatttgtgaaaatcctttagtctctctttgtcctgctgcttcatttatcgtcaaaatctgatctttaaaatgttgcttttctcgtttgtttgtagatggccggtagcatcaaccgtcgtggtctggacctgactggcttcgttttgaagctgcggagcatgtgcgctgtcctggggtatccacatggagtggactaccagggcaagtagctcccggagcaggagggtgacgatgcagagccccacgctgcttgggaggttactgcagtgatcctcactggctcatccgagaggacttcgttggcagtcaccgcgggtggagattccttctccgccgcttgccagaacgccgcactcctcgccatcggcactctacaccagcgctacccggacgagttgcagcacttgccctaccgctaccaccctcgtcgcggaggagcccgcgactacgccaccttccgggatgctagctcggaggatgacgctaccatcatgcacctggcgcgcatggtggaggatacgacgcggcccgtatcgacttccatcagatggtgcatcgcgggttggtcgagaacaacatgaagatcctggagctgtgttaggagaatctgcagctgaagaaggacctagacgcagtggaggcgcagcggtgtcaggtcaagatctcccagggagaggtctgtcgccccaagcgtcgccgcgtctgccgcagcctgaagatcaccgcccgcaagagtacctccaggcccgagcttgttcgtcagtccctggcgtggacctgcttcgtcgagacccctcgtgccgagcccacccccatggttcctcaggaggagggagcctctggcgttggcagcacggaggatgcgctgctgctcaccttccgccctggcccgtcgcagaagtagacgagtagttaagtaggcttgcgcgnntgtgttcttctcgntttatttttctngctagagtcgtatggggcatggttatgccggtgtgtggtataactgtcggagcctgtctttattttatttgcttaagcaacttgaaccttaatgaaccaacttaatagcagtaataaattcaagaattatggtagtcgtgggtggttagttttaattgtcagctctctctgtttgctggttctgtgtgggattttcagatggtgacgactaggagaagtgctaataccggtgatggcaaccaacccgaaggtagcaaccacaacaaccatggcagcccacctccacctcctcctccacctccaccactaccaccagacaccaacgccatcctcacccaaatcctcgcccagcaggccaacatgatggctgctttcctccaccacatccaaaatccgccacagcataatgctccaccactacccccacaacactctaaactcgccgagttcctccgcatctgtccgcctaccttctctagctccaataaccccgtggatgcgttagattggttgcatgccgtggggaaaaagttagacaccgtgaagtgcaacgatgaggagaaagtcatcttcgccgcccaccaactgcaggggcccacatctctatggtgggaccatttccaggctacgcagtcagaaggacagcatattacttgggctcgcttcaccgccgctttccggagaacccatgtgcccgccggagtcatggcccttaagaaaagggaattccaagagttgaagcaaggcaaccgctctgtgatggagtatttgcatgagtttaacaacctggcccgatacgccccggaggatgttcgtgaagatgagaagaagcaagagaagttcttggcaggaatggaccctgagctgtccgtgcgtctggtctccagggactatccggatttccagcgtttggtggacaagagcatccgtttggaagccaagcacaaggaactggagtcgcacaagcgtcgcttggcaaatttccgcaatcaacagggggctaaccaaagggtccgctacaccaacccctatccagggggatcctcctcacagcagcagcagccacgctccgcgccctgacctcaattcgtggtgcatgtcccacagccgcagcaacagcagagtcagcaagggactcgtgcgccccgtcctcctacgccagccgtgcagcctggacaaggccacagagacattcaaggtcagcagcgtctgtgcttcaactgctttcgagcctgggcactttgcggataaatgcccaaagccgaggcgccagcaaggccaagcacctccccgccccaacaacggtggtaaggatgtcattcggggtagggtgaatcacgtgactgccgagaatatgctgacaactccagacgtcatcgttggtacgttcctcattcattccatccctgctaccattttgttcgactctggagcttcccactcgtttatatatgtgccattcgtggggagaaatcggttgggggtagaaaggcttaggaaccctctgctcatcaccacccctggaggggttatgacagcaaagtattatagccctgccgttcctatagaaatccagggaattccttttccctcggatctgattcttctagacaccaagaacttggatgtgatccttgggataaattggttggctcaattccaaggagtagtggattgtgcaagacgcactgtcactctgtaccgagggccggaacaaccggttgttttctttgcacccccaacctctgtcggtagttcagaacttcatcagataggactgtcggaaatccccatcgttagagagttcggagacgtgtttccggaagaactacccggtatgccgccgaagcgagagattgagttccggatagatcttgctccaggaaccactcctctgtacaagcgaccctaccgtatggcagcaaatgaactggccgaagtcaagaaacagttggaagagttgaaagaaaaggggtatatacggccgagtacttccccctggggtgctcctgtgatttttgtggaaaagaaagacaagacaaagaggatgtgcgttgactacagagctctcaatgaagttactatcaaaaacaagtaccctcttccccggatcgatgatctgttcgatcagcttaaaggtgccactgtattctccaagattgatcttcgttccggatatcaccaattgcgtattcgtgaagaagatatcccgaagaccgcattcaccacgcgatacggactgtatgaattcacggtgatgtcgttcggtctaaccaatgctcctgccttcttcatgaacttaatgaacaaagtgttcatggaatacttggataagtttgttgtggttttcattgacgacattctggtgtactcacaattagaggaagaccatcagcagcatctccgtctggtgttgggaaagttgcgggaacatcaattgtatgccaagcttagcaagtgtgagttctggttgtccaaagtcaaattcttagggcacgtgatatctgctaaaggagttgctgtggaccccgaaacagtgaccgccgtcactgattggaagcaacccaagacagtcacccaaattcgcagcgttttgggtttggcaggatactaccggaggttcatcgagaacttctccaaaatcgctcgacccatggcacagttgttgaagaaagaagagaaatttgtgtggagcccgcaatgcgagaaggcgttccaaactctcaaggaaaagctggtttcctcgccggttttaatcttaccggatactcgcaaggacttcatggtgtactgtgacgcttcgcgccaaggattggggtgcgtgctcatgcaggaaggtcatgtggtagcctatgcctcacgccagctacggccccatgaaggcaactaccctacccatgatttggagttagccgctgtggttcatgctctaaagatctggcggcactatctcattgggaatcgctgtgaaatatatactgatcataagagtttgaaatacatcttcactcagtcggatctgaatcttcggcaaaggagatggttagaactcatcaaggattatgatgtgggaattcactatcatcctggtaaggccaacgtggtcgccaacgctctaagtcgaaaaagccactgcaacactcttggcgtccgtgcattccaccagaacttaatcaacagatggaagccctgaacctaagtatagttagtcgtggattcttagctacgctggaagccaagcctaccttgctcgatcaaatccgcgaggctcagaagaatgatccggatgtgcgtggactcctcaagaatatgaaacagggtaaagccgctggtttcacagaggatgaacacggaaccctatggaatggaaatcgggtatgcgttccagacgacagagaacttaaacagttgatacttcaggaagctcacgaaagtccttattccatccaccctggcagtacgaagatgtacttagacttgaaagagaaatactggtgggttagtatgaagcgggaaattgcagagttcgtggccctttgtgatgtgtgccagcgtgtcaaggcagagtaccaacgaccggccggacttctccaacctctccaagtaccagaatggaaatggggtgaaattgggatggatttcatcaccggacttccaaaaacccaaggcggatatgattctatatgggtagttgtggaccgacttaccaaggtagctcggtttattcctgtgaagaccacctatggagggaacaaactagccgagctctacttcgctaggatcgtgagtctccatggtgttcctaagaaaattgtatctgataggggaagccaattcacctctcacttttggaagaagctccaagaagagttgggtacccgattaaatttcagcaccgcgtatcacccgcagacagatggacagaccgagcgtctaaatcagatcctagaagatatgctccgtgcctgcgtcctagatttcgggaagaccggggataagagtctcccctatgccgagttctcctacaataacagctaccaagccagcatacaaatggcaccctatgaagcgttgtatggacgcaaatgccggacaccgctattgtgggaccaagttggggaaagccaagtgttcggaactgatatcctgagagaagctaaagctaaagtcagaaccattcgggataatctaaaggtggcacagtcctggcagaagagttatgcagataaccgacgccgtaatctggaatttgcagtggacgattttgtgtaccttcgggtcacgccattgcggggtgtacacaggttccagacgaaagggaagcttgcccctcggttcgtgggtcctttccgtatcattgctcggcgcggggaagtcgcttaccagttggagctgcccgcctccttgggcaacgtgcatgatgtgttccatgtgtcgcaactcaagaaatgtcttcgagtgccatccgagcaggccgattcagagcaaattgaagttcgcgaagacttgacctacgtggaaaggccagtgaaaatcctggacaccatggagcgcaggatcaggaaccgggtaatccgtttttgcaaggtccaatggagcaactacgctgaggaagaagctactacgctgaggaagacgagatgaaggcagcccatcccgatctcttcgtcagttcttccgaatctcggggtcgagattccgtttaagggggtaggtttgtcacgtcccaaaacgactctaaaatacatcctctaaattatgtctagaataattaaaatccgtgtgaaagcctccaaaaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggttttataaaaagaaaaaccctaaaggtcccctttccctccctccccctcttgggccggctcggcccatctccctccccctctctcccctctccccgcggcccactcgatctctccccgcgcgcgcgccgctgacgggcgggcccgcccgccatcctcgctgacgggtggggcccacccgtcatccccttcctcccgccgctcccgccgcctcgcccgcgccctagcgccgccgccgccgccgaatccgccgcatcccgtcgtccccgcgtgtaatcaatagaggggaattattccccgtgattctctctccctttccccccatttttccctctctctcatgcgttcaaacgggcggacttgcccccgcaagtctcgccggcgccattgatggcggccgacctcccgcgccggtttccttccttccccggtcgccctctctcgccccggctctatttaaacccaccccgcacctcctccgtccgtttccgcctctcgccgcccttcctcctcaccggaatcgagctcgcgccgtcgctctctctctccgccgtcgccgccgagctccggtccgccgccgtcgtcgccccagaccacctcccacctcggcgccgcctccttcggcttcgccgcatcctcgccgacctcatccacccctccgtttcgctcgccgaccgccggaacgccgtcgaccccgtcgacccgagccgcgccgccgccttcctccgctccggccgcctttttcgtcgtcgccgtggacctagggtgagccgtggaccgccgcctcttttcccccttcccttcccctctctcggccgccgctccgccgtgcctatggccgccgccggctgcgccggcttggctgccctcgggcgcgccgagtggctgccgcgtggggcccggccatcagccgctcgtgccctcgggtgcagctgacgcgtgggacccacggcgctggccggtgtgagcccgggtgcacccggtccaccgtggaccgtgagggtgccgcgtgggccccactcccgtggacccggtccgcgcgccccctcccctcggctgacgcaataaaccctttttaaattaaaatttaaatgaagaaattcgcaaatattcatttaaagagcatataaacttcaaatgaccataacttggccatttgaactcggaattggaccgttcaagtctctaattttttcttaagaagtcaagaacccatttttgtgctttgttcctgcttgttatacggagtttattagagtaaaagccttttcttttccgttggtcgtgtagacgctgcagcttcggaagatccgctcttcgtggaggttgaagccgacgtttgggaaagcgagcaaggcaagtcacatcatccttgaacatattgaatcccagtttataaaattattttgatttaaattattgcattaccgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctgattaattaggcaacattaggtggttttataactctagactttgggaatattctcatcacctggacactatggaatggttggattattgtggaattgggttcacacctccccctctattcaaaacccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctataggacaaatgaaggctacacgagctgcggcccggtagtcgagatgtcatagcacagggccggtgtcctgtagctaggggctcagtcctgcctacctgtcccgggggttccggccgtaggtggggttgggtcggtactctcgtctatggctaggatgggttggaaactatgtcacgtcttccatccgtataccgtggtggtatgtggcacgtggttacacgtgaggaagatgtgtcttgtgggtaaagatgtacacctctggtcagagtataatctattcgaatagccgcgccctcggttatgggcaagccgagcaatgtaccgaagttagtgttttaattcttaaaacctgcttaacaactaaaatgtggaatggttggcctgggttggcttaggacgagctgggacccagggtcgggttgccagttcggtctgaatcatcgtaggccttgggttaaggcaggttcgtgtgggttcacggccttgtttaataatattgtatagctctagaatcgtgtttacaaaatagctttgagtacctaagtgtcttttaatgctgtttactgcaaaccctaaccctttatattataatgcccttgtactcccttgcatttatcctgcacttgtgggtgtgtcttgttgagtacggtggttgtactcagtcttgctcaatttttcccaaacccagaagtggagttcctggaagatgaaggctttggtgtctagctcgtgtctgccgtcaagcgcctgtggtcgtcgccctagtcttcctctgtttcccgtttgtctttgtgtgtgctgggccttcgccgcccatgtaataaattatctatttatgcttccgcttgataaactctgaaatgtatcaacttttggtgtaccttgcctcctgggacaaggaataatacacgcacgtaaggaacgcctgttgggttaattccggtcgtgacaatgacaataaaaatgagaggcatcggacgggtcatatatgagtacaatggcagagccgccaatggttgctaggacttctagaaagtaaaaaatgaattccaatgattgttatgttcgggtttttaggatcccaatgacaataaatagtagtcggcagataggtcgtagaggagtatagtggcagcgtttgacgggatttctaaaagttataaaaaataaaacccaatgaaacaatgaactctaaaaactataaggtctaatttttaaaggttcgggcttctaaaaagtataaaagaaacccaatgataaacatgtttgattttaaattctcaatgacaataaagaagggaggcagcgggcaagccgtaaaggagtacaatgactaagtcgctgacgttttggcagaaattctaaaaagtaaaaaatgaacctaaatgataattatgttcatttttaaaataccaatgacaataaagagaaaatacagtggacgaccgtagagaagtataatggcaatgtttgacaaaacttctagaaattatataaacgaaacccaacgggacaataaactctaaaaattataagatccagtttttaaaggttctaaggagaatgaatagaaacagcagtagatcgagcaagcaaataaagaaggatatatcataagtaagcagtagcaactggtatgacttttaaaaactataaaattagaaacacgagaatgataaggtttcgtctttcaaagtcttaaaacaacgagatagatatttaataaattttaagtaaaaacatatttaaaaatataattttgtatgggtgctagccgcgcgattgcgcgggccacccaactagttattatatactaaaagtccatgaaacttcctacaaacactctcaagccgccacttggcgctctaataaaatagagaaaatcctagatattctaagaaaaaagcaaaacatctattctttgattttcacttaaattggtgggtccaatattatacaccgttagataaaattgatcttaaaacatactaattaccgtgggtcccacctatcctcctcccgtgcattggcatgtggagtatatacgtacatacgtacatacgcttccttcccctccttttcttttcttttttcttatttttttaatttatatatttaatggatatattttttaaataatcattattttacaaataaagaatctaccatcatataatttaaacgggtgtactctttactttgtacaattattttcaaataatgcactactttaaaataaattttacacaattatatcgtatacttatcaaataaacaatatctatattaacttatttatacgtgcacttaagctgatagccccattatataaatcatcggatctactttttattacattgatctattactcttaagtaatgcactctttcaaaataaggtctacaccattatattgtctatccatattgtgtttcataaaattcacggaaatacttgccactaccctcccatctctctgcacctcatacatgcatacatgtatgcatttttgcgagttttaaaatgatttttctcataaactaattatccaatctatgatttgattacaccgttgtattcgttgtaattaaatctttacaacaagatatcacatgattatattttgatagaagaaaaacatatgtttcaatccgttaacactagttgtttcatatgtggtagcgacatgtttcaacgtatatcttcatcatgtttcataaaatttttaaatgtttcagttgctgattttttttcaccatatataatttgatgtttcactgctcaatggtcaactagtaacatttgaccaaccaattttttttggacatcagacgtcagatgggaagattccttatgattgtggagtgaaaaataaagtgcagcaacatgcacatgcacatacgctcagaggttggctgggcgtccgatatttggtgggatatcggacgtccgagccgtagcgctctccgaacatgcaaggcccagcccacagctccacacacacgggaggcaaacagaagtccaaaacgtagtccgccaaagtcgctaaccctctctctttttctctcgattcttcggaaactacggcgctagttcctctttttgcggcacagagcgacggttctttgttaccagacggctaactctcacgcagggttcaccttaccgttttagggtgggttaccgaccccccgcggtaaccgcgcggttaccgccaaaaaccgcacaaattccgcatccaaatttttgaattcaaatcacacggtatgatcgaggttaccacacggtttcagtcggttaccgcggtaagtaaacggttaccgcgatatgtgaatcagaaaataaggagaatgcaaaaaaaaaggagaaacacttaaatgtgagtataatttggggataatagctctaacaaaaaatatatggggataatagctctaacaaaaaaatatatgggagacttgaaaacttaagatgtgattatataatagaaaaattcggcatgacctttcttttctatattgtgcagttcaaatcaatccaataattcataacattataattcaacaataacaatcatcaatctcatatttgaaagcataacgatgtccacatg

SEQ ID NO: 44137 - DNA, 6693 bp, Oryza sativa
  unsure (1)..(6693): unsure at all n locations
acggttatacacatacgttggatagccactttcaatgctagaggcactgaatgagctggagctatcctgttgtatgtcaacatgttgttgctgttgttggcctctcgatgcaatggtagttcgttgagagcttggagcaccatgatcgtggtcctgagtagcatgagtaaagtcagcctcacctgcaaatgagaaagttgcaagtaaattaactagtactgaattggatggtgaaggttgaaatagcaattaaattatatcacaccagtgaattgaatggggctgtggtgatctaactgttgggtgtgacccctaggaggcacatcagtagttccttggcctccttgaccatcgtcgtctccgtcatcggtttcagttcttgaactactatcattagactcttggtagtctgggcttccttgagtctcttcatcgctatcaacattagtcgatcgtagacctttgccctttgtctttttagatggacgtgcttttggtggctttcgagtcttcctttttccaatatgagtgtcacctacattcttatcagcccactcaacaaaactagaagctcccgtggtcctgtgcaggtcatccaagtccactaggtcggttacaagtggactaggcaagggggcgtcactctcatttgaatcttcatctagttcagggcaagcattcgaccgagcagtgtccatccatttcttgatctgattgttagtttcgtagaatgagaggtccgctaatctttgaaggggatcgtcgtcctccgtcctaacttgggcatttgctcgccgaattcgaaggcgaaggttgtagttcacataaactagcttgttgagcttcttgtgggtaagtctattacgaaccttggtatgtacgaaagcgaatgtgctccaattccgttcacatccacttgaagagcaacattgaccaaccaaacgcaacgcaagcttcttcaaattcggcgtgtctgaggcgaacatagaccaccattgtgctgcaattgccgagtaacatgtcattttataatattgaatacatcaagatcgattggacatatcatagttccatgattagaaacataccaggagacgttttcccatctatggccatctttcttgctagtgcccttccaaattcgcccgtcttacgtcgatacatctcaacctccagcaaagcggcggcggctgtatcgatgtccgtcatccactcgaatgcctgtcggaggtcttggaagacagtggcacttggatagtacgcatagtgcgtcctagggttcaatgcggcagctacaaaacatgtcataggttaagtacgagttacacaatacgacatgtggattatgttatgaccaatacttactggcattgatcagagtttcattggttaggtcgtgcatccttctgttaacaatctccatgtatgcttcaaacttgtccctttgattcgcaaaaatactgccgtactccattttgagcaactgatatctcagaagtacctcactcaaattggggttcttgtcctcgtcagcaaaccgaaggaatgagtacataggttggacagaattcactactgcctctaagttctcccaccaagatatgctagatagacatgcgtgtgcatatctaccttccgttgtcccgctgaatttgctttgcatgaagtcagaggaagccatccattgcatgaaaagatctcgcttcctaaggaaactctggaggaacatgtagttcgtcccgaaccttgtaacattccacttaaccagttcaccacctatagctgtgaccatcatagcatgcaacttgttatgattgtatagccatctgcaaatttttctaccacttgcaatcaccatttcgtggtttggcattttcccaacatccttaagcatcaagttgactgtgtgtgccacacaaggttgccacacaattctttggtattcttgccgaagtagtctgcacgccttcttatagttagacccattgtcagtgataatttgaacaacatgatcagggctgtaacgtcccgccttcccccaggccgggcccgcttacatctgatagctttcatactgtaggataagccaaatggtcaaaccttaaggacaaatcttccgaaaacataatttgtgaaaattttcctttctttcttatctagaattctttgcaaatcgttttgtcgttcttcccccttcctctttcaacttgagtagtcgttaatcttgatggagaaactcgaagacgtcgatgttgtcaacttctgcaagtcaagtggatcgaggaataagaagatgatagtcgaatcttaagtgttcagatagagtgaagtttggaacctatcttagaacctatgccgccaaagtgtctttgaagaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaacctggttaaggtcttgtctttagtgtaacccctctccttctaccttttctaatctgcatcagaatggtgggatcatttccggatgaacagagcagaacgacaaccaatcacttgggaagagtttaccgaaggattcaagaagacacgtacctgtaggagttgttgctttgaagaagcgtgagtttagggctttgaagcaaaaggatcgtaccgtggcagagtatcttcatgagttcaatcgtctggctcgctatgctccagaagatgtgcgtactgacgaggaaaggcaagagaaattcttggaaggtccgaaggatgaactgtcagttatgttgatctctcatgactatgaggattttcaggagttggttgataaagcaattcgactggaagacaagaagaacaagatggataaccgtaaaaggaaaatgactgtatcccaggaggcacaaggtagtagccagaggcagcgtatcaagccactccaaattggtgaatctttttctgcaggtcaagaacagtcacaacagttgggcatcagtggtgagatcaactcagatactaatgcaagcaatgaagacaatgatgagcaagctactcaatcagtgtcatttcagcaggatcagtctcaagaagataacagtaatggaagggagcatcgggtgtgtttcaattgttatgagccaggtcacttcgtaaaagagtgtccgaagccgaagcgtcaacagccacaaggccaagtcaacaacattgtcctcacaggagcaaatgcagtgccggttgcgtctcaagggatacagctcagccatcagttccaaagcagcagtagctttctttaaaaccttagaataattattggagttgtggaataaaagatagactgtagtttacctatgcctttttctttctagccgttccgaatctcgggacgagattctttgtaaggggggtagatttgtcacatcctgattttcgtttcaggatttataaattatttaataaattattaatagaatttatattaaacgttcattaatttactagtgaagttaaatgtgggaaataaaatttcctaaatataaagcatggaaggatttaatttttattaaattcttcatggttaattatactctctggaattttctcagatttttcggagctcaattcctaatttttaatcatacaaagagcatttcagtaattacccacatattaaattaatcattaaatggtctaattgtaatttttttaagtactttgagtgtccaagtattttcaggatttttcttgaaattatttgagcattggaagtatttttaataattcaaagatcatttaagtgattattttaattgggaaagtaataaaatcctcctcctcagcttgggccattttcagcccattccttcctttccttcctctctcttccgccggcccaacctgagccgcctcctctcctctcagcctagccagaaaagtctattttctttccctgcgctactgttcatcttccaactcaggcagagcccgagccagccgtgccgtgcacagtgccgccgcctcttccttccaaatctcgcctccccgttgctctttttctccaattttgttgaggggaaatattcctcttatcctcctctatctttacccccaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagctccgtcgccaccgccgccaagcaaaccgccgccgccggccatctccggtgccgccgcgccgccgtctccatcgtcgtcgccggtcgccgtcaccaccgttgggtgcgccgtggtgaggggaagctcggccacccttccttttccgtcgctggtcatcggagctccgccgccccgtgcaacccgagccgccgccgtcgcctcctcgtcgccggccgtcgtcggtcgttgtttggcacgagggtgagtatcgttgggttcgtctcgtcgtcctctacgtgttcatgtcctccaaatccgcagccggtcgctctatctccggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatattgatcctatatttaaattctctatttatttcatctgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggatgacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgcctctagtttttgagggggtgattatgatccaggaaaggtgcgctgtaatggattatgttgtgcatggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttaatacctgataataatttgcttagctcctggtttggagttagatctgtacagccgggtatggttgttcaggatggttgggcctgtacagcatgggtgtgctgttcagtgttgattaaaatttttaattaattactctactgttttactactcttaactctttgctaaatgcgctttcgcaaatgagcctatattatgccatcctttggtattcttgtgcacttgcatatttgctgtgtggcttgttgagtatgtcatatgctcattcttgcaataatcaatcaacctcatttgaagataaaggatccaaaggagaaaggtttggcttataccccagttgagctgcctgtgggagtggagctgaagccatcgctagatcgttattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaagggcctacttcgcgtaccaccttccttatctcctgcattagtacatcacaaaataaaaattagtccatattgctcagcgccgatctcctcgccagcacaccattcagggaagcggagggccgacaaacaggtcagacccacaacctcaaacctccaaaccagctggtcagacaggtcctcgtaagagaaagctggtgcttaatgacgacgagggcgatgacagcaacaaatctnnnnnnnnnnnnnnnnnnnnnnnnnnnnnnnnnnnnnnnnnnnnnnnnnnnnnnnnnnnnn

SEQ ID NO: 44138 - DNA, 789 bp, Oryza sativa
tacgtgtgaagcgttattattatgatggatttgtatattaaattgtcagtttgtgtacctcggctgattcctggacgaggattttatgcacaaataagttcggaaattactagtgaatttccgggcgtgacaagggtctacttcgcgtaccaccttccttatctcctgcattagtacatcacaaaataaaaattagtccatgaccctaacactgacgataacagaggaagaagtaatttgttgcatcaacgacgtcaccttcagcacgaagttagcatcctggctttggcccgtcgcatcaatggacttgtggaaaaacattattccattgcaatatatcaaaaaattgattacagacatacccgtcgggccagtccaagaatcacacattatagtaacaccgtactcatcccagtcattcttgaacctatcgaatatcttcttcacatccttctctgtagaatcaagatatttgccatctatctccctaccagttggagaaggaacactttcacctataattgacgtatgaagtaattagaaaaatgtgttagaaaaatgtaattccttaataaatacatacgtaccccacttttgtgtctcccgaacggcgctgacaaagtatagattatcggcatttctaccaggaatgccggcggtaaagaagaaccttgcccatgactcaccaatggcctgcctagcttgcttccccttctttgtgaagaatcctgtgtcaatgcgtgtctgcacaggggacttggcagatgctagattgtaatctcttacagc

SEQ ID NO: 44139 - DNA, 1341 bp, Oryza sativa
caactgtctgcccaagccaggcggtgaatccgccactgatcataaggcctctgccacatgggaccaacaaccctccgcaagccaacttccagtcctactatcagcaagaccgctgctgtgcactgctattagcaccctttagcgtgctgcggaaccaccagtttggctgacctgtgggtgccactcctatccaccgtctttcaccaggagatgattggtgggcccctatgggggttgaggatggtttggtcctagtttaggttggttttgactatcatgattggccggaggtgaatttcatcgtatggtgggtgtaatttcttccaaaaccacctgcatacatatatttaccaaaactcgtggaaacggtttgtaattaacccctaccactaagtttgatattttattttgaattcttttatgcaagagttaacggttaaagtttgcacttatcgaccatcaacactctctccggaggactaacacatgtgaagggaaagagttgccaccagcattgctacaccaggctggcacctcaactgctcctccgctccaacccatccctaacgccaccaacttccatctccctagccagccagccgtcatagctgctcatccgtaacgaccaagcatgagaggatggtaggatgactgccatcgacgccaccacggtgctttagctgcaactccgcacaatccgtcgccccaccaccaatgccagcgctatccttagatttgtctaaacaatggcaacatccatgccgtcggctttgagctcaaggtacaataagaagccatgtcgccactatccttgcagacaccaaggggagaggaaggggaggaagtgggacgacggtgctgcggatagttatcgcccgtaagtgcgacaggtggttttttttccttcatcattttctatcactagtaaaaaaagatttttgcatatctcaacaacagattttcgttggcagattgaggaactacatgcccctttaatttgtaaagatcggcatatttttgggcagcacaaccgcatgtgaaaagtgattttcattggcaatcaagttatgccgcccacctgaaaaaatatgcataaaaaataaaaattccaaaaagtcgcaaaaccctagcttaaacagcggatcagcccctcccaaggtcggccgcacgaagttgctgtcgctcgggcttagtcgttgtcaccaaagcctaccactccactcctctaagcgcccgtgcacgaagctactgtcgcatgggctttgccgctcactagaagaccaccaccttcttactgccggatccacgcagctattgttgttactgtattccaaccccctt

SEQ ID NO: 44140 - DNA, 995 bp, Oryza sativa
gtggcgtgtaaaaaaccgtttttctagtagtgtcatgctcattctacaagattagttctatgtgtcaagggctgttattatattgaaaatgggttttggcaagtttgaatttgaagaaaaaactaagttgaataatccagaacttggattcacgtatggactgagagtgttagtagatgctattaagttgaataatccagaatttggattcacgtatgaacttaaggctaccaaattaaccgaagaagaggatacctgtggagattatgggtaccccatacccacacggcatggttatctgaatggttatagggataacttatatctatataaaatatgtaacggatcatgacttgggtattacgtttcctagtataatatggaacggcctaaagtcctggtttgttaatattgtaaagtagatttaggaagccggtaccgtattggttaaggtttctatcttgtaatcctgccccccatcctatataaggtgggcaggaggccctctagggggcatgagcacatatgatcgtcagatctatactatacccggcggattcaaatctctaaacaggagtagggtattacctcttattgagagggcctgaacctgtctaaatcctttgcctccgcatccatccacttttaggtctcgtacgctacccccttttattattgccgaattcatgtttcgacagttggcgcgctaggtaggggttgcgtcgaattacccgtcgaaaagtgcgatggaatcaactccatgagtcaccggcttcgtcttcacttcgggattgtcgcttcctcgtcgccgacaacatcaacaagctctcgttctctgacttggattcaaaccagtcaggagagattcaatctaactaagaaggagatgccacttttaggagttatctccccgacgaggcctcatcagttccgcccgaccggagaacgccgccactgccgacacgcaaggagggagatcgtgtgctgcatgtgcc

SEQ ID NO: 44141 - DNA, 10949 bp, Oryza sativa
tataatcacaacttaactgaagcttgtgttcgctattttgttcgcatgtttggagattccacacgcctgggggctgcgggccagcgccgcctttgcgtgcctaacgcggcctgactgctcctagggcacgcacgacctggatgcgacgccgcatgtcgggggcttcggtcttcgcccggccaacacagccgactacgcctcttccgccgcgggctagggggttttgcctttgtgcgccgccgcctcatccaccgccgactggtgtcctcgcctacacggttggttggtcacaccaccgttcataggcatccacgtcttcaacgactggctggatttcgtcaccgccgactggtgttctcgcctacacggttggttggtcacaccaccgttcataggcgtccacatcttcaccgaccggttggatttcgccaccgccgactagtgttccacctacatggctggcctattatgccgtcgttgttgggcgtctacgacttcaccgtcagcctgccttcctcgccgccgactggtgtcctcgcctacacggttggttggtcacaccaccgttcataggcgtccacgtcttcaccgaccggctggatttcgccgccgccgactggtgtctccgcctacatgactagcctattatgccgctgttgttgcctgccttcgtcgccgccgactggtgtcctcgcctacacggttggttggtcacaccaccgttcataggcgtccacgtcttcaccgaccggctggatttcgccgctgccgactggtgtctccgtctacacggctggcctattatgccgccattgttgggtgtctacgacttcaccgttagcctacctttgtcgtcgccgactggtgtcctcgcctatacggttggttggtcacacccccgttcatgggcgtccacttcttcaccgatcagcttgcctttgtcgccgccgactggtgtctctgcctacacggctggcctattatgccgctgttggtgggcatcttcgctttcaccgtcgaccgccttcgtcgccgccgactggtgtctgtattgttattgatggacgacttcgttcccacatccacatcggctacttctattgtcaccgagggaatacgaaaaagctaagtcctcattaattttctttatatgatattttccttttcctctgcctcactacatcaactggtttaccgttgactagtgaatcgggggctacagatgttatatcatattttttcaacaattttcataatatttatcttgattgtttgcgacataatccgagtacaaagctacctatcgagttatggagttctatcttcctatgctttccgtttggtttgtcaatggatagttgcctttgggccgattcctagcacccgggggctcgttggatggaccgagtaacacaaagtgctaagtattactcggaataaatcaaaagtatagagataagataatttattttctactcttaacaattgcaaaagtacccgagtagtaaactctgatccgtgaatctttgttccattaatgacgaactcatgtcactcgtatgcatgtttgggagtcattcgctatgactagtcgggcagagtgtttaaacgtaaggagtcattcgctcggggaaatcaaaattgacaagaggagaaatacatatttataaacattttaaaaatacttgaattctcctcgagtattatatttacataagatactactcatcctatatgtttgttctgcaggatccagatccaaatatgcataaaagggattcatggttttaagcttatctcttacgctccgggaatggatcagtcagaacatcaccaccggcttgctgtcgccgccaccgactagtgtcctcgcctatacggttgggtggtcacaccgctgttattgggcgtcgttgtcttcaccgaccggccgcctcgttcgccgccgattggtgtcttcgcctacatggttggttggtcacgccaccgttgttgggcgtctacactttcactgttggcttgcctccgtcgccgccgactagtgtttccgcctgcacggctggcctattatgccgccgttgatgggcgtctacgtcttcactgaccaattgccttcgccacctcgtatgatgccaactggagctatcgtcttcacagctggccacgtcgctgccactgctaataggcgtcgtcatcttcaatgcaagctgtctatgtctgctgccgactggtctcttcacttccatggctgcatgattctgccagtgttgattggccttatcgtcttcattgccggtcgtctcgtctgctgctgactagtgccctcgcctctacgtctggtttataccgctaccactactgatggacatcatcatcttccgtcgccgactggttatatcgccgccgactggtgtttttatcttcacaactatgcgtcttcgctacggtttgcttccgttgccgccgactcgtgttcacttcgtcacggctatgcaactttgtcaccatggtggagcgacttcatctttattatcttcggcaccggcaaacccaattgtcgcaacttcgcatgttttgctacttcaccaaccacgtctacaagagcttcgacatctcggcatgcacttccatattcgatgccgtgttattctactacaacaagtggttccctaattttcaagatttctattcggacatcctcaacacatatctttactcgtgcaatgagtactcgatgacaagaagctacagttctcgactctatgttcagttgccttctaactaaccaaagagtcgggggctacacaaatacaagactctcaaaattcaacaagctgaagaaatcaattaatcagccaacgagtcaactccaggagtcgttatcttcatctttgcttcgaagcagatattctacttcagcaactccaattatttcactagcaattttggtttctggacgctgccataatctactccaaatttctcaaagtatcaagttcaagatttaatctacatgttcgagagtttggagttatcagccaatcagcttggtttagacgagttggacaacagcatctactttcctccaagtgaagcatttacaacagctataacactaagttctgcagtcatcttcgtacatcaagaagcgttgcatcagtcttctttatgcacacgctctcgtcaaggaaactacttgagctttgatatcttctgaacagtttgatggattattgtcgctgacatcatcactagcacctctgcttcattagccctgacatctccgctgttgctaatggatgactatgtcttcgccgacttattatttcaccttcacggttgacctacaatgcaaacgctgatgagcgtcttcgtcattatcatcagttgctacaccgctattgactggattaccaacatcgtcatcttcatcaacatcctgtcaagcctcttcaacatagcctactctgctgccgttgatgggcaacttcgtcatcatagccggctatctctgttgccgctaatcatcattaccgtcggatgcgtttgccatcgccgactattttcttcatcttcataattggtggatttcgccatcaccatcgatgcgtgtctacttcttcatagtcggcttgctttcgtcgccaccgactgctctgtcgttgttgttgggcgccttcatcttcactgctagctgacctgactactgtcgactagttttttcgcctcgatggctatgcgacttcatcatctttgattggtgtcattgtttttaccaccaccaacattttcgtcacctctgacgggcgatatcatccccatgttcgtcattttgccttcatgtcgactgcataagctattgccaatggaaaattttgactatgacagaaggacaagttatatatgctcaggggcttatcaactcaatcacaaggatcatatcttcaatttggacttgttccggatacattcaacatgaatttatggtcacgagtcgatttcatatgcttaacggctggactattcattattccccacaagggctatcaaccgactacttgcgctagtcgggattcaatttttatatctattttggagtatcccataagggataatcactcagatcagaagctattcttatgagctacagttggtctatatcacccggaagatttattactcaggagcatgttacatgctccatcctttaaagggtgtcaaaggcatatttttttgcctaggcctaatatgtctgcagcccatattttcaggtgtggcctgtcacattcttttatgtacttaggcacctttcgcttaggccaaagtgcgcgtgatcaaatgcccaataccttaaaatccttttatatcgcagttactcaactttttaggagttggtacaatgcattttaaaaggtgcccaacagtgaagtttctcatagctgccccgctgacttttttatatagtcaatgcgttgtttgggtttataaagcaattgattggatacactatcattgctttttgtcacgtaagtgtgcattattattgaccaatattatggcttaggctgattaaataatgtggtcatttttcagacggttggtaaatccttatgagtttatttactcggattttacaccacataggccatatatttccaggtgtggtgaaaccatgtgtcttttagagatttaagcacatctgttaaagcagtgtgcgcatggtgtgtgcccaataccttggaaatttctttattcacaacatacaagcttctttagagctgttttgctatgtgaattttcaatgatatagtcaactttagattgcatgcatcatgctttacaaagcatttggtatatcacatagatcatgttattcgggatttcataccgcatatgctatatattgatatcaagtcacttggttgactataattatcaaaaatcactctcagttggttggattatttattccttgactatatgcttggtttgttcaactaaccatagtcgggggctacacctattaggtgcatctattagatgcacctgaccttatttttcagccctccacagtcctctgatttggtaaaagtactcgggagaccatggcgaagatgattgaagcactcggctttagagtaatctggttcgaggaaagattatcttctcgattgtgaaggtcttaggggctactgtggagattatgggtaccccatacccacacggcatggttatccgactggttgtaggggataacttatatctatataatatggaatggcctaaagtcctgatttgataatattgtaaagtagatttaggaagccagtaccgtattggttaaggcttctatcttgtaatcatgccccctatcctatataatgtgagcaggaggccctctaggggcatgaccacatatgttcatcagatctatactatacccggcggattcaaatccccaaacaggagtaggttattacctttcattgagagggcctgaacctgtctaaatcctttgtctcctcattcatctacttttaggtctcgtgcgctaccccttttattattgccgaattcatgtttcgacaataccaaattaccaaccgaagagacaacttctcaagaactcatttagtacggaattaataactgaaagaggtggctacgatcaatacgaatattcgaaattgacagtagcagaggctgcaggcgctgaggacggatggccactggcactactcagtgatgagaacaagagagagggccatggcgacgatggattgaatggaaatcagggtgaaataattgagctgagggcgcacggccgcgtggggcggcggacatgggactggcttcgcccttttggtgccattgccacgcatgcatgccagatcgaactagccataaagcggccggcagggcacaggacgagcatgattaataagcctcacatgaatcaattccatcgaatgtacgttccaaggaatttcacagaaaattgttatgttgcctgcagtacgaaattcgtacgtaggtatgtacgtactctatatttgtaactgggaatttctgatgctacgtacgataaccacatcatattcttcttgttaggccatcagtcacgagagagtgcgcggaatattgcggtgcgttatgcggataatgtgataattggtcatgcatgttaattaattaggggctatattaattcaactttgcataatttctattgctaacagcaatataattaaccacaccgataatctcttggcattttatattgcaaggcgactcgatgtatataagcacgtgtgatatttcgcatttcatgtctccgcaatactttttttaattacatgcgttggcgcgcacacacgtgaaaatataactctctaggacattcttaagacatacttcctccgtttcacaatgtaagtcattctaatattttccacatttatgcattcattattaatatcagtatgaatgtgggaaatgctagaatgtatctatctagatttattaacatcagcatgaatgtggaaaatactaaaatgatatacattatgaaacagagggagtaaatgataattaaaagatagatccatgaagtaattatactagtgatgctgttggtaacaaaattcagaaattaaagaccgtaccaggcatgaaagcttagcattggttggaaagatgtctgagccgtactattctagccgatggaatcaaaatcatgttctctctcctaagtctaaacagctggaggcacgacgctctgtcctttgtttcatggatcatgccaagattgttcgtcacgtgttgcttaactgaattcaaggccatggggctagaatttgttgctggcaactttgaattcctgtgtgtagggccgaatcaagtctatctactgcatggaagaacaatctactgccaatattctaccatcttgataaggtattaggaggtatcacattttctattataaaacttatatcacatccttataaaactatgtatttcgagttatcaaaatttgtaaaattttgttacgtataaatatttttaatattttccaaggaccgtaaaatttatccccttttaaacctctgaaggtacatggattttaaggccaagccaaagaaattaaaccttggagttacaaaataaggccatatattaagaaacaacaatagcaaaaatgtaatgtttgtttcgttacataaatgcaaatgtaacactaagaattgcattaagcattcgtcctaaaagagtattaagtaaagatattatgtaaacacttactgatatcttaaaaagtctataatacccttgtaaagaattcttcaatgttatattatcttatatgactaactacttctccattcttattttgatcaattcctagttcccttcctaagttaaaattggccatttggtaattaatcttctcctatttgaaaaatggatttatttgctttttttaaacaacttctatatataattttgttaaaaaaacatatcatttaatagtttgaaaagcatgctaacggaaaacgagaaaattaaaattggagttgaagaatagaaccaggcctttgtagtatatacttataactaaatatttggggtcctgttctatcgccatattaaacatgcttatacacagcttaaatgtttttgtttttcacttatggtacaaataattataaatattctaaagtatgccagaatacgatatacacatggagaaagaaaaatatcagattagacttgaaaaaacatagtcacatttgcaatttgaattttttttgtccatgcatattgaatttgattttgcaagtttatagggacgtctacaatcaataatccaagttttctaatgtttctagaaaaaaaaatgtaagaaacgagggcttaaaatctccatcctattatcccagtatcaacggaaaaccatctagaaacattaatttgaaccatacaatatgctttcattaactttgacatgaaccaaaataaagaatgtaagtaggtaggtaggtaaaccaggacaaataaaggaatatatgataattataagctgcaagaaacatgcacaccggctcttctgatagggctgcgctgaaaacatgtcatcaccggttcctatcatgaggtaatcgatcatattcggtacgtctctctcctctcctggagtaggcagacgcaatcttacattcttacctaaatcactttctctaatccgccattacagccatgaattggagtaaagcagcttggtcagctagcactcatcagcaaaaggtcttatgctttcctacaggaagaagcagccacatgaaagagctgaaaaaaacagagcaagaaccacttcctttcggttttctagtgtagcactggcaaacatttttttcactaaccaaactcaagattagtcggctagctagtgattattgcagaatggttttgttaagaccaccctaatctataattaggagttaggcttagccaaaagtttgatcatggaagcacaatcacttcatgtctgcattcgtgttacaattttttttagataatggaaatggattacatctccggtttctgtcataagacacacagccataagtttaatagtaataaaaaggtaagataaaagtaaatcaaaatgagaaataaggtgatgggacaaatccccaactctcctttattattgactagcgttaaatcacataaaatattttagctagcaattcttatagaactacgctacccatagtggaataagagactcttggctaccgattccaagagtgtagcaccattgcgcatagtattctgctcctcctgtggtagcattgtagaccagaagtggagccagtaggaagacatgaagataacctgcatagggttagataattgtttaccattaaaaactttatcattgcgacaacgccaaattgaccaacatacagcgctagctccaattagaatcatcttcttaatggacctagatacccctctaagccaattaccgaaaatgtttttggtgttacggggtgggggatattaaaagcaaaaaacacacatctccaaacaaactaagcgacatgacactcaaagaaaagatgttggattgtctcttgtgcatagcagaaagaacattgtttgtctccccctccccccaatttcttttagccaggttatctttcgttagaattactttcttgtgaagaaaccacataaagaccttgatctttagtggaattttcaagtcccacagaattctctttttatccaaacattatagttcatgatcgcggcatatatagatttgacggaaaattgaccattcttatggagcgaccatacaaagcagtccttttcatttgacagagttatattagctagcctgaggatcaaatcgttccactcaattagcttttggccaacaatagcccttctaaaagaaatatttagcggcgttgtgctcatgacctctgccacagtagactgcttctttcgagccacattatataatgtagggtattaatctttgaaagcacgcgatcccaaccacatgtcttcctaaaatcttatgtttaccccattgcgacatctaaaagaaccaaacctaagaaattggtctttgactttcattaaaccagcccagaactgagaaatacctatcttgctggacataccagaaagaggtttaccctttaagtattaatttcccaaaaggtcttgccataggccttcaccattaaacaactagaaaagccatttgttaataagtagctattacgataacagagaacttttacgatgatctctactggtagtatcacggacggcacaatcaacggcgggcgcttcaaaaacgtgaagggaagtgggagtatttaggacccttcccagcaatctcacccatccctccccttcccctgcttcggcagctgctggtgtggtgatacactcgcctagctttggccaccactaatctctgctctgctttttctcctctgctccactgatcatccaattcttctcttcctgattggccattctgattggctggtgacatgtcgaaggtgagcctttcttgctcttggattctgatcctgattagctcgtgtagaatcaggatcatcatcttttcttcttcagatcccaacaaccttttttcttgcttgtcttcctgaattgtatcatgttcaggtgtttgtgattcacacattgccaaccttaaccctctgtttcacatgttgctctgctgcagaaaattgtggtgaagctggacctgcatgacaacaaggacaagcagaaggccatgaaggccgtctcctcggttatcggtacgaacaatcgtctcgaatctcgatcgatgcatccaccatttctgtctgtgattctgtgtacatcaacgaactctctgaagtctgaacatatgtctgattgattgttgtgtgtgcgtgtgtcaggaatcgacgccatttcgatggacatggcgtcgcggaagatgacggtgatcggcacggtggatccggtggacgtggtgagcaagctccgcaaggcgtcgtgggcggcctacatcgagtcggtcggaccggccaaggagccggagaagaaggaggagaagaaggaggaggccaagaaggacgccggcggcggcggcggcgacggcaagaaggaaggaggtgacggcaagaaggaggagggcggcgacggcaagaaggagggggaaggcaagaaggaaggcgacggcggcggcgacaagaaggagggcgaaggcaagaaggaaggcgacggcggcggcgacaagaaggacggcaacggcgacggcaagaaggagggcgacgcgaaggccgccaagaaggaggaaggcggcggcggcggcggcgacggcggagggaagaaaccagccgcggtggcgccgatgccgatgc

SEQ ID NO: 44142 - DNA, 20261 bp, Oryza sativa
ccgcggtggcgccgatgccgatgccgatgccgctgcaccacctcccaccgcagtacttcaacatggagtacatgaaccagtatcaccgccgccgccgccgccgccggcctacccgtacgtgccgccgccgcagtactactacgtccgcaacatgagcatggaggagaaccccaactcgtgcgccatttgctgatcgaaaaaaaaaaacgccatggcaaatgagcaccatgaatgctttgcatctcaatgcatgatctgtgtgcacttctgcagcaggtaggcgacgcgtgcgtgcgtacacgcttgtgttcttgatcgatcggccgtgatgtgtatagtataagatctcagtgtttatgatgagaagaacaaattaagtttgcgtgatcgaaccagtacgtacatagtagtaagttcgttttttttttcttttcgacaaattcaaccaacctcttcatcggtggatatatccggttaatgaaatatatgatgagaccaacaaagtttgcaagatcaaactagtatacatagtatgtttacggttttttcgacaaaggaattcaatccagcttctgcaggatgtattttggccgaattaagtactaccttcttctcaaattttatgggtaaaatctcttatattttaagacagaagatttacgtacaatttgtaattggaaatttgtgatgctacgttctgtctgacccaggtgcatgcttcctactataaccacaccatcctttttctctaaaaaaaaccacaccatctttttctttcaagcaaagagaaccagcagtaggagagatagagagagatgggcatgagagagtggggaatatgcagcgcatgatagatgagtggtcatgcatgtggtgggtgctgttcagactttgctttctagctaggagcattagaacatcaccaataaaactttggcattttctctcccaattgtagctcgatgcatgtgtattaccagcctagagatatggagcatattaatcatgtttctacagtttcttgagaagaaattctcttggcaagaccagtcatggaaaaagttagcatctgttggcctgaaagatctctgggccgtacgatttatttttttttgaaacctaagttggaactttgttccacttttatatttagaagaagagaattgacccagtttataaggaaaaccgggcccgaaaaccatacagttgcacggttaattacgggaaaccggctaaaacccaccacacagaagaaagcaagagacctaactacaactagcatcgacggcggagcccaattgtaccacatcattgtcaagctaaaacacagaagcggcctaaacagctctaacatcacagaagaggtgttatcgttgccgagctggccgcccaagcgacccagcagcgccgacttcacaaccgcagcgacactggagccgcgaaagtcaccagagcgaaaagcagctccgacatctaacaatggacatcagccaagccaccaaagagccacttccttcacacggccagcaccaaactccttggaagagactgcaacttgtcatcgtcgccaagcatcgccgcaccccatcagcgagcagctccgacttcatcagcagaagcaaccgaagagcgtgtcgcccaccacaataacgaagcggacccaaggaggcgaaggcctcgccgaacgccaaggtatgaaagtttttgaaccgaaaaagaccctccacggtcatcgatgcataggaactcctccgaagcgacgcccccaagaaggacacgacgcgtaacgtcgccgcctctcgtccgaaatcggaacaaggttttcacctggagatttgtgggaaatatgaaagaatgccatgacaatgcctccaaggaggtttacggtgcccatgagcgtcgtcgtcgttgaaccggccaaaggcacggcaaggctttcgccagcgtcttcacatcacgcacacaagcaccccacatcaacgaccatggaatagtccatgacgtctcacaagcagtcatacctcgacgtaaccaaacacgccaacgcatccacatccacacatcacgagcaggaggctcgccgccagcgagcaaccctgccggagcccgcctcgacttcgcgcagccgctgagcttgccagagccctcttgagccgtgcaacgccgccacacgcaaccgccgcccacgccacgcccgctcccggtctcctcctttccagccgcccaactccttccccgccttcatatgctgccgctaacgtcgacacgccgtctgtcgcacggcgccaccgtcgccagccaacaccaccacggccgccgccgtcagccgccgtggtccaccggtcatctccccgccaccatcaccagccgcggccgccagccgccaccatcaccggtcgctgccaccagccgccgcccgtgcagatccggccggggtggcgcggatccaggggacggagcacgcctcggtgccgggctggagcgagacgaccaggacgacgcggcggaggtccctgccgtggcgtcctggtcgcgccgcggtccaccaccgacgtcgagtcgtcgtggtccgccgccgacgttgccttcagtcgccgaggtccgccgccgtcgtcggcaccgtcaccgtcaatccccccgccggccacccccctccagatccggccggatgtggcgtggatctggccgccaccgccgccgccccggacagctcccccagccgccgagcgtggggtgggcgaggcgagaccccgccgccgccgtccttgcggctgcgcggctttgccggcacccgctcgggcggcggcgaggtggaggagggggcggtgggaggaggaaagcggcggcgcgcgcgtcgcgccgcgagctgcccgggggagggcgacgcgagggcctatctccctaataagctgttcgccgtacgatttatagctggtaggaatcaaaatcatggtctcctatcagctgaatgcactccactttgttctttgtttgctgaaccataagtcaaacaccatttgtttaagattttgacagttcttgctctttggagagctgaaatttatgtgtaaggggagagtttgtgtctagttgacctatatatactccctacatccataatttacaattgtttggccttaatccgaaattgatgtactagttatctcataatcaactctaattctattttctatacgccttgccccccaataaacattccactcaccactgtggaaaaatctaatctaattgttgtattcatgttttctctaatctattacattgatcctcttatggggtatatatagaagtacataagggatagagagtaccccctccattccaaattgatctacatatagttttttgaggttattgctaaatgatctacatatttgtgttcattcatgaagtatattcgttatttgtgcattggagtaaatggatattgatgcatgcatccatgcacataagtatttataacccacatgcaatatcttggtttgctattggctaggaaatagtggggatggtgcatgcatagagtttgttgctagagtaaatatagtatgagagagttattagctttttttggttttggtgtacctatgaaatatgtagatcaatttagaatggagggagtacaatacaagtaagagtcgatttatctctagaattctatctctaggactctatcttatatctaggattctatctctagaatatatcttatctctataatttgtatttgactcttatctttaaccgtcatatttatacttctaacaacgatcacctcttgtttaatgagacatcctagtttttttctttatccttgatccctcaaaaaggacaaaatctcttcttatattacaggaaagaggggagtaatatatggtaaaactcatcggaacgcttgagtagcgcgtgcgcacggtggttattatatcctactcctgatccgtcccagaatatagcaacctaaaaccgtataggacatatactagtactatgaatctagacagagagatatccagattcatagtactatgatacatcccatccggtcctagattgctatattttgggacggaatgagtatattctgggacggaaggagtataacgttagcagtttgatcctatcggatgctaccattagaaaattgtcttgagccaaatattataattcttttgaattaatttaataaattgttttgcaatttcaaatatttttaactgattttctgtaatttctctcaaattctgaaatttcagaaatcttaatttccagcccccatctgactgtttttatcatttccttccgcaacatctcgtgtgaacatagcacatactctactacgatgacacattacacatatatgttactgaatttaatttgctaattcagcagttccatctatgatgtcatcgtttagcacttaatttcccacatgaaggatcacgctaattaaattgaagattagtagtgcgcagctaggctgtaggaccacacactaattagtagtacgtgtgcatgcactccctagaaaaactgcacacggtaaccacacatataaactatgcatataagcttcctaagtagggatgtaaacggtatgaaaacttttcggattccggacctattttaaaaaacagaatacgtcggttggaacttttcggaaatggaaacgaattcggaaatattttctcggaaacgaaatcgaaaatgataagggcagtttctgtcggaactcgaaatcggtcggaaaactttcctgaaactttctcagaatttctagaaattttgtgactgaaataccctggattcttttttcttaagcactgaatagtgaataccatggtgattggttgttattttttaaaaaatatttgttatgcaaatctaaaattacataagaatattttttttcatgcattgggatttatcaacagcattactctcttaaacatagataatttattccatagattgtgttttgtaatgtacgattggtacttaacaattggatttatataattgtgttttacgatgaattgttgaccgttgagacttgagaattggatttatcactttaagagattttttattccgataaatttttgttaccgtatttgcgccgattcatttttgctccgttttcggtttcgataatattcgattctgttttcgtatccggggttttcgattccgaaaataatatgaaaacgaaaacgataaagatggtttacgtctgtttccgtaccgttttcacccctattcctatgtataccttgtacctaccaattaacaaatatcccagaaaattctaaaactaatctgacatgtactcttaaatagtattacacgtatctacaaattcgtatatttaaattcattatatttttgccgtcaaaaaaaagaaaaatctaacggttttaagagtgaaaatctatcagaattttatcttttttttcgtctaaaatatattgagtttgaatatgacatttcacatataggtataatactactgaaaatattatctatttttttcttgaatttttccttaaatttattagttgatgtgtatgaaacatgcacgagaaacttgtgtcatgttccatgtatataagacttatggattgcaatctaggtttgtttaatttaataattatcacttagcaaagaaagatgtcatgtcatcacaatcaccagggcatcaaaaggttggtaggttttaatttacaacaaaactaacagaataaaatatatgttttgggggaaagtcatatatatgaatgcattcagaagcgagcatgcaaggttgtgatttgtgtttagcgataaaagtgttcatgaaatttttcgaatgttcgattgtccttttctatataaactaggaagtagcctgtgcattcgtacgggcatgcatcgtagactatgtttgagaacttataatgatgaaatattaatctgaacttataaaagatcattttatttatttggattatttgagcatatttagaaaaaaaaattaagtaattggactattttctctaattaaaggaactcaatgttttatgtagtggctcagactattcatattttagttagttattttttttacgaagtgtacgtttaatttagctatacatgtttcaaaacatagcatggtgcgactctatgttgttgagttatttctttttcttttggcaaattaaatatgaaaattttattctggtactatattgatttaatttagctatgcatgtttgtagaatttttcataatgacataatatttattgtcaaaattttaaggtatttagatgtggtgcaaagtgcatgggtggactgtgcccaaatgctataattcttatacagtaaaatataggcatatataaatattacattgttagtttaattaatagatagagaataattagatagaaatcagacatgtataggttataaaaaattgtagttgtttcaacattgattgtttatcgtctagattagtagctacaaaaataaggaatgggagggcagtgttctctacatgtggaggaggtggaaggattttagtgaaaaccaatgagagatgtttcttttttctcagcatttcttttattgtttttatagctggtaagacatgacacgtgttgtcttatgtttttttttcccaaaaaatagatgacatgtgtacttatggttctttcaaaaatagatctaattgatgaaaataatgaaatccatcgagttaagttggatcgttttctattttttgagacatgatacatggttacttacaagtgcaatatgggacgtttaatcaaattttatcaagtagactgatttaatataacataatgcatatagtcaaccttttcgaaatgtctcattcctatttggtttccatgcaaaacataggtgccaatgttcaaaagaatttaaatttataataaaaatatggataatatggaacttgaattatttatttagttataaataaaacaacaattgaaactaactaaaaataagatacaacttttaaaattataatcattaatctttctaattattgttttttcacataatgttgtccattgaaaaaaagagaggatgtgaagggagagaagcagagataatgtacgtatggagacgtcacttgaacacatacatgacgtgtgaaggggtaggaagtgggtcttttccgtttttatattgttaagatagcagtagaaaataataggtacaccgtgtttaaattaaaataattgatggttaggtgtattatgtaatttctttaggatttctaggatttattgtatactactggagaaacaatctttggtcggtcgccaagaaaccacaataatcctagttcgaatagaaatcgggactaaagattatttttagtcccggttaaaaactttttgatctttagtccccagttgatgttaccaatcgggactaaagatcatttttagtcccggttcaaagaagttattgggtcgagttaggccccaattatcttagatctttagttccggttctttatatcaaccgggaccaaaaatactcccgagcgcacgtcgagtcctctcttatcaataagaccgataaaaaccatttgcacttcctctctcattataaaccatctccactctccagcctcctcgatcccatctcaatctcaggcgttctccttctcgatcggcctcctttgtccgatccccctctcctctccccttcctcccacttcccctctcctccccctccccgcctcctcctcctaccacggcctctctgggtcagcggcggccggtcgaggtcggcagcggtggcggccggctggccgggctggggaggcgcgcacggcggccttcggaattgattttctttttttgaggaattgtgatgattgtttttgataatttgttatgtgattaaatgtgggaaaaaaatcaattacacagtttgcgtgtaaattgcgagataaatcttttaagcctaattgtgccattttttgacaatgtggtactacagtaaacatttgctaataatggattaattaggattaataaattcgtctcgcagtttcctagcggaatctataatttgttttgttattagacaacgtttaatacttcaaatgtgtgtccatatatccgatgtgacaccccaaaacaaatttttttgggaattaaacctggccttagtagagttctttgtggaggttcagtcttttatctttatgaatttataatcggatgaattcatattgttttaatttacttaatactatcgttctaatttatttgtgatggtttttcaaaatttgtgatgtaattttttttagaatttatgatgaatttgatttggggatttatctgttaggggatgtaatgattagtgaaatccatatgaaaaaaaaattaaaaaaactgccaaccgccggttctagctctagcatttttagtctcaattagtaacaccaaccgtgagtatagggggttacaaaccgggaggaaagaccatttctccaccagtggtagtgtcacatggtggcttaggtgtgttcgtaggagtcccgcgtggtggtttcagagtattttgtgggaattttagttgacttttagcatataatagatagatatggcgcaagttgtcgaaatgtgcctaatatatatctacatgtttctttagggaatatatttctacaagtaaaattataccggtgtaaactacatttttctgacattgtagaactattttagttacatgccagtgaagttattatatagcatgaaacaatataataatggtcactttcttttcataatttttacaagctaaattatagttaagaggtgtattaaattctaatttgtgattttagtcataataatgacacaatagaacatgtaatttcatccgatagcaaaaaaaaaaaacttccttaaaagaaaaacggagaggagttatgtacatgcatatgcacgggaagaggggatgcctctttgtaagaaatagaaaaatcaatctaatccaagtatccaacggcttggagtgatgggcctattaatattaattttagtgaaatcaaaagctgggtttttttttcagatttttcctaatttattggagcgccacgtggcattataggagcatttatataagcatcatgtgacagcttagaagcatttataaaatttttcacggactttactatataatagatagattgaatattatcgatataatttagtgaaacatatttgtagaattatttaaggtgacatataatataccaaccggagatgaggggagagagggagtatgtacgtacagaaggccaggaggggaacatacttgtggtggggaccggtgtggagaggaggattttatttattttatttgatctaatggttaaaaatgttagacccaccaatttaaaagaaaatcaacggttagatttttagactgccacttggcgtcttagaagcatttgtaggagaacacgtggcggcttaggagcgtttttaagaagtttaatggacttttagtatataatagatagataaatggtactgtttaagaacttttagctatctgtaaaatttaaatgttctattctttttagcatcgttttgatatcaatataaaacacgaatattagaaaatgatctaatatcatattgtattatttcgttaaatatgatcgatcgccgatcgaccgaggatcgttgaggctaccgattctgacagtcttcatctctagttgtggtgtccaaatttgcatctgtattttgcatatcccagctgctcgatctcctagcccaaatcaaaataatcaaaacaaacagatggtgttaatcgcttgtcaatttttgcggtgcggatgagtcggatgatcccgacgtctcgtcgtcccctgacgacagccagtcgtccgggccggcagtgacagcttatagctctttcaacgcctcatggacctaatgaaaaaaaagctgatgatgaggtaaaaggcgacctatccttttcgtttcgataaagaatgatagctttcagcctgatccagatgtgtcactgaactaggcgttgttaattgtgaatttatgtgggtgatgcaggttttactattaaagaatatgatgatactgtgaagtcacgttcagcttctgatcatccactcgcaatatagtactatataatatgagaacgggaaattagcttagctcgggaaatggagcgacgtgtggtgcctgcgtgcgtgcgtgcagtggactggtcggtgacgatgttgactgaagaaaatctcagagacgatggagttgaaaattacctctagctcatgcctgcggttttttcagccgcacctgcatgccgctttcattgtcacacttgcgagcgtggagataggccggtaagaaataacagcacgaagaaaaattgccatatatgagtgtggtataagtaggtggctagctgaaaatatacaacgttcagtcaatgcccacgttaaatacttttgaacggagaaattatatcttaggctctgttccttaagattattcacactgattatttgttttatgttttgaaaatatgttttccaaatgatctttcttctactatatcgcttaattagaccactcattttaaactatttgtatgaagtatatattttaaaaatatttgatttattcctatagtcaagtagataatccattacaataatttgaaaagaaatggcccttaatatatcttaaatgtattaaaaaaatagacctatccaaggcatgaccttaaatacctagtcttgtttgtgaatgcattgcagagccagaaaaatatcgagagcttaggctaatctaagcatatgcatggacatggacatatgcatattcagatttgtaccaggattggattttttttttacatgttagatggagtcacatgcaaaagagtatatagagttcaagcatgtaaaatttcttgatccgtgctttaacctcatgatactgcgaatcaactactcctatgaagttagcggacgttgacaattgagtgtcccgaggcagtctatgtcagaatgtcagatgattgtagtgtaccgactcaggggctcagggcgatatcactgacagacagcaacaaagcagccactgttttctgctgttaaatcgtaaccaccggctggcgtctgcatttcagatcgatttctgtcatcgcactcaagcaaaagccatttttgcagcgtcggattcgatgttagtgtttcacgggaaggcgtacggtacttctttttgggacagtaaacatcggcatttgcagcagtgttacgggtacgtcctgattcctgatggctaactggcctttttcgtcagtaatcgcaggagtcaccaacataatgatggtgcacaccatacgtaccagtttaccatgggaatgtgggagtcgcatccaaagtatttccccattattttgaagttgtttggcggaaatcaaggttgggaagaaaagattttcctgtgtataccctaattaaatgatcaatggattaagataggagaatagttgagattaagatagaaagaaatttgaacgaaaaataattggtagaataaggagttatttgaatgcttatattggtggataaattttaatcccttaacttatattgatgaacatatgaagtagtttgacatattagtttcagagggattttatgggtgtgtttagttcacgctaaaattggaagtttgattaaaattgaaacaatgtgacggaaaagttaaaagtttatgtgtataggaaagttttgatgtgaccgaaaagttagtagtttaaagaaaaagttggaaactaaaccagccctatgtagcatgaacgaatcgaaacggcaacctgcagatgtctcattttgattttaaggaaaagctaccggcaggcacatccatgactgaatattggttcagactgaattcagtagtgcagatcattggcattatactaggagtaccaatttagcaacttgcaataccttgaagaaacaggacaatctgcagatgtcaaagataaaattgatctgtattccgcggagttgatgctctggaaaggttcagtgaaatgccaatccaacttgttagaatgtagattatcaccagaaaattagttcaggttaagtcagtcaatttgctttatttctgcagtcttgctttaacctttaggatggtaagtaataataagtacggatcgaagacactatggttggcagctcaagtatcctctggaaactaaaagagtaaaaaaaagttaggtgcagatggaagcacgcaatattcttagctgcaagatttgcaattaaaattcaaaatcagtctatactctttagaagcacattaattcctctttgtttaaaaaatagagaagtgtgctttcagaaggaatcgagatggcaacgtactctgcatttctggaacctgcagaatgatctggtaaactggttctagatattggttacacattaaattcagtagcgcagatcattgattcatctagccattgagataaggggctccctacttatatattaggtcatttgcccttccacaaccaatgtgggactattcaacacatccggcccaggtggcgttggccgaggcccaataaattaaggttgattcatcattcatgggcattgatatatccggcctaggtggcgttggccgaagcccaataaattaaggttgtccggaccccaacagttcttaggcacacccactcgggaaaatgaccaatctccctaaaatacagtccaatagaggaatggtggctctcccttttaaggtggcttaatcctcccaagctaagcaaggtgggattattcagaggctcacacggtcgccgcccaactacaactggaccacttggccccttattgcgtctttgccagcggttaatagtggaggatatcctcatcaggcatagtacttcttcagataataatgacaatttgcagatgccaaatatacaattatcttatctgtattccacacagttgagatgctctacaaaacttcagtgcaatatcaaagaatgttggcatgcagattattattagggtaagtttatcatcattgagaagatacctagagatatcatattttctagtgtaaaatttgatacttctatatactaattcccaaaagtaccaaaatttaagtatctgaaggtactttcttaatgaccataaaattcctcttattattaactcttatgaacagaatatgagttcataacttcaggttaagtgggttattttgcttcgtttcagcttgaaaccttcgatgtgttgacgtttttttacagagtttactcagagaactcggaacatggtgaatcaattaaggcccggtttagctgtttagttcaggaaaagaaaatttttgggtgtcacatcggacgtttgaccggatatcggaatgggttttcggacacgaacgaaaaaactaatttcataactcgccttgaaaccgtgagatgaatttattaagcctaactaatccgtcattagcacatgtgggttactgtaatacttatggataatctaatcatgaactaattaggtttaaaagattcatctcgcgattttcatgcaaactgtacaattagttttttattttatctatatttaatgctttatacatgtgtccaaaggtttaatgtgattttttggaaaaaaaaatatgggaactaaccaagccctaaaccaaggtagagtatactgcaatatgtacagtaaattaacgcattcaggtttcttgccgccagtaagtcaaagtatgataactccatcgatcaagaaagacgacgtgggttagccacataaaatccaagcagaaccgtgtattagtacatgtcttcaattgtccattgaaacaaaaaagagtgaagtagcacagtaacatgaatcatgcgaattccgaaagggtaaaggaataatacctcagatatcatataaaaaatgggcgatggaaagtacaagctaacacacatactagtatttcttagcgggagctgcaagcctgtaagtgatttctgcactataggaagttatgcttcggtttacaatattcaggattatacagctatctcagcagcacagtaccatcaaactctccctatcagccactcacttcattgtaaacatgatagaggactaaattaaatacgcataaaaattaaattcagcagtgaagatcataagcactataacatgattaacacgttagtaacttagcagggtagcagtcataaagaaacagaataatctgcagaacaaagaagcatgaactgaaatgcaaatctgttgacacgtgtataggaaactaactgaacggcaattcatcatcttcagaatttcttcactgaattaaggaatccttcatcagcttacaccagcaagaaacagtttctacacgagatcaccatcgaactcagcgagaagcttgaaagaaacaagcaacacacagaactgatgaaggcatcaagcacattgatctctaactaatcacctgatctggtgcccaaacttgccgcctcacttaagggagaatcctcaatggttggtagctcaagtatcatctggacaaaggaaaaggataggtgctagatcaaagcacacaatgttcttaggtgcaagtgattgttttctgcggagggactctagaagagtgactctagacagtgcgttgcggcttgcgttgtgctgggccggtgatctccaagacaggcctatctgaaatctcatagcaggccaagatgggcttcttttgaagcgagaaagatccatcggagcattttgggctggatttcttcaggtccattaatctgttccaagccaattgcacacaacacatggtgacatggagcagtgtagctgggttcgttttgagcttttttttttttactttttaaatttttaattctaaaaacaaactctccaaaaacttagtttcaagtacgaatctttttgtcatgccagtcgaactgactacagtgacgaaatgaagcttccatgctgacgccctcttgggggtgtgtattgttgtttaacacgcttggcggggtggcatggtcaaaacgtttatgaggatttatttttaaattaaaagtaaaataataataaacattatcgttggaatgttttagtagggctctaggtcctatattctggtcttatatagcaggccggtgcttaagcaaatggcagtccatttagaacattttgaagaccatctcatattcattgcaaaaattaaattcaggagtgcaataaccgcactgcccatcaatccatacgaaattattcataagcctctgatccactatcctggctgatcaatagagccatgcccactcacccacacgctttttattttttctatctttttaataatggaatgaaacatcttggcttttgctcaagagctatagccaattattacaaggttcacacaaaaacaaactcacacagtgagtatgtagccagtagccaaagtaacaaaaccaaaagtagaagcaaactaataagaatcaaacaaggtaaagacctcataactactgaattctattgatgaatctccacttgaagttggcaaagagcttcatgatcgtcgactcaaatatacgacacgcatcttttattagcttgatatgatcatcatgtctttgtaactgagcccattcctagagccaatatgttatcctgaaaagtgcctacaaataaaattttgaaggtgatctatcaaaaatcatttcatttcactaagccagagagcccaacatacagttgaagctccaacaaaaataagttccttgatctttttattttttccatttagccactcctcccccaccgctagctattcttctccgccgaccttctcaatgtaggatctgaaacaccaagcaactgacgaagtggatgaacaacatgttacccacgtaggacaccttttatctcgccaccgcaaaaccacaatatgcggaagataacaatcgaaccatcaatgtcagttgaaagcaaacaggatcttcataggatcatcctctttcccttttatgtgatcgtgccaaatcataggaagaatgggtagctagaccctcacatagttctagctaaagctaatttttattcataatattgagtctcccttacaatggacgcacacctattgcttatatataacaatcctaagacctacaaacaagaaacaaactcgttagatgacttggacacgaagaaaaaaaaacttttgttgcagcaaccctatgctagtttggtagattaccgataaaccatgaagaatgtgaaggtgggaccaaaccttgacatgagtcataaaattagctttccaacaagtaatcaaatgtccaaaatagagtccgtatgtgaaatccacgactgtttcatcataggcttgtccaggctgttcgaaccgaatagaaaccttcttattgtaatatcaaggagttgatttatattttgtgtgatgaaaacattggtggttttcgatatatcatgtgtgaaagattggtttcttatgataagatttcagagtttaatagatgattgattttgtgaagtgatgtttctgttgaccccgggtgtcgcccgtcagaccgtatgtcatgcagccgtcagactagccaacccaatggtatgaccggcaggatcctgatcattattggtttcgggttatcttgttggatttggatgttttcttcgaggatttgacttctagatggtttatatacgtatggatactattgttatactaatgtgagtcaagttgggataaacttgtgctcggaatatggtttcttggttgtttgcatgtgcagatgttgcttacggcctcgggagagtgttgccggtgatagatcggagttgacttgggagaagttgatgtctagggatcaggagatcatgtgggatactaaaaggatagagaacaatgcacgtggtgatgaagaatccatatggtatgcaagagggattgtgtatgtatggaaagaggagtcaaatttggaagggagtccaaattctagaagattgatagagataaggaaagggataagttgtatacttgcaatagagggtttcccacatggttaggagtcctaagttgtgtttgctttgtaggctttgcacagcctacctcgtgtataaatagaaagggaaggtgtggcctcccggtatcggttgttgagagacttaagttgagagaaagttagggtttcgagtttagttcgagattttggtgaggaatgctgttggtgcactttgtaaacactagttgatgccaaaaagtcgaaagtttcaatcttcatcttcgaatttgtcatctgtcagtgctttttgggtcctgacggtctatccgcatgtgttcgggtggtctaaccggtgggatagcggcgatctgaccgcacgtgttcgggtggtctaaccggtggcaggtgggcggttcgaccgacgacaatagtgcttcgtcatctactctattcgaggtaaatcttttattccgcaaaaaggttttgggttttaggttttccctaccattcaccctccccccctctggtagatttgtttgatcttatgtgatccttcaattatcttcgaatttctcatttggaaacaattcaatccgtgcagatgagataattgttgacttatggattatggatagtgttggaatagacgaaaactatctaatcataccgtagaatccacaaactctccaaacagagcaattatgtcgtgtcacttttacaacatgggcaaccttcagtaaaattgccactacttttgattggaacatccaaatcatatgactttgatctgttagaaagacgaattgaaaacctatctaaatatgaccttttgatactttgaattcctataatttgatgcacaaatcttcagacaattgacggctagtactgcaccatatcctcatcaacctcccctcctcctcccaatggcatggaaaggttcgatttatttgctgcgaattcagggcctgatgatcttgtggcggtaagctcttggccaccaaatctggcttgtccatgtgattctggcacaagaccatggcaacggtaatgattatgacttcatccgatgcccaaattcgtccactccaaggtgagtgctagcataggtggtgatgggcacgataggcaatggaggcctatagtgatattcccttcgtcccacaataagttaatctagtaatggatgtgacacattctaattttactaatctggataggagcctatccagattcatagtactaggacatgtcacatccaatactagattaacttattattggacggaagtagtactttgtgatggtgatggaagtatgagatctatcaaatgaatggttgacgactcggcataggtgactcatgccggttgggaaccggcgataggtggcggatttcccaaccagtaccctgcaagcaacacctttgaggttcttggaatgcaaaaataaagccggctccccatcaccactgagatcaccgtcatgcccatcacccaagaacatgatcacaaaatcaaccttgaaaaacaaaatttgagagggatgatcaaaatcaacaaaatcacatagcgaagaacacacatagaatgccacctttgccgatgttgccttcgtcgagagggccatccctgtggttgcgatggcggatccacccacccccgagcttgcggcggcgtatccgtccaccaccaaggggtgggcgcaaggcggcagttctgcccacccccgagtgcacggcggtgaatacggcagctcctatgctcgtggagtagatctagccagcctcaagagagaaatgaagcgatgtaggcgaggatttctatcggtggctgtggcaaagaggagacaccgtgagcgaagacgaccgtaagtggttacggctgcatcggtggagaggaggagacgtcatgggcgaaatggaccggtggtggctgcggtggaggagaggaggaggaacaatggtgggggcgaacgatgatgatgggcgaggaagagctagccaccgcccgtgcccgagaggtggccggccatcgtccgtgctagagaggtctccgagacaggagatgaggagtggagagagcagataaggatggggagagcagcggtctcttctactaagtggaaacggtgaccgtaaaaaaaaccgtctcacccatggccggtcttggctcgctctagtaggtgtcgtctttttttaaaaccagcaccaataacactattataagtaccgatttattaaaaaaaggtacaaataattattagtgctggtttaataagaattaatggtgccggttttcaatttcagacgtcccatgaatggaaagggatcatgagtgccaattttagataaatcggtacctttagtgcgtatcacggccggttaattgatcggctttgaaggtgcttgggcataactgcttcccctttcaatgattcggttcgtgggctccaaatccggcgttggttgcagtttgcaactcgggtatgcgcgcagtagcaaacgaatcacgaaatgttcgtaaagccctgacgactgccactggtggagatgtgctttttagtcccggtttgtaaacccctgtagtcctgttttttaaaccgggactaccaatccgggactaaatatcgctatctttagtcccggttcaaatacctaggactaaagatcgatctttagtcccggttggtatcaaccgggactaaagagaggggatctttagtctcggttgctaacaccaaccgggactaaaaagagggaagcggcagtgagatggtccccttttcttttttttcttttttattttctcccgaatcgagtgggatatatatcccaaatcaaacccaaatccccaaatcaaagtaacatctcaaatctacatcacaaatcttaaagttacttatacacacaaatcaaatacatcacaaatcctacaaaaattacaaacatatcaaatacatcacagatccatacaaacgtgcaatgaatcacaaaattatccacacaaatatgcaaatgggctgccgctgccgccggccgcctgccagccgccgccgggcgtggccccaccggccgccgccgcacggccgcctcgctccgccgctgccgcacggccgcgcggccgcctcgctccg

SEQ ID NO: 44143 - DNA, 16018 bp, Oryza sativa
cgacgtcggcctccagaaatgcttcttcccgaacaccggcaagaacgacaaggagctgctcaagaacctgccgctggggatggcggtgccgtcaagcttcgtcttcatgatcttccctaccaatagaagggggatcgggtcccattgctccaactccgagcacatcgacgactcctcctccaagtctggtaagaaaatcgatggctcctcctccaactctgcaggtgagaaggagaaggcgaacaagcccaccgcgaagaacgtgtagcaccaccaactttggggtggtaattgttaggaaacgataggcgaacaaacgataaaaaacaatagatcaatcacaaaagacacgagatttaacgtggaaaaccctcccaaaacaggagagaaaaaaccacaggcgccagccagcaaaatatcttcactatatctgaggtgaggttacatcgccgcacgacggcttacaagaggtatatatagtggaacctaaaagggatgatgatccgtacattattaggagctggcctttattaagtgcaaatgaatttggatcacaactcaacaaactccaccttgagacaaattccttcttgtagcgtgaatcaatccttcatcctgaacacaacaaagacaaaaaaaaacactttcggcgtcaaatagcctctcgggctaaaccactataccaactaagcttgagcaaagctcaaacttagcaacaggaacaggctttgtcatcatatcagcaggattatcatgagtacttatcttgcatacctttagcttaccttgcgcgactacatcgcgaacataatggtacttgatatcaatgtgctttgtcctctcatgaaacatctgatctttggtgaggcatatagcactttgactatcacaaaacaagttaatgcaagaatcaactccacaaagctcagcaaacaatcctttcagccaaactgattctttacatgtttcagcaatagccatgtattctgattcagtggtagactaggcaacaacaggctgcaatgttgccttccaactcacagcacaactaccaatggtaaacacataacctgtgagtgaccttctcttatccaaatctgcagcaaaatcagaatccacatatccaataagccccttatcagtcctgccaaacttcaagcaagcatcagctgtgcctctgaggtacctgaaaatccactgaacagctttccagtgttctttaccaggattagtcatgtatctactaaccaaactcatagcatgagataaatctggccgggagcaaaccatggcatacatcaaagaaccaacagcactagaatatggaactctagacatgtattctacatcctcatcagtattagcacattgtaaagctgataatttaaaatgaggtgcaataggagtgctaacaggctttgcatcatgcatgttaaaacactgaagaaccttcttaatgtagctttgctgactaagaaataacaaaccagaatttttgtctctagtgatttccatgcctagaattttcttagcagcaccaagatccttcatatcaaactcactactcaactgtttcttcaatgtagtaatttgttccttgctcttggcagcaatcagtatatcatcaacatataacagcaagtatataggtgatccattaacaaatttaatatacacacagctatcaaattcagacctcttaaagccatgtgacaacataaatgaatcaaaccttttataccattgacgaggagactgtttcaaaccatacaaagatcttttcaacttgcaaacataatcctccttaccaggtactatgaacccttctggttggtccatgtatatctcctcctcaagctctccatgtaaaaatgctgtcttcacatctaactgctcaagctcaagatcatgcatagcaacaatactgaagaatgtgcgaattgaactatgctttacaactggagagaacacatcattataatcaacaccaacaatttgactgaaaccttttgctactaaccttgccttaaacctcggaggctcgctaggagataaaccctcctttctcttgaagatccatttacaacgaacaggcttcttctgttttggcaagtgcacaagctcccatgtgccattcttctcaagagactgcatctcctcctgcatagctgagatccacttctcacggtctccagaaacaacagcttcagtgtatgtggctggctcaagagtattctccacctgttcagcacaactaaaagcataataaaccatatcacattcctcaataagacggactggagctccacaactcctctttgttctgcgatgggcaataggttcatcttgtggctgcaaaacaggaggtgagtgctgaacagtatcattaacatcattaccaacaatttcagtttcctgatcatccacgtgctctacctgcacgctaacatattgctgctcctcatctgaaccacctggtatgacatctgtgggcaagctgtcattaaacataacagattcattgaaaacaacactcctgctcatgaaggtcttgttagtttcaggattccataacttatatccttttactcctaaaccataaccaagaaatagacacttaatagctctaggctctaatttttcattatcaacatgagcataagcagtgcatccaaaaactctcaactgtgaataatcagcaggcataccagaccatatctcaatgggagttttcttattaagtgggatagaaggcgacctgttgatcaagtagcaggcggtgttagcagcctctgcccaaaaacgcttgttcatgcgagcgttggacagcatgcaacgagccttggagatgatggttctattcatgcgctcagctacaccattctgctgtggagtgtacgggatggtgtgatgcctaacgatgccttccttcctgcagtaatcatcaaaagcatccgaacaaaattcaccagcattgtcagtgcgaagtacttttacctccttttcagtttgcctttctatcataactttccactccttaaaagcagcaaatgtatcatctttatgtttcagaaaataaggccacacttttctagagtaatcatcaataatggtaagcatataacgagcaccaccgagagagggcttacgagaaggcccccacaaatcagcatgtacataatcaagtatacctttggtgcgatgaactgaggtattgaattttaccctcttgtgcttaccaaaaacacagcgctcacagaacttcatgttaccctgagtgcagccatccagcaggttcctcttcatcaattctgccataccaagttcactcatatgtccaagacgcatgtgccacaggttagtcttattaggttcatctttagtaacagcagcagcggtaacagaaccatgtaatgtacttcctctaaggacatataagtttgcagaattcatatcaccaatcatgtaaacaagagaacctttcgatacctttacaactccacctgaaccggagtatttgtatccttctgcatcaagtgtgctgagagagatgagatttctcgccatccctggtatgtgtctcacatctttcagcgtgcgtgttatgccatcatgagtcttgatctgaacggagccaatgcccacgatctcacgtgggttatcatttcccatgcgcacaacatctccattctgcacagacttgtaagaactaaaccaatctctgttaatgtagatatgaaacgaacatgcagtatcaagtatccattcatcatgactagcaacacaaccagcaaaaacaacaagacaatctcctgaatcagagtttttagcactggtaacaacagaggccttaccatcagatttccttttctccttattctgcagcttccaacattctttaatgaagtgaattttctttttgcaatacttacagaactttttacctctagatttagaacggcctctactcttactcttgtcacgatcattgctgtcgttgtaggttctctgctcagatctgcctttgacctgcaatgcttcgcccttagaggacgacgcatcagactgaaccatacctttcatcttctccctgttttggagcgcctcataaacttccgctagggttagttcatcacggcttaaaagtatggtgtcacgaaaattttcatatgaactaggcagtgagcataacagtaaaagacctaaatcttcatcatcaaactgtacctccatcgacactaggtcggcaacgatctccttgaagaccgatatgtggttcaacacagaaccactctcctgcaacttgtgcgagaacaatttcatcttgatatgcatcttactggttagatctttagacatgcagatcgattccagtttgagccaaagttctgcagcagtcttttcctgcaacacttcttgcaaaatatcattagatagatgaagttggattagcgacagagccttacgatctttccgcttctccccagtggtccactcagtcgttttcttcttcccgaaactttccagcgcctcatcaagatccgaagtttgagctagaacagctcgcatcttgacttgccacagcgagaatctcgtcttgtagtctagcagcggtagatcatacttcatcgacgccatcgcgaaaccctaatctgggaaccagctctgataccacttgttaggaaacgataggcgaacaaacgataaagaacaatagatcaatcacaaaagacacgagatttaacatggaaaaccctcccaaaacaggagagaaaaaaccacgggcgccagccagcaaaatatcttcactatatctgaggtgaggttacatcgccgcacggcggcttacaagaggtatatatatagtggaaccctaaaagggatgatgaggtatatatataggcagaagctggcctttattaagtgcaaatgaatttggatcacaactcaacagtaatgggccacaactcacggatcctttcgttgcccactcaatctttgttagctaaagtaaaataaatgtgtgaaattcagctcaaccagttgggattgcctgcagtactactgatgcagtagcagtcaccgacgtgtgggcccggacccatatgtcagccactgctactgtatcagcagtactacagagaatttgcatcttatagatcggccccataggctaatggtgttggcccattaccaccggctcagtcatccctttgtgtctggcttgctaccccaagagttttcttcttttctccttgaaatctataaaccgattgtattcagtgctgaaaatttttaggatgaaggatggcgtcattccttatatatgttctgaaatataagaacatcaaactgtaattaaagcaattcataaatccaatttattaatctcagctaaagcaaactcaatatatgtgaaaagaaaaataataagttggtatctagtacaccatagtacaattcatggatcaagagtgtatctgatacaaacaagaaatgttaaatgggaatgaaatttttatttaattcacaagctcctaaataataatgaaatgcatgaactcgagccctgtatcaatacgattgtaaataaaactgataccacttaggagggaaaaaatgatttgtagtgcaataaatatcattaatatgcagtaggagtaattatttttgttctgaaacatgcagtaggagtaactaatactccactaaaacaataaaattttagttcagttatcaaattccaggttacgagttcaagaaaaaaaaatcaacaaatcgtctaaataaaagaatttcgttttaaatgaaatttgaaagtccatattcatttaatattttgaattttcaattttctgaataaaagggaagttccacaattaaattccgaatttaatttaaactcaaaagcagccatttggttgcctgcaaaagaggtcattgggcttgcaggattttgatgctttggttggctgggaaagccttggtctgctaactggttaggacccaaaaatctccgtgcagataaccaaacaaagatggaataagttcatatgaggtcccttatcttgtcgatcaatccgattttcatcattcaactggaaaatcatatacaatgggtctctcaattgttaaaactggtgcaaaacaagtcccaaggcggtttggacgacggtttcagctggcgtgatgcctacgtggctaatttgactcggtcttcatctgacgtggcatatgaagccaaatttaacaattttaaaaataaaacaaaatatgtgggcccacatgtcagtcaaataataaaattaaaaataatgagacccacttcctccaactcatcctctctcttctctatctccccccctcatcccatcgtggaatacacgagctgacacgaccaccatcccagggctctgccaccggtggcggtggaggaagaggacggcgacgtgaccggtggcttaggaggatgacagagaaggggcggcggtgtgtctcgcggcggtggaggaagacagcgccgagggagaaatcgacgaggttggcgtcggaagaggacgacggcatggttggtggcagaggaggacggcgccgtggcctgcagtggcggaggagaacgacactgtggcccgcagcctcccgcagcggcgagggaggacaacgtcgttgcccgcggtggcggaggaggacagcgtcgtggcccaccaagggggacggcgccgtggcctgcggtggcggagattgacggggtgtggagtgttgttgcgacatcctgcaggtgtccaaattccacaatctagggaagaagggaaacagaggagaaggagcaggggaggagatagagaagagaggggatgaggtggagtaagtggggcccaatgacatgtgggtcctactattttttttattttattaattgaatcacatgtgggtgttaatgccaaaatttggtaagcccgaagttattatttgcctagagttagtaccggctttagagtcttggaatcggccgatgggagtcgtcaaatcgccagcagttgtgttcttggtggagtcggattaattaaaggaaatttatgcagaagagttcgagttcaagaaggatgcggcatggcaagtttatatattaattaggaataatttgttagttccttttatctttaggaaagtgtgtttagtgtcatgtaaggactttatgttttctttttatctttaggaaagtttcattcttgttctataaggactagtatctccccatgagtataaatatttacacccggggtcattgtaagatatctctcgatcaatacaactactctcggcgaatcgccaccctctttccttaggtttttacttatcatctggtggaatttggcacctgacgcggggctgcatcggttcagttctatctccggtgaaggaataagtcctacattccgccggccttggtgaatctattggatacgttagtgttgttcaaggctgcatcgcttcgatctcttggatcgctctggtttggttgatatatttgcctacctgatatctcaattctatctctaattgtgttgtgtttggagacgcatcggtttagttggaactgtctcggttaggtctgatcttctatcttagccgatatctctctacaatcacaatgctgttgtaaatagatctgtcatatccatcacgttagacagatctatcggctcatcgagtattatattatcatatacaatctcgtgctgcatcggttaggttcgacctactagattgttgttgataatataaatcatgttaagccgataggttcatgctaatgttttatcggggtgctagccgataagttatctggacgttgcatcggcttttaaggattgtatatatatacatatatatatataatatttagccgatgacaacaaagactttattgttatctaatattgtggattttatgatatcggatctccagttgatgtatgctttaaccttcggatcagtgctaattctattatatcatactgctagccgattggtttctactcgattatattgttatactatactatcatcagccgattgcctttatatcattatctacattggacatatagccgatggctcaaaaccctatcgttatcggctggtatcggcatcggctagaactactccattggcttgtccgccgatcggctcattgatctactatttgcatatcttgtcaattgcaggatcaaactgactggcacgcccgcatctcatcaagatttagacctgcactagagctaagcagatctcccaggctagtgtgttttttcatcaacagtgggtccacatattttgttttattttttaagttgttaaattttgattcatgtgccacgtcaatgccacgttagatgaagaccatatcaaattagccacgtaggcgccatgttagctgaaaccgcctttggatttattttgcactggttttaatagttgagggacccgttatatttggtttttttggttgaaagacgaaaatcggattcgtcgagatgttaagggacctcagataaacttattcccattgagattgcacattctgagcaggctcaatcgaacgatacgaaccaggctggacggtatgcagggatcaaacacactcttttggccttttacttcttctctttttcgatttctttttatttttatatttttacattaagatatttgcaaaatatatatttttaaaacctttacaaatctatatccctcacgtttcttggaggacgttttttttaaaaaaaacatattttcttatggcgttttctatgatgtagcaaacaatcatcgacgtgtgctaatggcgagagctggtcattttgccatcctcttagggcatgtacaatggtccagatgcttagatacatgcttagaaaaaaaagtatgtaagcatctgttgaagagccttaatctccaatgaagagaatccattccacagatgcttagttatttaagagtctatctaagcatctaggtgctacaatggtagtgaatgagtctaccaattttttttattttactatctcattgtcaaccaatttttaattttattgtcatctttatgacaaaggtgatgtactaaaatacttccatgtgtgatccatatgcctaaaacaagattagttagttggtactgagcgccagggcttgctacgctcctccttttttcgcgcaagtgctcccaagcgacgaccgcttcgcgtggcgacgggcgactcgcgtagcgccggcctggtaaaaaaaaacccggtttttttctctaagcgtctacttaagcatcccattgtacatggccttagagggttatcttctagttttgcatgcaaaggtcctgtaaaatgggcaggcgttatttttggtagggctgcaaggggtcgctagtaaaatagccagagctcgcgccaatggctatttaacaagtcataaaagttgtcccactaaagcattgggggtatttatttgtaaaagttctttaaaatatatctttagatattttaataaaatataaaaaatcctcttttttccgtgtaaatcccagccggcattgttcttcatgtatcagtccacaagctggattgctggatgggaggctagccgagcctgctcgatacaggcctggaccaaccaagtaacacctacacgaggtaacctccaactgcagccaaaccgagcagaccaggaccagccaagcgccaagcggcgccagctgctcaataggccgaactggccaggcggccgcgtcgtgttgccacaccacacggaggtcgcactgatcgatccatttcatcttgcatgcaaccagtcaacccgacaagcacgctccacgcgcgcagcgttgtgtatcggccgtgcacagtgcacctcttgtattgtataccaccgacgtccatgccgccagcatgccaaatggcgccaaaccgtgcttcggcccctctcactatctcgcacgcaccgctgtgtctgaacgagcgatacagtcgcgcgatcgcgccacacccgtgtccgtgtgccaatcgtgcgccaccgctgacgcacactacgacactcgccaccaacagacgcattgtgaccgcgtcagccacacgccacagcgcagctcctccacagtggcactgtgcgtcctcgccgacccgcgacttcgacgccatccttgcactggttaaccactggtgtcgtgccacctcgcaacctcgtttcaggcttccagcccagccgttagagcgaggataataatacagccagctgcttacttatagcctatctatcagctcactcatatagtggttaactctttactataaatatatggtccacatgtctgtctcacagattttcttggttcctgtgcctaagccggttgtaaacttacagcccgcttctcatctctctcctcttttctcccatccacctcagcattcagccttcttatagcccactattataccttctcttagctcgcgttggccactatgagcccatcagcatcaatccaacctcgcggtggtgccacttgttaaacacttggcacgcttaaatctcgtatcatcacaccgcaagtcgagcgacgtgtggcccccctaaacctcggcccattccgtcttgatgccataggaggccaaagacggcgcaatattaagactacacaaattttgctataatacaccgtgacttcgcggttttagctataggacacgacacgaaaaacttttggggggaaacactcacaaaagttggatatttgctagtgtgcatcgcacccattaaaataataatttccggttgaggatgagagagaaattgtgtgaaatgttaaaaatgtcctttgacccacatgtcagctcttctatctctcttctctctatccccttctcttctctctctatcccatatgtccgcgaaggcggcggcaggcgaggtccagcagtggcaggagggctagtacggagcggccgcggcgacagcgctggaggccttttcactccacacgccggctcctccacattctgcgctccggcgtgggacgcctcctcactccgcgcgccgctgccatcgctgtcagccgcgccgccgctcctccactcgcagttgccaccgccgaacctcatatgctgtctggccggcacagcggatgctccgccctcgccctcctgccgccgccgctgctggacctcaccctcggccacggatcgtcgcggccgctccgccttagccctcccaccgccaccggaccttgcctgccgccgtcgtcgctaacatgtgggatagggagagaagagaaggaggggatagagagagagttgacatgtggaccctgggacatttttgacatttcacacgatttctctttcatcctcaaccgaaaattattattttaatggtgcggtatctatcagcaaatatccaacttttaggagtgttttctcccaaaagttattttgtgtcgtgtcgtacagctaaaaccgtaaaagtcacggtgtcctgtagcaaaatttgctgaagactaaggtccgccgtgtcgacgagtgatactcttagaccgaacgagttgggtattagggtacgtaggtacaaggatctacataatacgatatcaagcaaacagaagacaaggattatactggttctggccccttatcaggtaatagtcctagtccagtttatatgggattaatatggaggaaccacgtaatacaatgagagtagatagatctgacgataccgacgagatcgtagtcaatagactcgacgaaatctcccggtgacttggctccgtatgctctggcttcgtaaactgtggtgggtgtgtatgcgatgatattcgatgccttgcacccccagggggtcccttttatacagtggatcatcttgatcttcaagtaatactcggagacattggatcccgtacgatacaatagaaactctatccataccgggtaggactttgtaaatcattcgacccgtaaagatattttccataattcgtgatggattcctacaacacataaggaaacaacccgtgtacgtgaatatataccatacttgtatattctctaagttgtaggatagaaggtatcccttatcattaaccatgacaagccgtgagtccatgaccacaccacttcacggtgtcatgaagaaaaatttgcccaagaccaagatcagccgtgagtccatgaccactgttctacttgccttgtagccgccaccgatcaaacctctcgtgcgtgtgagacaccgtttgaacacatcgccgtagtccttcccctccactgcgcccaagcctcgttccttcctgttgacctgctgaaccgagaccgcgcgccgaccgaacaattggcaattggcacgcgctcggcgccactctgctttgttctgactcgctgcggatgacacgccaatcggtcgttcatggccaccagcgtccagcgggcagcggatacccgcttgccgcctcttgtgcgccatgctcaccagacatcctcacatcagtcactccaccatcagtggtacgctgccaatgtacatggcttgtcctgcctccgtcaaacctggagctcgacggccgtggccatgcccgaaacagaggacggcgatgatgagcacaagcttccgccacgaacgccggaccacgcgtcgagcacaggtgtgcactcgactgtgctgtgctggctgttgccaccaccattgcatagagccaaactagccaaacaaaaggaacgttgcatacacagcatcctttcggatagttagctgctcccaacatcgctccacgcgtcataaaccttgtactggtttatatgagtaaattgcactcacgatataagaacttgtcagggtgggtgcgttctagtataagaacttgaaatttaagcatattggtgcattaacttagctttatagtgcattttaggcaaagtgaatatcacattattattcttttgccacattagcaggggacatcaggtgcacaagatcgcttctctcgcattccaataaatttgaaacagacttcctaccactttttatgttctctttgttccgcatgatgtatatttaatgttggcttccttcaatttatcaggaactcgtgcttcctaggttgatccattgcttttggtcaactataaagcttctgaatgtagatcatgcattcatgctgcttttcttagacgccatctagcttcattgttcaattgacagtataactatgaattggttcatgtatcgatcaaagagatcacggtgccctgtatcattgctaaatctagatttttagtgcttttgatttgatgttgttaacattaaaccggggatatttgctgaaatggaccttcagtctactgctgttccgatccaaggaaccagtagaaacatgtaacaaaaatgacgacgtgtcttgcaaacctggaaaaagattccatgtggcaatcactttgaccaaaagcgcaccatctaaccaagtttggtgtaccaattactcagttttcaagtttatgcattaaactgcacccacctatcaagttatgttcttgtatcttcaatgcaatttactcggtttatattatctcagaacatacaatgccacgtattcctgaaaatacgtccatgcctattatctgcactactgaatttagcacgtatcaaatattccttcagtcgtagatcgatgtattaaggggtgggcgttcggttcatttggagactcgggtcggtttcttcggtttgcttatacatcagtttctctaaaacacaagccgagaaaaatctattatctattatctatctatctatctatctatctatctatcttccattatatactaaaagtccattaaacatcctaaaaacgctctcaagccgccacgtggcactctaaacactcctatgccgccacgtggcactatttaatctcacaatcgatttttatttaattggtggacccactattttagatcattagattagatctgatttttattaaattggtggaccaattacttagaccaatcattagtgttgtcgacaggtggtacccgtagaccggatatagagggtattggggtacgttggtacaaggatctacgtaatacgacatcaagtaaacaaaagacgaggattatactggttcaggccccttgataggtaatagccctaatccagttgatgtgggattatatggtggaaaacacaggttacaaaggggacaatggaacttgtcggatccggcaagatcgtagtcgagttggttcgactagatcccgatggcttggctccttgcatgctccgacttcataggctgtgtgggttgtgttggctctgatattcgatgccttaagcccttcccggggggtcccttttatattgcagatctggaggtctccaagtagaactcggagatatcagaccctatacgatacatcaacgacccagtcttgtccgagtaggattcttcccatccgtagattccgtgaaggatttccttggaatacgaaggaagtatccgtatgcgcgtgggtataccatactgatatgtgacgtatatcgaagtgtaaagggtatgcctaaccataaccctgacagtagccctcgacatctgcttaaaatgagctcgcgtaaccattcgcgacttcgggtgtcgagactgttgtcgttcccggtgcgaggaccgcggagacaggccgtagtcgagcacgccatttgaagcccaatggtcacgagcgaatttaaattgaagtccaaaaaactgccgcgcgtaacggacccagaaatttccggcgggcatctctctctattccttggaattcgcaccgtcggtagtgcgcctatttaaaggaattttgggggtccatcttcaagtccgcccaccgtgctgaaaacattccgcctgtaagcgctcttcgccttcttcgccgccacaagaaaccctagttcatcaacctaggccctttctctagcgatcttcgatcagcgatggacctcggcaaatcatcttccaccagtgcgtcgctgaagaagcttcaggaagacgacgcccctcctggtcttgaaccatggagagggaagcaggatgtactaatccccagcccgtcttaggtcacatggttgcgatcgaagactatattctctgcggttttctccctccgcctttcgaatttattctcctagttttgaacttctatggtctttctcttctccatttgaaccccaattttatcgcctttcttagcatctttgctcatctttgcgaggcctatattggggtagagcctttccttgatctctttcgcttctactacgagctgcgttggatggagtccaacagggtatctggttgcgtcgggttccgacttcgggatggcctgaagtcacgttatatccccttccagtgcccttcttctcgcagcaagtggcggaataggtggttctatcttgagatcaaagacttggaccctgtcttcgttgttcccaaagagcaaccagacaagatttcgtcttggaccgcaaagccccctttgacctcctctcttcagtcgtttatcaacatcattgacgatctccgagtacggggcttgtcggggtatgaagtcattgcagacttcgttggtaggcggatccagtcgctgcaggctcgggcccatccaacctttaactattccggaccggaggacgcgacccgggtttctcctcggggtatctttctcgcatttatcctggcatgtttatgttcgcgttcctcttgatttatcgaaatttggttctcgattcacaggtctgaacagcgaagccatggagcgccgtgtcggctaggtgatgatcagtggtccgacaacagcgagtgacatccccgtgcccctttgtgagaagggggcagctgaacgcaatgacgctatcaacgtaagtgtactcgattggcatcctgcattttcccttcgagatcaccttatgacttgattaagcgtaggctcttcctctg

SEQ ID NO: 44144 - DNA, 13205 bp, Oryza sativa
  unsure (1)..(13205): unsure at all n locations
nnnnnnnnnnnnnnnnnnnnnnnnnnnnnnnnnnnnnnnnnnnnnnnnnnctgatgctgctgctgccaccactagcggtggcaatgttccgacaaaggggaggaagttctcctctgtaagcggacatcgtcgcaaggcgtcgaccccctcggtaagttatcctgtcgtcagatcctgcagccagaaggattctgccttactccgcattggttgtctttcaggcctcggacgcgtctcccctgcctccacgacgacaacgtcttgtgacggttagcgagaagtaagtaggtgaatttttaggtttccgtgattctattcaagcattgtctgattcgtggtcatcccatagggaggcgcgggcaaaggctgcccaagacaagtcggagggacttccagcgcatcgcctgaacgacggatgtcgtgacggaggcgcggcctcgacggatgtcgtgctcgcagccgggaggcgacgcccaacggcccagtcagcgatcccgcggcaggtcgtgatccaccagctgccgtcctcacctgggaggagctccaagtcgagatggggcgcctcctcgaagctggtgcttgcgacatcggccgcgacattgcagaggcgtggtcggaagcagtgctggcgaacgcgcgtgctgaccggctggtgcgcgagttggctgaagcccgtgaagacctcacgaagatgagggaattggtggccggcaacgagcgacaacggcaggggctcaaggaccgcatgtcggaactcgggaacaacctgtcggaaatctggggttcgctgcgggtcacctacactggcctgcactagctcgtcggggagtgcggcatcaagtctaccatcctggtgaatcttgacgagttatcgctaacatcctcccttgcggaactggcgacggtgatgggggagatcccctccaagcatgcggccaggatcgtggaggagacgtcgaactggatttacaccggggcgtgccatgtcctcgcgtgtgtgaagctgtcgcgtcctgaacacgatctacgcgagatcttggatcagggggcggcctgcaacacgcgtaaggaggtgatggaagaagtcggtgatctgggagagtctattctcccctatttgaagagtaggacttcttgtacttccaagacatgatgtgtaacatttgaattctgaccaccttcgtgcgtgcaattatcattttacttttgtatgttacctcgggaacttttgtcctttgtagagatgctgatgacgaggatgtccagcagcgcgggcagcccgagtcaccggcgataattccggttctcgagtttgaaccacacgtgtcgcccgacaatgtggaccagacccttgttacggagacggagatggcgacgacttcctcaggttagtagtccattcaccccttgacgccctcccgactagatcaactgtgttctcgaaaagaggtgtaccgcttgacttagttgttatcacattaagcagatctcgagggtgcctttgctggccaagatcgtcgtatccaatactggaagacgaagtttgaagtagcggaacttgagagaaccatgctggcagtgaagaaagagcaggctgtggaaacgctccaaggttgtgaggtgtggtttaactcgtacttgaagagttgctgcacatccatggccagagtctgtagagaacttcgagtggtccacggagatcctgaggagttggcggccgtgtacatctcgtggctgaacggggcctgtgctcaactcgatggcattggcaagcgtattgacgaggccttgaagcaggagtgttgtcgatcgagccgatacgccggagggcaattgttggcttgcctacgagatcatcgcccgcgcttagacctcgaatttctccgtgagggttttgctcgttctcggaggacttcggcggagatagaccatctggcgagatcgatgtcgccgttggccgagaagatcttccagtctatggactggcgttggccttcttgctagtattcgtaccctgtgacagatatcttaggaaaaaggtgtaatgtagcaaaagatttgtgtaaaaactgtaagaagtattttgtgaaatagaaaagaaatctatcattaacaaatgtttcttactctggatgttgtgtgtaagagtgcgttctcagttcacgactttagttagccgtttgagtcgtacactctctctagcccccagccttgtcgtcggaggaattttctcggaggataaggctcttggacctttgaataagctctgatcctagcccccagctgtgaagttggaaagttgatttccgatttcacggcttggttaatacgcacggtgagaactcttacacgaccagatcttacatagtctttcgtctctacaggatctgacaaggccttatcggcactgggcgtccccagccgaagatcccttaggttcctcggaggccttgtcaagacagcgtaaagggacatgaggacaggtttcaacgctaggtgtcatcagggtaagggatcattgggcaaaaacactttgattgtaacatgggcctaagaattggctttattgatactgtaagctgtcttacaggtacggatggtattgactcatacatagaatttacgtagttggtcaatgttccaagaatttgctaactcacgaccttcgccgtctgcaattttgaatgcgcctggctgcaagacttatgtgatcgtgtaaggtccttcccaattgggtgagagcttgttccgccctgcttggctttgaacccgtcggaggacagagtcgccgatcgaaagtatgcgtgctcggatgcgcttctcgtggtaacggcggagggcctgttgatagctgactgctcgaacggcaactcgttcacgatgctcctcgagaagatttacatcgatgtctcgctgttcctcctggtcctcgtcggagtgcttctgtactcatgtactctaatgtcgtagctcgccggggagcatggccttagagccgtacacgaggaagaagggtgtttccttgttagacgttgtcggtgtggtgcgtacggcccatagtactgatgggagttcttcaacccattttttgtcgtgtgacatgagtctgtcgtagacgcgggtttttatcccttgtagtactatgccgtttgccctctcgacttgtccgttgcttggagggtgagagaccgaggcgaagcatattttgacccccaacccgatgcagtaatcctggaaatcggcgctgatgaactgggagccgttgtcggttatgatgcggtgcggtagtctgtatgtgcaaaatatccctttgatgaatttgatggcgttgtcggcccttgatttcccccatgggtactacttcgatccatttggtgaacttgtcgatagccacgaataagaacctgtagccgccctgtcctcgtgggaatggcccaagtatatctagcccccagcacgagaactgccaagtcagagggatagtctggagtgcttgcgcgggtagctttgtgtgtttactgtggaattgataggcttcacatcgctggaccatgtcgcatgcatttttaagggcggttggccagaaaaaaaccttgtcgaaaagctttcctgaccaatgtccgaccgacggcatgtgacccacaaatgccttcatgtatatcgaggaggaggtgtctgccgtcgtcggacgagacgcatttgagaggtaccccatttggcgctttcttgtatagatcgttgccgaccatacagtagatctttgctttacgggttattttctcggcctctgtatcgtcctctggcaactccttgctgatgatgaatttgattagtgggatgcgccagtcgtctgtggtctcgatatcggcaacagcgcgttctgcctttgtgacctccgagctgatgtcgggggtgtccgggctaacttcgccgctaacctctttcactgatggcttcgtcaggatatccagaaaagtgccgggctcgagcggttctcgtctagacgctcgtcgtgctaggtcatctggctcgatgttgtctttgcggtagatgtgtcggacttcgatcccatcgaatcttttctctagcttcctgacttctgcgagatacttggataactctgggttagagcatttataatctttgtgcacctggttcgcgactagctcggagtcccctttgatgattagtcgcttgaccccaagtgcgactgctgctcttatcccggcgagtagtcccttgtattcggctgtgttattggtcgccctgaagttgaggtggattgcgtgcttgaattgatctccggagggagacgtcaagatgaatcctgcccctgctccttggctgttgagtgcgccatcgaaagccattgtccatgtttcgttgtcgacttggttgtttaatttgttatcaggcatagtccaatcggcaacgaaatcggcgagtacctgtgtcggagcccaaaactaacaacttggatccgactgagattaatgtatcaatccctggatcagtaaaaattgatacatacaatataactggttcttcattgcatatgttaaagtcttacaatactaagggttttacaataataggtactcacctatctaattagtacacagcggaagttctatacattctgactagtgaggtaaaaccctcagggattttctaagttatcggggtcttcgtagtaatagtcatatgggtcctcctcttgacccagatctgaaaaaggggttataagagcaaggatgagtattcacaatactcagcaagttatgatggaaatatgttatgaattgacatataatagggttctttgcaaaaagcggtattggacaatctggaaaagttatagcagaatttataaaacatataaactttatatttctaaccagagtaccatatgagtcccggtactcaactccatgagtacggctattcgaatagtttcaaagatattctactgcagatgatgtacgctttacccgcagtccacgatttgctgataattatcagctttagtcatggcccagtattaagtcattaacagttatggcacctgttccatgaacttgtatcctcatatgttctgaacgtaatgttaacagcagtaagaggagttatggcgttcccgaggtatttaacgggaactgatcgtatgacaccacgtcatctcgatcagggtttagaaatataccatatagtttatactcgagtatcacaaaccatttacctgtacatggtaatggttaaagttgcccttcgcggctatagttgcctcctgcgcgaggacttagaaataagaaccactatacataggtgccataatgccaattaacctaataaataggtctgtccccattttagaaactgcggtcgtactcgttcgttcgacataagtacctagtaaaacttatatcgattgagacaatactagccacccggaaatcatccaaatcttacgtattgtctcaatctaagtatagggtattttaaccagattgtaagcaaaataagcaatactaaattatttgggtttctatgattaatttatgcatagaaaatggaatattgaatagaaggctataaataaataatttataaaatataggcttaaatgatcaacaggtatatggtaacttgccttgctcgatgtcctgagattgattgatattatctagaatgtcagaggaatcctcaagacctagggttagacatataaaattcaaattcaaaaaggagtttaaataaaatccaaaaataagaaaaatagagaaaataaaataaaatgaaaaaaatagcgaaaaggggtccaaaagatagagaatgattttagaagaatattggtccaagtttcattgaaattggatctatattttaaaatatatgggcttctaaagtttgaaaatcaaataaatgtgaaatggcactgtgtgtgggtcccacctgttagtctctctctcttctcttcttctacctccggccgttccccaagtcgggccggcggcgctagggtttaggattgcggcagcgttagaggaagaaagtggttgcggccgaggaggggagggggctagggatctccgtcgacggcgagcggcggcggaggagttaatttgatgcgtggacggcctagcggctagggcggcggtggcacggttaggccgagatagtgatcaaggtgataagagttagacatggctagggaaggggttctagagcatctacgaggtgtccagagggattccgacagcttgccaacctttgacaaggcgcggagcatagttgccgacgagcgcctccataggtggcggccgtgctcacgtcggcagctcagagggtggcatgttagtgcaaagggattgctaaaatggaatctaggtagtatgtagatggttgtaacagaagaactcaccgagattggttgaaacgacggattgcggccggaaaaacttcgcggcggcgaagaacagagcagtgtgggggcggcggtgcttggtttggtgcggcgaggtaaaactcgacgcagtgctttggttagggcttattatgctagaacatggtaggatataggtgttctaagggttatttagggcggaagatggatggagaggggtggagtcgatcgcgcacaaggtgctcgaccgacgggcgagggtggttgatgagatggattggtgaagcagagcttcggggttgtggggctatggttgttgatgatcgatgctggacagggaagggattggggtcctattcatagggctaggaggaacggatgagctcgggcaccttcatcgccttggatgagctcgggatttggatgaggcaaaggtggcagaggctgagagagggcgggcaagatcgatttgagaggcgggaggtcacgttcgaatacttaccagcgaaggattgacttgaccgcggttggaatctgctggcgacgtgttggcgccaatccgggcgtgacgcgtggcggcggcgaaggtgaaaatggctggctcgggggtgaatggtttgaattgtgagaggggataccaccgtctatctccaatcctaccgtgcggcaagaattggcgcgattcaccccgggtagaagcgaaatcgaactcggcggtggcttggacgggtgcgcatggcgtcgagcggtgatttcttgcagcggtcgtagtcctggctttgtcgtcgtcaatattggtgcgacgacagtgggctgagggcggcggacaggcgacggcgcgccaaggcagtcgggcacatgcaaacggccccgaggccgacgcgcggtgacacggcgcgcggcaaaatcagatgccagtgcggcgcgtgcaaggggaggaagaagcaatgaaatccacggtttttgagtggggtgtggtccctaggatcaaatctaaactttgtgcaagattggatggagttgggctgctctaggtgggctagacattcttccgaacaccttatgtgcaatgaatagtagaattcagaaattttgaatatttcctagaaaagatttgaattcaaactaggagtttgaaaaggtttcactagggtttagagtatagcaaatctccactaatattaggataagctaaagaaataatctatggtttgaatttgagagaatttgctcaaattcactagagtttagaataaagggaataagttagagtaaattgcttgggctctaatacttgaaccaattttaaataaaaatcaaatagatttttgaaccaaacaaatttaatcaaaagccagcatgatgccgtcaaattttagtttaaaatttgaggatgttacaacctgggacttgatggctgttcgtggcacaaagtggacatcaaactggctcagctcgactacccatttcgcaatgcggctgataacgtctttgtttctcacaacttcgtcgagagagaaagaggagacaactgtaactctgtgggcttgaaagtagtggcataccttccttgatgtcatgatgaccgcgtaaaggagcttttggatttgtgggtatcttgtctttgcgtcgtggagagcttcgctgacgtaatagactggtcgttgtactttctctctctcgacaacaatgacggtgctaacggaatatggcgtggcggcaatatagaggaataattctttattaggttggggagcaacaagtacaggggggtttgataggtagcgcttgagtgcaacgaatgcctcttcggcttcctgtgtccatacaaatttgtcttgtttcttcagcagagcgaagaaaggttgtcctcgttctcccatcctagcgacgaacctgctcagtgccgccatgcatccggttagcttttgtacctccttgagtcttgtgggcgacttcatgttctcgattgccttgatcttctcggggtttgcttctattcctctgccaaaaacaaggaatccgagcagcttgcccgacggtactccgaacgtgcacttctctggattgagcatgaggcgatatcgtcgaaggttgttgaacgtttcccgcagatcgtcaatcaatgagtcgcctgtcttggtcttgacaacgatgtcgtcgacatatgccttgacattattgctgagctggtcgctaagtgcgccctggaccgtgcgctggaaggtattccctgcggttatcagtccgaacggcatcttaacatagcaaaataccccgaacggcgtgaggaatgctgtcttctcttcgtcctcttttgccatgctgatttggtggtagccagagtaagcgtcgaggaagctcaacagctcgcaaccggctgttgaatccaccaattggtctattcgagggagagggaagtgatccttggggcatgccttattgaggtcggtgaagtcgacgcacattctccattttccgttggccttccacaccatggttggattggatagccactctggataaagtacttctctgatgaagccagctttgagaagtttgtcgagctcttctcgtatggcttgttttcggtctggtgcaaatctccgcagtctttgctttactggcttggcatcgggtcgcaccatgagtttgtactcaatcacctccctggggacccccggcatgtcggacggctgtcaagcgaacacgtcagcattatcgcggaggaaggtgatgagcgcgagttcctatttctcgtttagtgtcgccccgatcttgacagtcttgtcggggttggcactggaaagtggaacgatcttgatggcgccatctggtttcggcgtcttgtttgtcttgctcactttcttgggtggctcagtcgtggcgggtgggttgggcgtttgctcgactatgtcgaggctccgcttgttgcactgcaccgccagttttgcgttcccttgaatagtgattgttcccttcggtcccggcatcttgagcacttgatacgcttagtgagatgcggccatgaacttcgcaagcgtagttctcccgatgatggcgttgtaagctgtatcgaattcagcgacatcaaaggtgatctgctctgttcggaggttgttggcttggccgaaagttacaagcaacgtaatcttgcccaatggtctagacgatgattggggagtaattccatggaagggttgatcggttggtgtcaactcgctttgcggaattcccatcgcgtccaaagtgctggcgaaaagaagattgattgagctgccaccgtcaatgaggactcacgctaccttgatgttccgaatagtgggttcgaccatgatcggatatcgtcctaggatgacggcggtcttggggtggtctccttccgagaactctatcttctgctcagaccacttcatcttgggtgcagccccctgccaagtcgaacagacttcatgttccactttcttgtattctcgctttgaggagtacgttgtggagcctctgaagatgtgtgaaacgtggaagtcggagtctggaaatgctgaatccgattcgtgaggaactgcctcctcattcttctcgaccacgcgtactcgcttgcctttttcaaatgcgatgtgcttctcgagcgattttctgaaaacaaggcaatcttccagagaatgtctgttcgtcttgtgtatggggcaccatgctttccttgtgtcgctactttgtgggtctggtcgcttaggagggttcgcgtattccgctgcgaggacttccgcttgagctttccttttcccatttttgcgatttttcttcttgcttgactcagatgcgtttgtggctggtttcttctctcccccggtcttcggcttatcgttcttgcgtcttagcgcatcatctgcgtgggcgcatcgctgaacaatctcgaacaatctctgagaggttgtgatgcgtcttgtcgccaactcctgggtagtatagcaatctctgacaccggaatcgaaggcgcgaattacagaagcgtcggtgatttcggggattgtatttctgcactcgttgaagcgccgaacatattccctcaatgattcacccgagttctgtgtcaacgcgtataggtcgtcttcgatcgcgtggcgcttgtatgttccttggaaattggcgacgaactgttgccacaggtctgcccacgaagagattgagtagggaggaagatgcatcagccatgaacgtgcagaacctttcaacgcagttggtaaatgtcacgaccggaaataacccaacgggcgttccttacgtgcgtgcattaatccttgtcctaggaggcaaggtacaccaaaagttgatacaattcagagtttaacaagcggaagcgtaaatagttaatctattacatgggcagcgaaggcccagcacacacaaagacaaacgagaaacagcggaagactagggcgacgaccacaggcacttgacggcaggcacgagctagacaccgaagccttcatcctccaggaactcctcttctgggtttgggaaaaattgagcaagactgagtacaaccaccgtactcaacaagacacacccacaagtgcagaataaatgcaagggagtacaaaggagttatactataaagggttagggttgcagtaaacagcatttaaagacattagttgctcagggctattttgcaaagacgattctagtactatgcaatattatttatcaaggccgtgaacccaaacgaacctgccttaacccaaggcctacgatgattcagaccgaactggcaacccgaccctgggtcccagctcgtcccaagccaacccaggctaaccattccacattttagttgttaagcaggttttaagaattaaaacactaacttgggtacattgctcggcttgcccataaccgagggcgcggctattcgaatagattatactctgagcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagatgtccatcgacccccgacttcttccatctccatccgtgtacttttgtttataactagactgagccacaaactaagccttacccactagacatgtggaagtacggtagtgcttttcaacagaggcccgaagaccggtccttatatggccgaggtgctactatcaaaaccatgcaccccgagcccagccaattccacaataaccaaaccattccatagtgtccaggtgatatgaatattcccaaagtctagagttgtaaaaccgcctaatgttacctaattaaaagcgaagcatctacctaaaattatactagtggtaccatgagtagagggtccactagttggggttttgtttattctagggtgaacaaggtaataataataataacaataataataaggtcataacaaaggtaaataggcatggctaaataaaacagtgataacgcgggaatttaaataaagcgataacgcaataagttaaatcaacataattttacaaactgggattcaatatgttcaaagatgatgtgacttgccttgctcgctttcccaaacgccggcttcaacctccacgaagagcggatcttccgaagctgcagcgtctacacgaccaacggaaaagaaacggcttttactctactaaactccatataacaagcagaaacaaagcacaaaaatgggttcttggcttcttaaggaaaaattagagacttgaacggtccaattccgagttcaaatggccaagttatggccatttgaagtttatctgctctttaaatggatatttacgaatttcttcatttaaattttaatttaaaatcggatttattgcgtcagccgaggggaggggcgcgcggaccgggtccacgggagtggggcccacgtggcagcctcacggtccacggtggaccgggtgcacgcggcttacgccggccggcgccgtgggtcccacgcgtcagccgcacccgagggcgcgggcggctgacggccgggccccacatggcagccgcggggcgcgcccgaaggcggccacgccggcacagccgacgggaggcggcgcacccgcgccccgatgctcgccgccggcgaccaccggcgcggcggagcggcgcccgagagaggggagggaagggggaagtgaaacggcggtccacggctcaccccgggtcgacggcgacgacgggaacggcgaccggagcggaggaaggcggcggcgcggctcgggtcgacgaggacggcgttccggcggtcggcgggcgaaacggaggggtggacgaggtcggcgaggttgcggcgaacctgaagaaggcgacgccgaaacgggagagggtccggggcgacgacggcggcggaccggagctcggcggcgacggcggagagagagaacgacggcgcgagctcgattccgacggggagagagagcagcgagtggcggaaacggtggagggaggcacggggagcgtttatatagtgttgggagagggagagagcggccggatgagggggaatcggccacggaagatccggccgccattgatgcgccggcgaagttagcgggggcaaactttccgaacgaatccgagggagagagagagggaaaagtg

SEQ ID NO: 44145 - DNA, 2962 bp, Oryza sativa
ctatgcacaattttgaggatgtattttatagtcgttttgggacgcgacagtaaataattcgccaacgcgttgtcgtctgctccagcagcgtagagcactgtggagtagacttgaaggaactcctctaggtcgggctcccatcatacttttctattgctccaggtcggaatctctcagtccatcggacatcacgcagggaacgaccgaaagccctacacccagcgttgggggcggtgggttgtcggcggtcgtgtgtccttcgtggatgtctgtctgacgatgaggaggacaaggatgatgacgatgacgatgggtcacttggttccggcatacgattacgaggatgtcggcctggatctcgggaatcttgtcgtcgtctcccgctgttgtctcggcgccgatctccgtcatcgtcgtcgttatggcgacggcctcaaccagtattgtctggcacccgtcgtttgcgaccgttgtgatcgtggtggtagtcctggtctcggtcgtcgtttgagcggtcttctcgattttcgttatcatggcgctgtgaagagacatgacgccgagaatgattcacattgtctcgtgtgcgttgtgcctctcggcggctgttgatgtgatctcggagatcgctagtgccgcgaggtggaggggtagctcgttgaggttattccctccgttccgggttttcaccattggcatcgccagttggtggctgctccgggtgcactgcggtagcggcttcttcgaacgcgttgctgaggttggtcactgattcccgtagtcgttctatccaatgctcgaggtcatcgttcagaacgggatcgtagggagtttccctcagtatagcttgaacggttctaatgtgctgggctggtgtagtcaattgattccccgcttctgcgttggcatgggctgacgtgccaacgtcatcaatggccaatacctcccacggcgcgctcgttgtcgatgacccatagtcttcgagaaggtgtaagactgatggttcgtgaggatcgatatcgattaccccaacgaatcgatctgaagttggagtcgctccttgttacttgtcgttatccctgatggggacgtatgacttaggagacggagctttcatggcgccgagaaagacctcgcagcttgagatgtcgtgattctttatcttgtgaataggataatagacatcgcgaattggagaaatacgctgaatcccacgctctttgcaggcgcgaatttcagcgcggacattgaggaaaacccagcaggcttgcaaagtgtgtttcttggttttgtggataggacaacaggaccttgtggcttcggaagtcatctttgtcggctcgcggtttatgtcggaaggacaaggtttggccacatcagaatccttctcgagctcggatgtcgtcgatgctccgttctccgtctcagcgggaggatttttcgacatggagtctcgttggtttgtagccactgcgttctcgtttccggtcattgggggatcggttgagatcggcgtcgtggtgtaaaccgggaagacgatttcgccgacttgattccacaccagcatcgttaaagcagggagtacttggctgaggttggtgttgacgctgttgtcgacgaagctggatgacatagtagtagaaccttaagtaccaagtgcccctacctggcgcgcaactgtcgacggatggtacctgtagaccggatatagagggtattggggtacgttggtataaggatctacgtaatacgacatcaagcaaacaaaagacgaggattatactggttcaggccccttgataggtaatagccctaattcagttgatgtgggattatatggtggaaaacacaggttacaaaggggacaatggaatttgtcggatccggcgagatcgtagtcgagttggttcgactagatcccgatggcttggctccttgcaggctctgacttcgtaggctgtgtgggctgtgttggctctgagatttgatgccttaagccctccccggggggtcccttttatatcgcagatctggaggtctccaagtagaactcagagatatcagaccctatacgatacatcaacgacccagtcttgtccgagtaggattcttcccatccgtagattccgtgaaggatttccttggaatacgcagtaagtatccgtatacgcgtgggtatactgtaccgatatgtgacgtatatcgaagggtaaagagtatgcctaacccgtatccctgacaaatgtatataccttcccattataaaagtgaaaatacgtacgtcggcaaaaaaaaaatcaagtatctccggtaaatatgattcggggaaaaaagcgttcacgttccgttcgccggaagaaaaaaaaattacccggccatgttataaaagagataaagcaaaaaaaatacaataaatactcatgtaccgtcacgtggcactatctaatcacaccatcgatttttatttaattggtggacctgttattttggtctattagattagatatatatgtattgtttattttcattaaattggtgtacccattagtttagattaatcattagtgtatatataatatcttccctgtataaaaagtgaaagtacctacggttggcaaaaataaatcaagtatctccagtacgtatgattcaggaaaaaaagcgctcatgttccgttcgtggaagaaaaaaaatgccaggccgtattaaaatagagataaagcaaaaaaaaaaagaatacaaacaaagtatcatcggaagaaaaatatagaatataattttctaccgtataagataaagcgaaaaaaccatacttacatagtaccatctatatctatctatctatctatctattatataataaataaaatccattaaactttctacaaacactcccaaaccgtcacatggcaccctataaataatctcaagtcactcaataaatatcgatattcatttaaat

SEQ ID NO: 44146 - DNA, 6964 bp, Oryza sativa
tgagagacactggaagaacatatatatgccatgggacacagaaaaaaaatggtaattagcggcaggatacccgtggcactatttttttacatcgaaaggaaagggagagaaacaatcatgaaagtatgattttgccccttcctgccatatgcggctcgcatataggtctgacgccattgtagtcacgacatgaacggtggaggatatggcagcgtggcgtggcgtggcgtggctgtgagaccgacaacaatagccagcgctctgcggcaccctgctcgacataaatcaggaggtgctccatgttgtgctcaccctcaagcgcggtgtgtggcagagcatcgacactggcatggccctcgcgctgcagcgacgatgagtgcgggaacgacatgtagctacgggcccaggcgcatgggctctccttgaaaccccctcccccctctagatagccacctcaccggtggcgggtccggttgctgcgtcagaggtgtatgcgagccggacttggtaggcaaggggaaaaattgtacttttgttattgtttctctctccatttccattggacattataaaataatgttgcgggtgtccagcaactaaatagcagttttttcggtgtcctacagctgatacgcattcttacggtgtccctagctaattacattttttaatgtcctgtagcaaattttaccctaaataaaataaaatactaaagttgctcactaaaaatcaaagtatcccaccttaatttttaataaaactggtagatccattacttatatcccgttagacatctaacaactttctatcaacttaattaattttattttcagcgagtatacaggagctatttacccatacattttgatattgatgcttttatgaataaatgatcattttaggagataaatacataatcttaaaatgatcatatcatctatattatatatatgatctatgaagtcacgtggccagttgaacaacataccgatcatactaagcacgttggttgcaccaaggaatcttaagagtaaaacaaccattatgtggcctcaataatatataagccaattccagataggaattaaaagaccgtatccatttacttttcgggtaaaacttgctacagtacatcgcgaatttgtgacatagcatagaacaatctagaaacgtgtaattattacatgacgctccagttcagtggtaatttgctaagaaaatactatggcctctattttaaattttcttagttgattggagcgagataatttagaatggatgcctttaccccatgctaggttgtaggatcaacccacttatattttcatcccgatttacatagatcaaagcatttcaagatgcttcataaagtggatttgtccaaaaaaatgaagataaaaagaaatgaaaattaaacaaaatttatctaattttaaatttcttttcgttgggtttataacccattctaaatagaaatatccaaacattttaccaggactaatcaaatgaatatatttaaaatttcaaatagaatttaaccaaaaaaaaaattggacattcataggaaacacatcaattgtttcgatacaaaattttctcatgaattaaaagaacactgttttgaagtaattttagttcacaatttatatgttagcaagtaaccaacgttcaaagcacgttaaatatgttaaattttagtttatgataaagtaaaagaatatttttgatataaaaccatccagacatggacattcgtaataaaattttacgcacatgcccgcgcatatgcgcgggctacctttctagttattattatatactaaaaagtccattaaacttcctacaaatgctcctaagccgccacatgttctcctacaaacgctactaagatgccaagtggcagtctaacaatctaaccgttgattttcctttaaattggtgggtctcctataaacgctcttaagatgccaagtggcagtctaaaaatctaaccgttgattttccttttaaattggtgggtctaacatttttaaccattagatcaaataaaaaaaatcctcctctccacaccggtccccatcacctgtacgttcccctcctggcctcctgtacgtacgtactccctctctctcctcatctccagttggcatattatatatcaccttaaataattctacaaatatatttcgctaaattatatcaatgatatccaatatatctattatatagtaaaagtccatgaaaatttctataaatgtttctaagctgccacatgatgcttatataaatgctcctataatgccacgtggcgctccaataaattagaaaaaacctgagaaaaaaaaacctagcctttgatttcactaaaacctagcccatcactccaaaccgttggattagattgatttttctatttctttcgaagaggcgtcccctcttcccgtgcatacgcatgtatataactcctctccatttctcttgtaaggaagttttttttttttttttgctatcggatgaaattatatgttctgtttgtgtcattattatgactaaaatcacaaattagaatttaatacacctcttgactataatttagcttgtaaaaattatgaaaagaaagtgacattagtatattgtttcatgctatataataacttcactggcatgtaactaaaatagatctacaatgtcagaaaaatgtacttcctccgtttcataatgtaagttattctagcattggctatgaatatatagatataagtctagagttttttttcatattgatttcaccaatcactacatcccctaatagacaaatccccaaatcatctccgaatcacatattaaattcatcataaattccaaaaaaattacatcacaaattttgaaaaaaccaccacaaataaattataatgatagtattaagtaaattaaaacaatatgaattcatccgattataaattaattcagataaaagaatactaaacctccacaaagaactctactagggcccggtttagttcccaaaaaaatttgttttgggtgtcacatcggatatacggacacacatttgaagtattaaacattgtctaataacaaaacagattacagattccaccgggaaaccgcaagacgaatttattaagcccaattaatccatcattattaaatgtttattatagtaccacattgtcaaatcgtggcgcaattagacttaaaagatttgtctcgcaatttacacgcaaacggtgtaattggtttttcccctcatttcatcacataacaaattctcaaaaacaatcatcacaaatcctcaaaaaaagaaaacaaattccgaaggccgccgcgcgcacctccctagcccggcgaccgccgccgtcgtcgttccaccaccgccgccggatctggcggatgggagccagaggcaccgccgctcccgcccaatccaacgcccctcctgccctcccgcccgatccagtacagcgcccggctggcccgccgccgaccccgactggccgccgctaacccagagaggccgtggtaggaggaggaggaggcggggagggggaggagaggagagggggggtcggaggggagagggggtcagagagaggaggccgattgagaaggagaatgcccgatattgagatgggatcgaggaagctggagagtggagatggtttttaatgagagacgaagtagagatggtttttatcggtcttaccggtaagaccgagagagaggactcgacgtgcgctcgggaggatttttgttcctggtaggtataaagaaccggaactaaagatctatttttagtcccagttatttgatctttagttccgattgtttataccaacagtactaaaggtaattagggcctaactcgacctaataacttctttgaaccgggactaaaaatgtttttttagtcccgattggtaacaccaactgggactaaagatcaaaaatattttaattgggattaaaaataatctttagttccggttcctattcgaactgggactattgtggtttttgggcgactgaccaaagatggtttctctagtaatgtacaataaatcttggaaattctaaagaaattatataatacacctaaccattgattattttaactcattcatagtatacctattattttctactgctatcttaacaatgtaaaaacggaaaagacccacttctcaccccttcacacgtcatatatgtgttcaagtgacatctccatacgtacaatatctctgcttctctcccttcacatcctctctttttttcaatggacaacattatgtaaaaaaaacaataattagaaagattaatgattataattttaaaagttgtatcttatttttagtttgtttcaattgttgttttatttataactaaataaataattcaagttccatattatccatatttttattataaatttaaatacatcatttgaacattgacacttatgttttgcatggaaaccaaataggaattagacatttcgaaaaggttgactatatgcattatggcatattaaatcagtctacttgataaaatttgattaaacgtcccatattgcacttgtaagtaaccatgtatcatgtctcaaaaaatagaaaacaatccaacataactcgatggatttcattattttcatcaattagatttatttttgaaagaacaataagtaacacatgtcatctattttttaaaaaaaaaacataagacaacatgtgtcatgtcttacaagttataaaaacaataaaagaaatgctgagaaaaaaaaaacatctctcatcggttttcactaaaatccctccacctcatcctccatctcacatgtagaaaacactgcgctcccattccttatttttttagctactaaactagaagagaaacaatgaatgttgaaacaactacagattttttataagctatacatgtctgatttctgtctaattattctctatttataattaaactaacaatgtaatatttatatatgcatatattttgctgtataagaattatagcatttgggcacagtccacccgtgcactttgcaccacatctaaataccttacaattttgacaataaatattatgtcattatgaaaaattctacaaacatgcataactaaattaaataaatagtaccggaacaaaattttcaaatttaatttgccaaaagaaaaagaaataactcaacaacacagagtatagtgatatgttttgaaacatatatagctaaattaaacatacacttcataaacaaaaataactaactgaaatatgaatagtccgagccactgcataaaacatcgagttcctttaattagagaaaatagtccaattacttaatgtttttttctaaatgtgctcaaataatcaaaaaaaataaagtgatcttttataagttccgattaacatttcatcgttataggttctcaaacatagtctacgatgcatgtccgtacgaatgcgcgggctacctttctagttgtagaaaaaataaaaccgacacgagaagaccgaacaaaatcggtttggtttgtttgggatttcatttttttaccgaagcagctgattggtagggttaacgagaggtgggggtttgatctggccacgtgagagcagggttcaccctaccgccggttaccgcgcggttaccgcggtaaccggccgtaccgcggggggtcggtaacccttaccgacggtagggtttgagcaaattttgctcaaattcaaaattttcaaaaataaccaaaaaaaatcaaaaaaaaatcatggatgtatagcttgatttgtatgttgttatggtgtaaaaatttcttgaaaaatagtaagagaaattcaaatttgagcgcaaaaactaatgtcgattagaaaatagaaaaaataattaatgtaatgggccaaatatgcactgttcaggaggcccaataaggcccaacagtggggggaaaatatctaccgcatctcttcctggtttctgtcgcgttcttctatttctttcctctctctctcacagctgcgcattgcttcgaaggggcgacgaggactgccgcgccagatccgccgcctccgcgccggcgtggctgatttccgcgcggtatgcagcggtaaccgtgtggtaggaggcggttaccgactggctcgcccaccaacaggtatgcgcatgagagggggcggttaccgcgagatttgtccggtaaccgtgcggtttgggagagaaaccgtagcctgttatttacgttcgctgctattgttgagcacggtaatcgttgtttaaaccgcggtaaccgtggttgatactgtggttaccgtgcgtgaaaccgtggtatatgtttttttatactgtcatatgaacatattaggtgaaaacattgtgaatatgaattatatttggggattatgtgaagtacgttgggaatatgagtttattagcgaatttggttgcccgtacttgcctaaaaccatgcatgtgaagtacatttgattgttttgttgtatacatgcccgaatttgggtgaaagcttagctgtatacatattattgcgttatgagaggtatgtttataattcctagtgataatttttcatgcatttcatatagggtggagatggcagaaagtagggaccttgtgtgggagcacggggagaattttgcacctggatggcgttgtaagtattgccatcagaggaagaaaggtggtggggccacacgactaaaaatgcacttgggacacaaagggaagggggttacatattgcaattcagtgcctccggatgtccgtgatttcttcaagcgtgaattggagaggataaaacaaacaggtgacaagcgtcagaatgatagcaatagaagggttgaagcggcaggggtcaactattatgacctaacaggtgatgccgacgaggaggaacaaatggaagcagccatggcagcctca

SEQ ID NO: 44147 - DNA, 15103 bp, Oryza sativa
gatctgggaggagggaggggagatgccgctgccgccttctgcgccgccagatctaggaggagggagggaagacgctgcagcctccgccctcctcgccgtcgcagccacacaccccgccgccgtccaacccgagccgccggtcaccggcctcccccctcctccctccggccagatctgggaggaagggagggaggggagctgtcggccggcgagcacatactgcgccccgccgctgtccgccccacgccgccggccaccggcctccccgaaccctagcgcgcgccgcgtgctccctccgcacggtgagccgagccaccgacaagcgggtcccactcgggaccacgcgagaaggacccagcccaccggctccctctctcctcccctctcgcgcgtgccttgggccgccttctcgggccggctggcccattaagctcggccgagccgtgcctttttctctcgggccgcgccctagccgcccgagggaagtctatttcccctccctctttcttttctttttccaaaagggtttaattaaatccttttcctttagaacaaaagtccaataatcttagaaattcaatatcttctcaactgtatgtccgtttgactccgttcaacttccaaaaaatcctcaaatctcgagatctatctaatggcacgcttagaggtcaataatagggctttattttcgccgtttgttgagttgtcccgttttgcgtgtagtttcggagcccttagacccgcagtgcgagaatttcgaggatcaagcccaagatctcgagcaaggcaagtcacctttgatcatcttgcacctataacttaaatctaagtatttcttttccgcaaatattgcatgaataggattaacacgagtacttcggccacggcttgcgagatagcctactggccccaatcctaattgctgcaattaccctccttgaattattgaacacttaaacctcctttgtcaactgttgtgcttcgatgcacgggcctcctggtacgcgcatcggaacaccttccctcaaatttaaaatatccaatgatgggtaaaacttggggctttacaaaagacttgaaaaacccgacacttgggtcggtacttgcgaattaaatgaatttccaaaaccgcagaccggggaacgtaccgagagtacggttttccgctcttgcacttaaggaccgttttccttggaatttcatccgaacataagacaagtgtgatgattggtccaagtcttggcttccgctttccccttttgtgatgcagttgtgagctcgggatctgtccgcagcccaacatgactgtactcctactctgtaataaagagacctctgttgctgtgatattctgtcttcctgtgataccagcactgtttcctgggactggtatcgatgaacaggttaatttggagcgtcacaggatagttccgttcagggctagttcggggtgtgtccggtggagccggtgcgggaggctgcgggtgaggtaggggaccgtgaacggctcagcgggcgacgcagcgcgtccaccagcggcgccaccgccacgtgctgcagcgctgtggtcttgcctcgtgcgagcagcggccgcagtggccggcggtgacatctctccgcctcaagtgaaaccgagatgctctcgttcgctctctctcttggggtaccacgcttggtactcaggtaccaagatttgatacctaggtaccaatttgacaccagggtaccaggtaccaggtttacgtcggcgcacctcccgctcgtggaagcgccgccgctcgtggacgcgctgcatgtgatgcgtcgcccgtcgagccgcttgcgctccccgaccttgctcgccgcctcctgctccggctccaccggcgaggcgtgctccacttcctctactgtaacgctccacttttcgtgagacgttaaaaactaaattacaaaaaaatcctatatgcgaaaatttcgttccttgagtgctgagtttaagtcgtgccgtggatctcaatttaaatctccttgatccctctgtgtccatcaatcgatctatccacttatctaacctatctatccatctacttctcggaagaagtctattttacctccctatatttttggatggaccggtttcctcccccggccatctcccctcccagcccatcaccgccccccctctagcacgtgcgttgcacgcaaccgagacgagagagagagcgccgctcgctctctctgtttctctctctccctcgtcgaactccctctccccggcgccgatttcccgccgccgccgtttgaaatccggccgcgccctcgtattcgcgcgcgcgctcgccgaccgcccggtcgtcgccgcgttagtcctggccgcctgcgccacgcagccgcccatgccgccctgccactcgctccacctgtgcgcgcgtgcgtccaagacatggaggcagagcctcggctcccctctctcacgctctctccctcctccctctgctcgcccaaatcggcaaggagccgagctcctttcccctccccttttgctttttccctctcagcccggccacccgtgaccacctcctgccactccttgaccgcaagcgccgcgccagccgagctcccttgaccacctaagtcggtttcctccccccaaaaccgacttcccgtgcctataaaaccgcagccgagcccctcctctcaacccctcccgcttcactctccacgctgccgcgccattgtcgcccctgccctgcagtcgccctcgctgtccgtcgccgaagctccaggaagaccgatgcgtgcgaaggacgcaagaagaggactccacgtgccgtcatcttccccttccccggcccgaggccggagagctcgctcccgcgccgtcggtcacccatcacagcgcccgtctcgactcgatagtgcctctctccgttctcccttctcactcggcctctccctcttttggctcgcacgtagcttggtagccttcccgaacgcgcgtagacgaagccccaattcccgccaccgcccggcatggccttgtcgccattgccgcccgttccggggagccgccgctcatcgccggcctccctcggggcccctccgtcccatccggcaccggaaatgaattccttgcaccccggagatactctcgccaccttgaatcgacctttcatcgccccaccgcgattttcacttttgctcgccgccggccgccgccgtcgcaatccaccgcccttgacctctcccggcgaaatccgagccgttggctcgcctcctctcgcgcctatcttcgctccggtggtctcccctccttccgccgtgcctcgcgccgctccgccgacgcgcgccgccgtccgccgtccatccggccggccttcgtcttcctcctctcaccatccgacgcggccgccacgtaggcgccacgtcggctaggccgagtcaacccgtcagcctccctcccccatcccggtgcgcgtggtccacggtgcgctagccgccgacgcgtgggcccgcctcttcctagtccatccggcgcatgcggcatgagccgagcccactaaccctagcaccacaccccgcgtgcactcccccccaccgtgaaccaggccgccgccaagtggcccccgtcctgggacccccacgcggtggatccggtccaccagaccgcctccctctccccacccgagccctaatgggccaatctcctttgggccgcgcctcacgctcggcctaaaaagtctatatttcctccctccaccaaatcaattctcatacacaaaagtccatctttcccccttgttggacccacatatcaatgagtaattaaagaatattcttgggaatattcttttccataaatttaatagatcatttcttaaaccatttctcctattccagaaattccaattaagcttccgaaattcttatcttctcaaccgctcatccgattgactccgttccacttccaataattccgtaaaattgagatctatttaatggcactattatttagtctaaatagggtctttttcttggtctttttttctaggttttcgattgtttgcgtatagttgcggttaccggattttcgtcgatcgtggatttctcgaagattcgtgaagctcagtgaagaccttgagcaaggcaagtcaccctttgaccaattgctcctataattgaaaaatcattattattttgtttgcaacttgcattattagaatcacacacttaacttgcttggcctcggtttgcatgctaaaccgacggacctatccagtagtcgcactacttcctgtaggctgacataccctgatcccttgtcgctccaccattgtggtacttcagtatccgtgctctctaagcctgtatgccaattatcccacatacaccgttgtttgtcgaaaatttgggcaatgggtttgagaagccttgaaaacccgacatgtggtgtcggtgtgattgaaaataaaatgaattgtgaaaactcgcgatgcgggggttgtgcctatgtggcactgtcccgtattcgcatataaggaccgattcctgtgggaaactcatcgaacatgatcaaagtgcaaccacaaggtggaatgggacaccctagctaagtaactagtcggttcagggaaacctcgcatgccaatagttgggaacgccggggcggggtcggacaaaccgggttcctggtaaggcaaggacgagaagcttgctcacttaccgatcaaggtggttggagttgatttgtgaatgcctagaatggcctgtatttatgtgaggatttgatccttctatgtggcatgaggtaaccctgggtcggcttgagaaaggctttgtcgcgaacctctgataccggccagtgtctggactaagttcgtgtcttgtgggtaaagtgtacccctctgcagaggttaactaactattcgaacagccgtgcccacggtcatgggcagatgtgaggtggttcccgttgcgtagattttattgcctgtgctttgtgaaaagttgttgtggtgtgggaatcgttaccagaatcagcctatgtggcaaatggatgacctgagtggtcggaaacgaatctgtgtgattcgggatgtctgcgggcatcatagactaggcttcctgagtggaagcggattgttgtgctgctgggcagctggactctgggagtccgagaaaatgaaaaaggctctgggagccgattaatcaagtgaaatggctctgggagccgataagtaatgatctgacccgggaggtcggtacattaccatttgagttgttgaaaagcatctcttaagtcaaatcgagacgtaagtctcttttcgatccaaactcaaaaagaaataaatcacttagtgacttcaaaaatgatttcaaacaaaggatttgcaaaacaaccttgcctctcttccaagcttgcattaaacacctaaattcccgtgacttgctgagtacgaaattactcacccttgctctatatatatatatatatatatatatagtacatttgtttggtgctccatggtgcccgggcaccattgttgaaattgagtatatagttcctctgccttgaagtgaagatgaagtgaagtgaagattagggtttcgtcctggttcccagccgtcgtctgtggtgttgggtgttagcccgttggttccgctgctgctgctgttgttggtgttttctcgtccgcgtcgtcggttgcattctcggctgttctgagctgcaacctaagttaaggtaaataagtcctctatttattttaaggattgcaatgattcatatttgtcaccgtgggtaccagcgctatgtcctgggactggtactgagatcgcggtttcgtaagaagcggttcgcgccgttattcctatgacacgctcctgtcaggtgccgttgtacggcggtgctggattggggtgtgacatccacctcttccctcacgtgttcgacctccgcggcccgccccgctcccgctctccctcttgctcaccacgcccgccgctgagctcctcgccatcgctgcctcccccgcggcagcggccgccggctacagcgagcggtgcggcgacggtgacgggccggggagggctgtacctcaggtgccatctgatttgggggaggagtgaggtaggaggaggggatccggattagtatcctgtctccatgggataccggtgtatagattttctcctaaatatatgatagcgctgaccttttgatttatgcaaaaagagactatgactaaaatgtattaaaataaacctgcacttttaaacataagtctatgaaaatatattaaaatcggtgagtacgaaacattgcacttcacatctcctcaaaaaaaaaacattgcacttcacatgtgcatcaataaccttacacatatgccactcatttaatattttgatattcaaaattgataattagggagtatgtaacgaacatgagcattttttttaatttagcctgttataattcaaaattaaacaatgtactcaatatatattaaaatttaatatctattctataatgactggtgcgacgtatttgttgatgatcagtaattttcaataatacagaagttaagtctgaaagttaagggtgtcaaatgtctggttttgtagtttaggggtgtaaattcgaactgtcaaaatagttgaaggggttatttggatttttttttcctatactaggtattctctgaaatgtttcttccaattacatttttcttagtcataatacaaaggaagcatgtccttctgtccttcggtgccaattacagaacaatggaaaaactaaatatagttcatcataagaaggtacattaagaaaccacagcttacagatactaagcagtagttcctcttgaaagaaattgattaatacagtacaccttctgcataaccttacactgtatgcaatcaacaaagccgaaaacagcataccttaaggttccactgaaaaagaacattccaaaccatacccaaaacccgaaaaccactccagccattacacagaaggatagatactggtcctcgcattttctacaaaatctctcatccgatgcaagtgaagaacttgtgcatgaaatgttcaatggaaagccacatagaccataattgttgtggtatattgatgggtcactgagggtttgaagttgattcccagtgggtatcttacctgatagatgattattcgagagatttagaatgtcaagagtagatatatcagcaaggcttggaggaatggctcctgaaagttagttcaatgagaggtcaaggaactctagatttttcgtattaccaatgtttttaggtatgccgcatgacagatggtttcttgacaagttcagaaatagaaggccttggagggttgttaactcatcagggatacactgcgacaatgagttacctgacaaattgatacccgttagtaattcaattgttttttcgaaaaattgctcttgccccttccagattgtatcgattccatccgagtaaagcagccaatttatgtaagaagaccattctaatgtttcttgagcagataaagtatttggattcttcatggaagttaggttgccaaaagatttgggaatcaatcctgtcaaaccgttgttgcttatgtctaacagttgaagttgagagagattcgacaactctgaagggatttcacctgtgaagttgtttgatttcaggctaagaaacttcaacgacagaaggcctttcccaatccaaggaggaatacctccaaagaatctgttgttcccaatatctagggtgatcagcgccttacacatctctaacgatgatggaaaaacaccggtgaagccgttgtcggcaagatgaaccgattcaagagaacagttgtagttcgtctggactgtagggatttcacctgagaatgcattgttggacaagtcgatgaactgcagattttgcaggttccaccagcagtcgggcagcttaccagtgagcttgttgtttgacaggtacaggatctttagggagagcagttgacagaaatccgaaccagatctgctgttagaggaattccctgacgaatgatcaactccctgcatcttgaaattgtttcccatatttcccggaatcggtcctgaaatggagttatggctcagcttcaggaatgtcaaatggctgagatgacccaactcaggtggaatacctcctgtcagatcattatctgacaaatcaagatcctccaagcttgtcaaactccctaatgctgcgggtatgctgcctgataatctatttccaaacatgaacaacactatcagtttccctgcctttcccagctccggcggaatcttgccggtgaacaagttgttctgcacttggaaggatatgagctcgggccagctcgtgaacaacgccggtgggatctcaccggtgaggttgttcgttgaaatgctgaacacccgcattgcttgcatcccggcgaactccggcggcaatccaccggagagctggttcatggacagctccatgacagtgagattcttaagatttcccagctcaggcggcagagttgaaacgagctcggcgttcatgatgctgagctgctgcagcatctggagctggccaagaacaggtgggatagtaccgcccagcgggttgaatccgagatcaagaaccttcaactgcgacatcgaccccaggaacaccgggacgccaccggtgaggttgttgctgtcaatccgaaggtccaggagcttcgtcaacctcccgatcgacgccggaatttgaccggagaacgcgttgaaggacaagttgaggtacatcagattcgggagcttttccggcagcatgtctggtatggacccagagaaattgttgtgcgacaggtcgaggaaagtgaggttgccgctgcggatgacgaactccgggaagctgccgttgagggagttgaggaaaagagacaggaacgtcatggtgggcatcggcgagaacttgcggaagtcgagcccggtcaggtagtttgctcccaggtcgacatgggcgatcttggggagccggctgagctggtgcgggatggcgccgacgaggttgttgttgtagaggcggaggtcgacgaggccggagaggtcgccgaactgcggcgggatggagccgtcgaaccagttgctgccgaggtcgagcgaggcgagtgagcgcagccgcgagattctggccgggatcgcgccgacgaggtagttgtcgttgaggtcgagctcagtgagcgccgggagcgccgcgaagtcgagcgcgtggatgccgccgcggaggcggaggctccggagccggagcgaggcaacgctgccggcggcgtcgcaggccacgccgcgccaggtgcagaccggcgcggcccgcgtccagtcggacagcgaggccgcgtcgtccaggctggccttccacgccagcagcgcgtcggtctgcgacgacgacgctgccgcttcggccgacgcagggatggcagcggccgcggcgaagaggacgacgacgtcgacgaggaagaaacggtggacgacgggagccatgtgcgcagtcggttccttcatggcttcatggcagaggcgtagtagctcctagtagtaatccagttagctgactaacgagcagaacggaggaaaaacaggagctggttggcacgacgtggcgatctcgcgttggagtcgtctccgactatgcaggtatgtcaatctatctatctactcgggaagctattttaatccatctaagtggatgttcaaatggttataaaaatttcttaaaaaatttaacaatgcccatacaacatatatatatatatatatatatatatagtatatgctcactacacaaaatcttaggataaaattaactcacgcatcgaagatataaaaagacaaattcaacgtacaaatagcagcattctgttcgcacctgaatttatctttttctttatgtgtaggtcgaatttcaagttgattattgatagaccaatagatgtcactgtactttatattgtcattttttttcaataatttttcacaactatttgtgttggctttgaaaaaaagtataaaggggacatctaatgaaggtactagaatccattccctatctactcatgttttactccctccgtatcaaattttaaggctatattattttacacggttttcagagacatatttggggctttccaaagccctagttcaagaaaaaattattccatatcatattcctaacgaatatgaacttagcaacacatgaaagcataatacttagcatatatatgtttagtatgattatgagtccaaaagttatcgagtttgatttttctttaaaaaagagggcgccctataatttgggacggcatattatatatttttttctaaatcaaacttacgtttgactcagattaaatttagtaactttataacaccaaattagttttatcgaatgtaacattgattatatattttgatagtatgtttgtgtggtgttgaaaatgttactatatttgtttataaacttaattaaatttaaagaagtttcactaagtaaagaataaaaatgatttataatatgaaatagagagtgttaatttatttgttattaaagtaaagtagtaggttaggtcaatcatggaccatatcctatgcatacaagctttccattcacaccaactagcaaatatcataaaaaattctagaagaaaatggacacatactttaaattgtattacacttatatgtgaaaccttatctttaaataaattatattttagccataacaaaagagaaaattctgatagatttttattcttaaaaatattagatttttcttttttatggttaaaatataataaatttgaatatcagacgttgcaaagatgtgtaatattattaggagcacaaatccaatttttttcaagaactttccatgataattgttagttggtgtgcacggacagtacacgggaagtttgtgtgccagaatatgcttttgcgcaatcaagtggctagcatctatataaatttatgatgtaattgtgcggctagcatcaatataattttatattatgatgtaaattcatttgtattttctacacattaatatatataaaatttcttaagtagtcaactgtcacactccaatctggcaccgccgtacaacggcacctgacaggagcgtgtcgtggggaaaacggcgcgaaccgcttcctacgaaaccgcgatctcagtaccagtcccaggacatagcgctggtacccacggtgacaaatatgaatcattgcaatccttaaaataaatagaggacttatttaccttaacttaggttgcagctcagaacagcccgagagtgcaaccgacgacgcggacgaggaaacaccaacaacagcagcagcagcagaaccaacggactaatacccaacaccacaggcgatggctgggaaccgggacgaaaccctaatcttcactttacttcatcttcaacttccgggcggaggaactatatatatatttatatagagtaagggtgagtacttttgtactcagcaagccacgggaatttaggtgtttgatgcaagcttggaagagaggcaaggttgttttgcaaatcttttatttgaagacattttgaaatcactaagtgatttatttctttctaagtttgggccgaaaagagacttgcttctcgattcgactttaagagatgtttttcaacagctcatttgataatgtaccgacctcccgggtcagatcattacttctcggctcccagagccattccacttgattaatcgtctcccagagcctttttcattttctcggactcccagagtccagctgcccagcagcacaacaatccgcttccactcgggaagcctagtctatgatgcccgtagacatcccgaatcacacagattcatttcttgaccactcaggtcatccatctgcctcataggctgattctggtaacgattcccacaccacaacaacttttcacaaagcacaggcaaacaaatctacgctacaggaaacacctcacatccgcccatgaccgtgggcacagctgttcgaacagttagttaacctctgcagagggggtacactttacccacacgacattactaacccggatcacccagcccgtgagatcagccacgtcgagagaccctaaggctttcatgacaaggcatttcgaaagccgacacaggtttaccatatgccaacaagaggggtcccagaccaacaccaggttaggtcccagaccatactgtgccaggaagcccgagggttctccctgacaccaccccgttgaatccacatgtctcttggcatcatggctcccccgattagctaattactcagccaggggcgtcccattgcacccgtgtggtcgcacttattatatgctcggataaatttcccacaggaatcggtccttatatgcgaatacaggacagtaccacataggcacaacccccgcatcgcgagttttcacaatctattttgttttcaaacacaccgacgccacatgtcgggttttcaaggcttctcaaacccatttctcaaattatcgacaaacaacggtgtatgtggaatagttgatatacgcactcagagaacacggataccgaagtaccacaaaggtggaacgataaggaatcagggtagtacaacctacaggaattagtgcgactactaggtaggtccgtcggtttggcacgcaaaccgaggccaagcaagttgagtgtgtgattctactaatgcaagttgcaaacaaaataataatgattttccaattataggagcaattggtcaaagggtgacttgccttgctcaaggtattcactgagcttcacgaatcttcaagaaatcccgcgattgacgaaaatccggtaaccgcaactatacgcaaacaatcgaaaacctaaacaaaagaccaaaagaaagatcctatttagactaattagtagtgccattatatagatctcaattttacggaattattggaagttgaatggaggcaatcggacaaacggatcgagagatatgaattttctaaggattatttgattttctgtctaaaggaaaaggaattattaattctcttggaaaagaaaaggaaggagggatcggatttagactttctcgagcaacttaggcgcggcccgagggattcacaaggcttggccggccattgggccgagcgtggccacggggaggcggcccattagggcgcgcggggagggagggaggcccgacggggtgggcgcggtccgccgcgcggggtcccgagatgggcccgcatggcggcggtcgggtgtatggtggggagggcgcacgcggggacgggcgagacggaccggtggattgggtgcggatgcggtgcgctggtcgacaaggaggcggcgggcccacgtgcagcctcatggctcaccggggtctgcgcgcacggggatgaagggacgagggcgagcggctgaccggcttgaccgagtcaagccgacgtggcacctatgccaggccacgtgggcggcgagaggaggaagaagggggatgccaagatggacggcggacggtggccgagttcaccggagtttgatgcggaggtctagggccaaggggagcacaccagaacgatggctaggataagagggagtgagcctccggctcggattccccggggggggggattcaatggcgacggatttcgacggtggcggccggcggcgatcaaaaggggaaatcgcggtggggcgacaagaggtcgattcaaggaggagggagcatctccggggcgcggggaactcatttccggcaccggatggggcggaggactgccgaggagggctggcgacggcggtggcctccgggagcgggcggcaacggcggcaagcctatggcgggcggcggcgagacctggggcagcgtccatgcgtgttcagggggctagccgaggtaccacgcgagctagggagggagaggacaagcgagaagggagaacggagggtggcactaccaagccgagacgggcgcagtgacgagcggccgacggctcaggagcgagctctccggcctcgggccggggaaggggaagaagagagatggccggagtcctcgtctcgcgtccacacacgcactggcctccgacgcgtgcgacggcgaagagacgaaggcaagaggtgggagcggcggcaaggcgtcaacaatggcgcggtgagtgtgaggcgagcgaaaacgagagaagaaggggtttggggtggcttgggttttatagtggaggcgatgtcggtttggggagtgagggaaaccgaccttggtggcggtcaaggagagcgagctggcggtgagctggtgcagtcgcacgaccagcgtccgcgctttggccgcaagcggctgggaccatggatgacatcggcggtggtcgggaaaaaggggaaacgaagagggaaaggagggcttgacccttgccgaaacgggaaaaggaggagggagaggggagtgagacaggggctgcctctctcggccttggaagctagcggcgtggagcggcggagcggcagcgcggcagggcacgacgcaggcggtgccagggtttgacgtagcggcgaccgaggcgttggccacgcgcgaacccgcgcgggaagggcgaatgcggtgggagcggcgtccttgccggtcgaccatgcgcgagcgcacgggaaacggtgacacggccggaattttggggcggcgtcggcgggaagcgaagccgagagagagagagaaaaaggagacggcgctgtctctcgctcccgaacacgtgcgacgcacgcgtgagacgcacgcgtgagagagctgggccgagaggaggggatgggtcgggagagagaggaatcagctgtagcgcccgttccgtcgtggcgcctagcgggaaaactatctcttaaaaaactctatttgcgaaatctgtttctttgcttgttgtctagtgtctgtgccatctcagatctcaaatccccgatctatcgccgagttcaatcccgaatccaaatccttcccaaatcaattcctccgcaaaagtctattttgcctccccggggtcgatgggccgaatctctctcggcccatctaccccggggtgg

SEQ ID NO: 44148 - DNA, 32364 bp, Oryza sativa
agggagaggcgctcggtgcggctcacgcgcacgcgcgtgcggcgcacgggcagagcgagggaggggagagagagaaagagagagagagagagaaaatgggccgagagggaatcggtccacagaacctgagggaggcaaaatagacttttcgggaaggattgagattagggatttgaatttgacgatggattggggatttgagatttggaattggcacggaaactgacaacaagcaaagaaacaatcttcgcaaatagggtttttagaattaaaattttcccactaggcgccacgacggaacgggcgctacagaccaacccccctaacaagaatcttgaccccgagattcagcacgtaagggagcagctccggaaactcggcgcgaagatgatcttctcgttcccaggttgcttcatcttcggaatggttgctccattggaccttgtagaacttgatggtctttcgtcgagtctgacgttctgccttttcaagaactctgatcggcctttctttgtaggtcagattcttttccagctcgatattgcctaggggaacttgttcttctggaacacgaagacatttcttcaactgagacacgtgaaacacgttgtgcacatctgcgagaccttcaggtaacacaagctgataagccacttcgccacgtgtagcgcccgttccgtcgtggcgcctagagggaaaatgtaattcctaaaaacccaaatttcgaaatatgtttccttgcttattgtctagtatccgtgccaattccggatctcaaatccccgatcgatcgtcaagttcaatcccgaatccaaatccttcccaaatcaaatccctccgcaaaagtctatttcgcctccctcaggttcgttgggccgaatccctctcggcccatctccccctccctccccatccctctctctctctctccctctctctctctctctctttctccctctcccccgctctgcccgtgcgctgcgcacgcgtgcgcgtgagccgcgccgagccgagcgccctctgccctcgttgccgtttcccgccgacgccgcccaaatcgccgcgccgcccattgcttcccacgcgcgcgcgcatcatggtggccgaccggccagtcgccgccgccgtcagcgtctgccgcgcctgctgcccgtgtcgtcgctccgctccaaaccgccccgccgtcatcgccatcgtcatcgcctggccccccgccactccgcgcgcaagctgccaaaggacggaggcagagctcctcctccctctgccgcgtcgcccccgctccctcctccttttcccgaagaggcaaggggacaagcccccttttctctccctcttttcccctttttcctcccgccggcgtcatcctcctccctcctccctgtcgccgctttggccacgaccgccgagcgctagccctctcctttgaccgccctaagtcggttcccaaaccgacattgccatcctataaacccaagcttccccctttcctttcctctcccattcgcctccacgccattgccgccgcctcccgtgctctgttcgcagtcgccgttcgtcgttgcgcgtgtcggaggagccggcacgagcaaggacgcggaaggggactccgagcgcgccctctccttcctcttccccggcccgaggccggagagattactcccgcgccatcggcctctcgtcactgcgcccgcccgcacggtagtgcatctccccgttctccctcctcgctccatctcctccccttagactcgggtagtagcacgagtagcctccccgtagctagccggcgccgccccgaccgttgccgccgctcgccgtgtgctcgccgccatcgccgcccgagctcggaagcgccgctcgtcgccggcctcgctcggcgcagctccgcccaatccaacgctagcattggattcccgtagccgcgtagatgctctcgccgccgggaatcggcccctcgtgacctcgtcgccgtttcccccttctcccgccgccggttgccgccgccgcaattcgccgccgtcgggcatcctccggcgaatccgagccgttggctcgtctcccctcgtcctgtgcaaccacccggtgtgctcgctttcgcctgtatcgccgtggttcgttccggccggcgtcgtcgtctatctcccgccggcccgcgtggcagccacgtaggcgacacgtcggcgccagctcggccaaaatcgggtcgggccgaccccggtcagcccctcccgtgcgcgcgttccaccgcgagccgtgaggcggcgcgtgggcccaccgcatccgcgtcctccgcgaaccgcgcgcgtgcaccgcgtccctcccccgcccgcgcgcgtgcgccgcgtgctcgctccgcacggtgaaccgtgtcaccgacaagcgggtcccacccgggaccacgcgtggtgagcccggtccactggctctctctctcctcccctcccgcgcgcgcgccttgggccgccttgggccgccttgggccggccggcccatttagctcggccggaccgctccatttgtctcgggccgcgccctagccgcccgaggaaaagtctattttccctccctcttttcttttcttttcttttctttttcaaaaaggatttaattaaatccttttcccttagacccaaaaatccaataatcttagaaattcaatatcttcccaaccgtaaatccgtttgactccgttcaacttccaaaattcctcaaatctcgagatctatctaatggcacgcttagaggtctttaatagggctttattttcaccgtttgttgagttgtcccgtttcacgtgtagtttcggagcccgaagacccgcagtgcgaggatttcgaggatcaagctccagatctcgagcaaggcaagccacctttgaacatcttgagcctatatttgaatttaattatgttgcttgaaaaatattatgcattgataggatcgcacttaatctgtttgtcccgtctgcaaggcagattggcggacctacctaatttgttgcatttgatccttcctttgttaattgttatatcatgtccccttgtaaccatctagttgcgcctcgatattcgtgcaccctatgctagtatcgacggtcgccttcaaacttaaaatctgaaaaacttcttgggtaaaacttgggttttacaaaaggcttggaaaacccgacacctgggtcggtgcttgcgaactaaatgaatttccaaaaccgcggaccagggaacgtaccgggtgtacggtttcccgctcttgcacttaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggcttacgaaatgccttgtcatgaaagcttggaggtctcccgacgtggctgatccccatgggctgggtgatccgggttagtaatgtcgtgtgggtaaagtgtaccccctctgcagaggttaacaaactgttcgaacagtcgtgcccacggtcatgggcggatgtgaggtgattcctagcgtagtgttgttcgactactgccttgtgaaattgctgttgtgaaaaggggatcattgtttggaaaatctgcagctgatgggatcagctaggcccgggtggccatttgaaagttgttggcccgggtggccatttgaaagttgttggccgggtgccaatcttgatcaattctaaagactgatacatttgcacatactccgaccggacgagacgcactgtctcatccatgtcgtttgagaagcactcacttagttgctttcagaaaagagttcaaataaaatcaattgcaaaaacaacagcctttccttgaagcctgcattaaacacttatttcccatggcttgctgagtactcctgtactcacccttgctgtacataaataatctcccccccagttgctgaagaagatgaagcggatcccgctgacgaggagttcttccaggagcaagccggctacgatgagttttagggtttcggcctagttcccaagtcgcgcctatgttgtttggtccaagtcctggcttccgcttcccttttgtaatgcagttgtgaactcgggatctgtccgcagcccgacttgattgtactcctactctataataaagagacctctgttgctgtgatattctgtcttcctgtgataccagcactgtttcctgggactggtatcgattaacaggttaatttggagcgtcacgggctagttccggtcggtactagttcggggcgtgacatcagcccatcgacaagggaggcaaaatagatttttgctgaaagattttgatttggagagatttggagtttgggttttgaatctaaatttgatactttgtacacaagggttcaaggagtcaaggaaggaaacaaaacatgagtttggatattttgggatttggaaatttatttggcgaggattcaaaggaagagattgactttcggaattagattttagagacttgaattggaagaggaaatttgaggcggaggattttgatttcgatgagagggaacaatgggatttgaaaccgagatccatggcacgacttagactcgcactcaaaggacaaaatttttcacatttaggatttgccgaattagtttttaacgtctcacgagaagcggagcgttacatcaactcgtctcagtatcttaatataggatatctttacatataactaatggctaacattatctttcagttgataatgtgaagtaatttattcatgggctcaagtcaaacatgatgctagctgattttggtgcatacgagtggaacaacaaacatagcatgtatagtaaaaagaagggtgaatagctaatacgatccctgaagtttcgcttcgggcttaatttagccctcgatatttcatatcgtccaagcaagtcctccaaattaattatttgggttaatatagtccttagacccaaaaaaataccacatgagtatgtcaagtcatccttgcatgcagcggtttgaatgaaatgaccattctaccctcatatatcatgtagaaaagaaagagatttgtcaacatagatggtgatatcaataggattggaagagatttgtcagcctatgcttcctttgcaatgaagtctaaggcttggtttagttcccaattttttttcaaactttcaatttttttcatcacatcaaaactttcctacacacaaactttcaactttttcatcacatcgttctaatttcaatcaaactttcaattttgacgtgaactaaacacaccctaagacaagtgtcatcgcctactaaatttatatggttgtttgagttagcaacttagcatcggccaatatactaatacctcggtcccacaaatacttgtactggtagaaatgaagttttttgaatggagggtaattaattaccgaaggagaaaaaaagagaatggcttggctcgactatgatcacacttttcaaaccagaaaagtatatgaattcccgcaaaaaaaagaaaagtatatgaattcttgtccaagtatatgaatttgactatccaaaccagaaatttcatccaaatatagcttgccaatcaagtcaaacaaagaaaaatcgccctcttcaggcaaactgctgagttcaagtgcagactaatctcatacgatttgggggggccttagctccataaatacacttcgtctccttcggtccttcctcctcaacaccaaccagacagaacagaggacaccgctcacaagcaaatacagagtcgagagtgagacttgaggcagaggccatggccggaggaggagacgagctgaagctgctgggcatgtgggcgagcccgtacgttctgcgagtgaagttcgcgctcagtctcaagggcctcagctacgagtacgtcgaggaggatctcatgaacaagagcgacctcctcctcagctccaacccggtgaacaagaaggtgcccgtgctcatccacaacggcaagcccgtctgcgagtcgcaggtcatcctccagtacctcgacgaggcgttccccggcgccggcgccaccctcctccccgccgacccccacgaacgcgccgtcgctcgcttctgggccgccttcaacgacgacacggtacgtcggtaccatgtcacctcacatcgcgatcatccgcatcgtctccgactcttccgtttttgattcaatttgatttgttcgcagctggtggaggcgtcgcaggcggcgtcgtgggggaagacggaggaggagagggcggagggggagaagaaggtggtggaggcgctggagaagatggaggtcgggctgagggagtgctccaaggggaagcccttcttcggcggcgacaccgtcgggtacctcgacgtcgtgctcggcggcttcctcgcgtgggtgcgcgccaccgacgtgatgcgcggcgtcaagaggttcgacccggccaccaccccgctgctggcggcgtgggccgagcgcttcgtggagctggacgccgccaaggccgtcatgccggacatggacaagatgatcgagttcggcaaggtgctgcaggctcgcgccgccgccgccaccaactgaagtgacagttgacttgtcgtgtcatgccgaagacgaacggatgttgggattgtttccatctgtttcacagtcgagtgtcgtgtacgttacgagttcagatgtgttactacagtagtagtaacttgggttgaaaaaatatctagggaacagtttgtccaaggtaaaatgttataaaccgaaatgaatagtgttaattagagaaaagaaactagtacaagtggcgtctgggtgagaaaggtctttacaacttaataacatggcccaatgaaaataattacagatttggctgtgaaaaaaaaagagagaagactatactgtgcgggacaatgaaaaggtacaccaataatatattagcggtcataatctaataacaatgcctattcgtaaataaattttaccggcattaaaaagaaggtaccgagagataataaatttgatacgtgggatactgagaggcatcaaattttaccagaaaggctatttctctttggtacctttttaagagagtatcgaacattttaagataagtttatgcatatgtatgcatttaaaataaaattgtaacaattattggggaatgctatacagcacgagattgtgctatttcactagatataggcgtaaaaaaaatacatcccctagaggcaaaaaagagctgtacaaaattacataagcgttgtggttaagttgggaggaattctccaagtcaccttgtgcctgccattattcaggttcttgactcttcctttatttttgccataaggttgggggctaccgtttccttgtgctcgaagatcctttagttcctttctttctagatttcttaggctatgagtaggattaaggatcgcagccctttcttgggcactttctttttgttggctagcatttcccaccattcatgtacgctttggcatggctcccaattgctcaggtccaattactgataagccacccagccgaccatcagtctccagatccttctggtgtatctaaaggaagctaataggtggcatgtcgtctcgttcgtcgtacggcatagggggcacactccgctatttggccatcctcttgtagctagtcgatcggaagtccagactctattttgaattacaagccacgcatagaatttgcattttgcaggagcccaagatttccaaattaggggattaaagtttgtgccgactattcctagacactgagccttgtatgccgaagaggccgagcattctccatgattcgagagcttccagacgatgtggtctgactcattttggtttagtatgatgtcctgggttgcgctccatagggacacaagttggctgatcaggtccactgtaaaagtagtgttcctatttagctccaggtcatcgatccaggtgtcattttcaatgccttcatgtagtgatttacttcttttcaatatgccttcgtttaattttttagaccaggttagcggatcacatgtttcaatacatctgaatatgggagcgcgcattcaacgagccacgcaatcagtatactagctaccccgtccacagaacacgaaccaaaaccatttatttaaccatctcaaatctcaaaacctcactcacacgattcacagttcaccaccaagctacagctagaagaagctaatggccggagcaggagatgagctgaagctgctgggcatgtggacgagcccgttcgctctgcgagtgaagcttgcgctcagcttcaagggcctgagctacgagtacgccgaggaggacctcagcaacaagagcgagctgctgctcagctccaacccggtgcacaagaaggtgcccgtgctcatccacaacggcaagcccatctgcgagtcgcaggtcatcgtgcagtacatcgacgaggcgttccccggcgccggcgtgcccctcctcccctccgacccctacgagcgcgccgtcgctcgcttctgggccgcctacatcgacgacaaggtgattcacaaattgcctcaaatcaatcgcaacgccctgtcttgaatttgcatcgaatcaataccaaatgacgatgtttctggtgattgattaactgtcaactgctgcgcttggtgcgtcgtcgcagctgttgaagtcgtggctgcaggcgtcgatgggcaagacggaggaggagaaggcggaggcgttgaaggagacgttcacagcggtggcgaacctggaggcggccttcgaggagtgctccaaggggaagcccttcttcggcggcgacgccgtcgggtacctggacgtcacgctcggcgccctggtcagctgggtgcacgccggcgaggccctgtacgggatgaggctcttcgatgccaccaggagcccgctcctggacgcgtgggtggaccgcttcgccgcactggatgcggccatggcggtcttgccggacgccggcacattagccgagtacgccaagaagaggcaggcggagcgggcagccgccgcggctgcgaacaactgaactggcatgcaggggccgtggttcgcgacgtggttgggcctcgacgatgaatttggtgtcatggtgtgccacttgtagtcccgtcacatgtggcgatgtgggctttgtttgccacgtgaatttgttgtctgtctgcgttcttacggttggatattgttcgtgtggttttggttagcccgtttcttccaataaatggaattattaatttttagaggaacaagagtgaacattttttttttcaaagatgacgaaaattattacatcctgggcttttacataaggaaaagtgtagttggactaaatcctagttacccttaagtaataaaaacaactgaaagccaaaaaaatcacacaaattttaaggatttagcaaatatatgttagctacctgagccaattattaaaacattttggtttattattaaaattggtagtgaatatgtctcttgcatattgcgaaaacaatatttctctcgctaaaatttattgaaatggctagaaatcaagtaattttaaagtggccagacgagacagtcgtgcccgctacaggacatgggtgcctctgtgatggcacgacagagcctgagctggagccacggatatgatgtggcgagctaatgggcactcgccatgtgcccccactgtaaatggccttattgcaccatttcttatgtttcctcttttatttctccaagaaaggatggaagacatgactttctcggttacttactaaaatgcttttagaaaagaaagaaaaataagtaagttgtagtttgtaattaaacaattagcccgatcaaaagtgtccacacaatatttctgagtatatgtctttttttttccttttagttagtattctctttcttttttttcaaacttattgtttgaattcatttttaattcatcaagtgggccacatggataggggagcaatgggagacgcgttcggcacaacaattgtgtgcaggtcccagttggtgaggatcttctagcataattttttatttttgagaatttgtttttttttcaaatttgaccaaattttgttacaaaattccaataattttggactgaaatttttcaaaattttggaaatttcgccgtaccccacctctggatacaaatgccaaaaacgaaatattgaaccctgatcccggcatggtacaaaccacctattagagttaggtaccccatgcagatgcattttaaacagcccaaattcggctaaaccataccacacggatgggagaatttggggaaaagtgaatcaaccgattgttcctttacagtttacagtcatctctattgtagtattgcatcacagtataaatgatccaaacctattgacaatttcatcttttgattatgtggccaactatatattaataactttggggaatccacataaatgacacttcctctaaattttaatatatgatgtcgtttactttttgacatatgtttgacggttagtcttattgaaaacttatgcacaaatatgtgaaaatgtaagtaatgagtaaagtacacttaatggtaaagcaagttataataaaataaataataattatgtaaggtttttaataagataaatggtgaaacatctgtaaaagaaaatcaacaacattatcatttgtttagaacctgaggtagtaaaatggaacctagtcaacttaattcccaaaacagcagaatctattcgtttctgaataatctcagtctgcattcatcgatgacatcatggatgatgcattggcacgccgcaggcatcatggatgatgcatcgatcacccgccaccctccacttcaatctggagcaccatatatacatcaccaccctgctctgatcaagcatccaagtatacgcagcaaaacacaatccaaagcgtgttcatccaatcattctctgttccgctctctcaccccagcgagatggccggatcaggagacgagctgatgctgctcggcaaatggccaagcccattcgtcaccagggttgagctcgcgctcggcctcaagggcctcagctacgagtacgtcaagcaggacctcgtcaacaagagcgagctcctcctcgcctccaacccggtgcacaagaagatccccgtgctcatccacaacggcaagccggtctgcgagtcgtcaatcatcgtgcagtacatcgacgaggccttccccgacgccggcgccggcgccgccctgctccccgccgacccctacgagcgcgccgtcgctcgcttctgggtcgcctacgtcgacgacaaggtaggatagctaagctacctttccttcatttgtgtcacagttcgagctgttatctcaaaacacaaatattagggaatgatctaatatcaaataattcgaaggatgatgctctaaacccaaatcggctagcccactaccttgtgaaactagccagaaaactcccgggcatttctctcgaggtttttatctcactgatgcgatgatgtgttgggtggcgcgtgcgtgcagttcgttccggcatgggtggcgacgttcagaggcaagacggaggaggagaaggcggaggggatgaagcaactgctcgcggcggtggagacgctggagggagccctgaaggattgctccaaggggaagcccttcttcggcggcgacacagtcgggatcgtggacgtcgcgcttggtggcctcatctcgtgggtgaaagcgaccgaggtgctcgctggctccaagatcttcgacgaggagaaggcccctcttttggccgcgtgggcgcagcgcttcggcgagctcgacgtcgccgagaaggtgttgccggatgtcgacggggtggtcgagttcgctaagatgaggctggcagaggcagctgcggctgccgcggcggcttcaaaaaactaagatggatatgtttggttatgtcgtggtaactcccattgtttgggagaaaataatgtgcttgttggaaaaattatttgggagaaactaatgtgcttgttggaaaagaatagatttagttgatttagtgttttttctgtatcagtatcttgatttatgtctgaataatgcaaggaatattcaatgaagtcatgaagatgcttgtcctctgtttattcagtagttaggggatctttttcttctgttggtgtctattagtttgtgtttgcttagctttgtttatactatcgtgaactttctatataagtttttttctgtgtgagttctaaaataattgactataactctttaagtaaaggccggaatgttttattctattattaaaaaaaaaatgaagatgcttgtcctctgttttctctgttactcgctgttggccctgttgcccttcagagattttgcaacttgcacggttgttttgttctcctgtatttatccatttccttcattgaaaattcggcagtgtgtagtaggaattttttttccatcactttgtctttttttaccattcaaaagtttattggttgggtacctacgacagagacagggacgtaacccattttttttctttataaaagagcctatagggtgaagttttatctcaaatattgtggattccgcccccattccttttagcttgtttatcatatcattgttgcgatttatttactccatatttctaaaagtatgatttctcaaaaaaaaattcttatatggtgttagcagatcacttgttgttacgagctatttattaattttattttttattaaagtacttaattatcctgatagatatctgtgatactaattcggtgaataatttgttccaagcattgcaactactcataccatttaattattcagatgaatcgtatgttctatggtgcttgtacctttaattttgggaacttttacagtatatagtggtaaaatatatcaccaatataaataatccaagagtttagattgatttgttctctcacttaaatagtttgtagtataaaattaaaagggtaaaaatattttcactattgggtgtaaattcgtagaatatagtgtgaaacaatactacgtgttttcactaatcgatctcattccttattcctcatcatccttcaccacgatgagacgccagcagccaccatgagtccacgcgcgccaacaccttcatagccaagtaagccaaccaccacatttttaatcttgtggcaaaattttaaaatatttatattatattgacggtatatattttcttgtaattttacactagggatgtatgttgacatctttagtgatactcagggccggatccaggaaaaaaaattagaagagttcagttacatagtttattcaatctccaaccatttagaaacctttaatttatcaattatggtgaaaaaatcgaagggggtgttacggagatatccatgggtcttatgagtataggggagactccacgttggatccacccctggtgacactctcttattcccaaaagccaaaatacatgcatgcggataattgtgaaataatttgcgaaaaatattactaaggttttgtaatcatttcttgtgccccaatgcacaaacacccacaagtgcccgcgatgtccatgtcatccactgccactggttttgttcttgggctctcaaaactcacaggtcaaagtaaacgtactttaactggtaaagcaaagcgatactatgacggggagcagcgccatgatctgtaggtttgtttaatttaatgccccagatcctaagcttcctcttctccaagaaagagtagaagacgcatcttgacagtctcagagatgctgactggagtattttcaggaaaaaaaaaagtgtactccagtttgaaaacaatcagcctggtcaaacgtgtcggtgtcaccatatccgtttattattgatttatctgcacatgttttgactaaagttactgatcgcatgtttttgaatacatctgaacactgaaaagagctttcgacgtgttaaagagtagttgtggaaacccctatttcaattgtgcaatcaagcatcactcgtgacgcactactagtcttctatagcatatacaaatattcacggttcgtgttgtgctccgatcaagtgctagctagctagcaaaagacaactcaagccaaaaccatctcagagcttcagagaggaagacaatggccggtggaggagatgagctgaagctgctggggatgtgggcgagcccgttcgcgctgcgagcgaagctcgcgctcagcttcaagggcctgagctacgagtacgtcgaggaggatctcaagaacaagagcgagctgcttctcacctccaacccggtgcacaagaaggtacccgtgctcatccacaacggcaagcccgtctgcgagtcgcaggtcatcgtgcagtacatcgacgaggcgttccccgacgccggcgttcctctcctcccatccgacccctacgaccgtgccgtcgctcgcttctgggccgcctacatcgacgacaaggtaatcgacgaattgcctcaacccaatcgtcttgaatttgcatcgaatcgaaaatgacgagatgaactgatgcgttgtgtgtgcatcgttgttgcagctgttgaagtcatggctgcaggcgtcgatgtgcaagacggagcaggagaaggcggcggcgatgaaggagacgttcgcggcggtggcgaacctggaggcggcgttcaaggagtgctccaaggggaagcccttcttcggcggcgacgccgtcgggtacgtggacgtcacgctcggcgccgtgatcgggtttgtgcgcgtcggtgaagccgtgcacgggatgaggctgttcgatgcgagccggagcccgctccttgacgcgtggctggaccgcttcgccgcgctggacgctgccaaggcggtgttgccggacaccggtaggctggccgagtacgccaagatgaagcaggcagagtgggcagcagctgccaccaactgagccagcatggccacgtctggtactctcgtggggagatgaagttggtgttggtgtgccacccgtaccgtacgtagctagtcctgtcacacgatgtgacgactgtgtgaactttgctactatacgcaataaaattgtgaagtcgttaagttttcgtaagtacacaccggcaacgtgtaatggaattatctctactggtcgtcctccttaattagtccttcactcctaccactacttagaaaatgcatttttcaaatgtggggttttttttttcacaggcgaacataaccattgaaaccaaatgaccgcatacaaaaatataaaccgggctgaagcttattgtcttgcaggcggaccattccgcctgcaaataccctttattttcacaggcggatagtccgtctacgaaaattagtgtacaatataaatagaggcgacatcggagcggttttttttccaagtcccatttctcctctcctctcccgttccccgttccccctcccctccacctgtcctctactctccccttccctaacctctcctttccccggccgtcggccggaggcggctacaaggcagtggtggcgcaccccagcgagggcagtggaaggagcggacgcgggacggccagcggcggctctcctccctccctccctcccagatctggccggagggaggagggggaggccggtggccagcggcgcggggcggacccgtgtcggggcgtagcgtgtgctcgctggccggcgacggttcgcctccctccctcccagatctggccggaggggggaggggggaggccggtggccggcggcgtggggcggacagcggcggggcgcagtatgtgctcgccggccgacagctcccctccctcccttcctcccagatctggccggagggaggaggggggaggccggtgaccggcggctcgggttggacggcggcggggtgtgtggctgcgacggcgaggagggcggaggctgcagcgtcttccctccctcctcctagatctggcggcgcagagggcggcagcggcatctcccctccctcctcccagatccggtggcacggagggcggtcgcggcggcagctaccggctgtgatggtggaggcggtggcgtttgttttgattttgaaagttaatttgtgatgcgtttgatttgattgtgaactactatgattcttctatgttaacttgtgatgcttttgtgaatttgatttggtttgatggggaatggaaactggattggatgggggaatgggaggaaaacggagaacaggaagctgctgctaccggtcgaaacggcggtgggcggtggctgcccttttttttaatgctgggagctattttcgcaggcgttcatttgtaagcggaccagttgtccatctacaaaaacttgtttagtccgcctgaaaaaatgttttttttccagttgttgacgaaaaaatcgaacacaccggcctgggagatctgcttagctcctgtgcaggtccaaatcttgatgagatgcgggcgtgccagtcagtttgatcctgcaactgacaagatatgcaaatagtagaccaaaacagccgatcggctgacaagccgatgtagtagttccagccgatagtgataatagctgatgccgatgccagcagatagcgatagggtttaagcaatcggttatatgtccaatgtagataatgatataaaggcaatcggctgatgatgatgtaataaaataacaatataatccagtataaaccaatcggctagtaataatatgataaataagcatcgatccgaaggttaaagtacacatcggctggaggtctgatgtcatgaaatccacaatattagattaaacagtaaaacctttgttgcgataagctaaatccaatatgtatgcaatccttataagccgatgcaacatccagataactcatcggctgaaaccccgatgaaacccttattggcaatcaaaaagtaggctagagattatggttctaaacacgacttagtagatcaaacttaactgatgcagcactaagtatgaaaagaaacataatatctagacaatcaagccgttgactgagttttcagggtggtagatgtctaagctaatctaatctagcaacacgatttagccgataccggcagaaaccctaaagcgagaagcagccgatagaggtaaattgatatgctaagactagattaacagagacatatgataaataggtagacaaatatatcatccaaaccggaacaatccaagaggtcgaatgtattgatgcagccttgaacgacgctgatgtagatgatacaatttcctggaccggcggaacattggacttatcccttcgccagagatcgaagacgatgcagccccgcgtcgggtgccaagtcccgccggacgataaaataaagtagaaaaggtaaaaggtggcgatgcgccgaattgtattgatcgtgaagatagattacataggtcccgggtgcacatatttatacccgtgggttgatacaaatccttgtcggagaagaaagaaaaattcctaaagataaaaggaaaagataaagtccttataggacactaaacacactttcctaacggtaaaaggaaactaacaaactgttcttaattaatagataacttgccatgccgcatcctctttgaacttggtctcttcttgataagcttcctttagtagatcaatttccttaaccgaatatagcaagaatccgacaactgacgacttgacaactctcatcggctaatctaaggacttcgaagccaatgactactccgggcttaccaaatttcactgttaacacatgccccccagttttggagtatgagaattcatgcttcaaaatttcttgtcttgataactccaaaaccgatcttccttcgcttcttgcaatcggctttcatgagctaatactgatgtgcttcaccatgctgaaacttatacgcttgccccccgagccgagattgaatgatcttggcattgacttcttcttcagacatgtggatataaaattcgtggtcccaccaggcgtgccaatctgtgttgacgagaaaatcgaacacaccggcctgggagatctgcttagctcctgtgcagatccaaatcttgattagatgcgagcgtgccagtcagtttgatcctgcaattaacaagatatgcaaatagtagatcaaaacagccgatcggctgacaagccgatggagtagttccagccgatagccgataatagccgatgccgataccagccgatagcgatagggtttaagcaatcggccatatatccaatgtagataatgatataaaggcaatcgcctactgataataaaatataacaataatatagtccagtataaatcaatcggcaaataataatatgataaatcagcatcgatccgaaggttaaagcacacatcggctggaggtccgatgtcatgaaatccacaatattagattaaacggtgaaacatttgttgtcattggctaaatccaattcatatgtatatgcaatccttatgagccgatgcaacgtccagataactcaccggctgaaaccccgatgaaacccttattggcagtcaaaaagtaggctagagattatggttctaagcacgacttagtagataaaatttaactgatgcagcactaagtatgaaaaaaaacataatatctagacaatcaagccattgactgagttttcagggtggtagatgtctaagctaatataatctagcaacgcgatttagccgataccggcagaaaccctaaaacgagaagtagccgatagagctaaattgatatgctaagactatattaacagagacatatgataaataagtaggcaaatatatcatccaaaccagagcaatccaagaggtcgaatgtactgatgcagccttgaacgacgccgacgtaaacgatacaattgcccaggccggcggaacatcggacttaccccttagccggagatcgaacaccgatgcagccccgcgtcaggtgccaagtcccgccggacgataaaataaagtagaaaaggtaaaaggtggcgatgcgctgaattgtattgattgtagcgatagattacatagaccccgggtgtacatatttatacccatgggttgatacaagttcttgtcggacaaaaaagaaactttcctaaagataaaaggaaaaaataaagtccttataggacactaaacacacttttctaaagataaaaggaaactaacaaactattcctaattaatagataacttgccatgccacattctctttgaactcggtctcttctggataagcttcctttagtagatcaattttcttaaccgaatatagcaagaatccgacaactgacgacttgacaactctcatcggctaatctctggacttcgaagccaatgctgtctctaagccgatgactactccgggcttatcaaatttcactgttaaccgatacatctagatagctcgactattgttgttcagagtattgtcataaaataaatgatattgcataatgcaagcaatcgatcatatcaaacatgagtcaccaaccgacgacaccttttgtgtggatagttctagaattaagtagccccacaaataatgcaacaaaagaaagtagccccacaagcaacctagcaggatccacattaaaagtgcctctggacaatgtagctctcacacaaaacaactgtagcgattgaactacaatgggctattgaactgctagatcacaaaatagatgttattctctattcctttaactaatgtaggattgaaatttgaaaacttaagcctactagagatggtgataggggagaacaaataaagattcacaccaaataaaagacaaaaagggaacttttttctattgttttgtcactgttttgaaatataaaatcaaataaaactaaaacaaaaactaagcaaaactagaagaacacgaaagagaatgagattaccacattttcctttgtgtaaagatggtatttattacatcaaagtgtttatagtgtgtatccaattactcatccactatactagagaaaagcactttggtgttcgttgggaaatttaagtatgcataaatgtggatacaacacagccaactgctacaatattgcacctataatcactacgacataggcagcaacacaactactgtagtatggcagccgaacaagcccatagatgctgggatttcctatctagtaccactcaggcaggactaatgaccttggataattggtgtggttccacagcaaacacctttgaggcacacatgtggcaaaaaaagtctcaaattctcaatgcatgcatcggctcgattccaaccgatgcattgagttgctccccgtaaccccaaaaaaaaatcgaacaaaaaaaacttatgtacaagctgaatcacaaattaaaaaaataagacctgttgtacattctaagtcatgactaaataacaaatccaacaaaaaaactcatcgtcatcgaagggatgggcggcaacgattgggaaagggaaagggaacacaacgagatctggtggttatcgagctcgagacggcatcgtcacgtcgccctggtgagcgggcccagggggaggggttgtgctctacttgttgtacacggcgaggtacctgatcttgttgacggaccatgcagcagcacccccaccaactgtagcatctgcttcccctttcccttctccgcctcctctccgcccctcactgcctccctcccacctcatgcacggtgtgcgacgtgaatgctgcgccatggtgccctgtcacaccccaatctggcaccgccgtacaacggcacctgacaggagcgtgtcgtgggaaaaacggcgcgaactgcttcctacgaaaccacgatctcagtaccagtcctaggacatagcgctggtacccacggtgacaaatatgaatcattgcaatccttaaaataaatagaggacttatttaccttaacttaggttgcagctcagaacagcccgaaattgcaaccgacgacacgaacgaggaaacaccaacaacagcggcagcagcggaaccaacggactaacacccaacaccacaggcgacggctgggaaccaggacgaaaccctaatgttcactttacttcatcttcaacttccgggcggaggaactatatatatttatatagagcaagggtgagtactttcctactcagcaagtcacgggaatttaggtgtttaatgcaagcttggaagagaggcaaggttgtttttgcaaatcttttgttttgaaatcattttgaaatcactaagtgatttatttctttctaagtttgggccgaaaagagacttgcgtctcgattcgactttaagagagatgtttttcaacagctcaattggtaatgtaccgacctcccaggtcagatcattacttctcggctcccagagccattccacttgattaatcggctcccagagcctttttcattttctcggactcccagagtccagctgcccagcagcacaacaatccgcttccactcaggaagcctagtctatgatgcccgtagacatcccgaatcacacagattcatttcttgaccactcaggtcatccatctgccacataggctgattctggtaacgattcccacaccagaacaacttttcacaaggcacaggcaaacaaatctacgctacaggaaacacctcacatccgcccttgaccgcgggcacagctgttcgaacagttatttaacctctgcagagggggtacactttacccacacgacattactaacccggatcacccaacccgtgagatcagccacgtcgggagaccttaaggctttcatgacaaggcatttcgaaagtcgacacaggttcaccatatgccaacgagaggggtcccagaccaacaccagattaggtcccagaccatactgtgccaggaagcccgagggttctccccgacaccaccccgttgaatccacgtgtctcttggcatcatggctcccccgattagctaattactcagccaggggcgtcccattgcacccgtgtggtcgcacttattatatgctcggatgaatttcccacaggaatcggtccttatatgcgaatacaggatagtaccacataggcacaacccccgcatcgcgagttttcacagtctattttgttttcaaacacaccaacgccacatgttgggttttcaaggcttctcaaacccatttcccaaattatcgacaaacaacggtgtatgtggaatagttggtatacacactcagagaacacggataccgaagtaccacaaaggtggaacgacaaggaatcagggtagaacaacctacaggaattagtgcgactactgggtaggtccgtcggtttggcacgcaaaccgaggccaagcaagttaagtgtgtgattctactaatgcaagttgcaaacaaaataataatgattttccaattataggagcaattggtcaaagggtgacttgccttgctcaaggtcttcacgaagcttcacgaatcttcgagaaaacccgcgatcgacgaaaatccggtaaccgcaactatacgcaaacaattgaaaacctaaacaaaagaccaaaataaagatcctatttagactaattagtagttccattgaatagatctcaattttatggaaatactggaagttgaacggagtcaatcagagctacggattgagagatatgaattttggaagtttaattggaatttctgggcaaaagaagatatttgtggaacaaggggaaattgatttatgaaatttatagaaataatattctcaagaatattattgaccgtcactgacgtgcgggaccaaggaaatgatttatggaattttgggaataaggaattgatttatggaataggggaaaaagggtttattaaatcccttgaaaaagaagggagggatgccatatagacttcctagggcggctcaggcgcggcccgaggggtttatgcggcttggccggacctaatgggccggcgcgggcacgggaggggcggcccaagagagggggcgcggggagagagaggccgacgcaggtggacgcgatccaccgcgcgggacccacatggcggtggttgggttcacggtggggagggcgcacgcgggggcgggcgctagggtttcggatgcgcgcggttcgggcgcggcgcaccgggtggatggatggcggcgggcccacgtgcagccgcacggcttgccgtggaccgcgcgcacgggagggaagacggagggaggaggctgactgggcgcgacttgacccagtcaagcgggcccagggctgaggtggctgccacgtggtcggccacgcgggcaggggtgaaaggggaggaggaggaggaggaggcgcccgggatcagacggccgacaacgcgtgaggcgttccggcgagcggtggctaaccggagcgagcggctaccgccggcagctagaggaggtcagggggaatccatttaacggcacggatctgagaggggaggtacgacagtggctggcggcggtgaccaagcttgtcggatcggggatgtggtcgcgcaagggaagggacaagggggcgcaaactcgggcctagccgaaacggtacgcgaccgtgatgcgcacgcggtgacgcgggacccgatggtcaccggcgatgcacgcgcggcgttgttatgcggcggcggaaacggcgacacgacgcggagacaaaggagaaggccggcggccttggggcagccagggggaggtcaaggggatccccgggagcgtggcagcgagaggaatcggagcgaaaggagccgacggtggtggattgcggcggcggccatcgccggcggagagaaggggaaatctcaccggggcaacgggagttcgattcaaaggggtgggagcatctctaggacttagggatcccgtttgtggcgtcggatgggatggggaggcgccgtggaggtccggcgacgagaggcggtctccgagagcgggcggcatgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaagataaacggcgcagacggctccactccacaggcagcttgaccaaggctacacctaatcctccacaccatcagcatcactgtagaactcttcctctgatgaatgattgcaaggtgagtatatgacatactcagcaagtcacgcagcaaatatgcaagtgcacaaggataccaaaggatggcatagtagggtttcatttgcaaaagcagcatttagcaaacatttcagaatttaataaaacagttaagtattaaacaatattaatccaacgctatacaacataccctgttgtataggcccaaccattctgaacaaccatcccggctgcacagttctatctccaaaccaggagctaatcaaattattaccaattaaagcaccttttattatggtgagaagggtgagactaatcacgaaagatattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacctctcgtacaacacaatccactgcagcgcacctttcctggatcataatcacccccttataaacaaggcatagactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccagtccttaattgtcatgagcacgaccatcaaaaccatgtgctcacaacccaccattatcaggttttagttggcacattaattaattaaccaatcatgatagaacatcgtgaactatcattaagccatcattaagtaatagtgagtcataagttatcccaatagtgtgctaatatttctaagcatggctaagcaatcatatctaatatctagctgaaccaatatatataaagttcaactagtcaagttatattaccccaaggtatcaaggaataaagtaatcaagaacaaaagggctataacaaagaataggttaattccacccaatgacattcgaaaataaatgcaataattgaatagaaacaatagctttaaataggatcaacatgctcaaagggttgtttgggatctgtgtgacttgccttgctggccttggaactcttcaaattcttcttctgcaaaaacggactctccggtaacgacggaatctaagaagaaaagagcaaaatcaccaaaacagcacataaacaagcatgaacagtacatgtggatatttttaacatgtagatctcaattttagaaaaatttagagacttgaaccaactaaatccgactaagatgaattagttatgaatttttgaagatttaatcggattaaaacacttatattgattttaattgaattatgacgcaataatgaattatttttcaaaaggaaaagaggatttattgcgtcagcggctagggtttcggtggaccgggcgcatgggcgacggttcacgcgaacggacggccgagatcgacttgatccaaaacggacggccggaaacggaaaggatcgatcgaattttgaagggaacggcggcggcgcgaaactagggtttcgggcggcggcggccggaggttgacgacgactgacaagcgggacccacctgtcagcgacagcgagggcgcgcgcgggctgcggactgggccggactgggccgaggagagagagaaaggttttgggccgactttcggcccaaagccaaaagagactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaaaaattccatttaaacaacaatttatatattttgaattttcagggtgtgacacggcaatggcggcgaggctgtgccgggcggcgacggcgctagggaatggtttggggaggtcctagggagctcaaggacggtggtggcgcgagggattggcgagggggcccatggcggcgcacaggcgggcgcggcggcggcgaagcagagcaacggcggggcggcacgtttagggggacgagcgagcaaccgaacggctcggggcttatccaagatgatgcaaatggcaagaatttgggcgaggagctcaccggcgtgcggaaacggtatcggcggcgcggatggagtcgcggcgaggcggacgcgacggcggggcggcacagcgccgagagggcgtggccggggaagaagagatggagaggcgcgaggatgggggcggcgcggagctcctcatcgactcctcgtgctcgctagctccccgacacgcacgacggcagaggagggcgagaacgacgacgaacggcgaggcggcagtggtgtgatggaggagaggaagcgagaggtatgggaggggggtgtgggttttataggtggcgatgtcggtttgagagaaccaaccttggggcggtcaaggagatgaggcgggtggtgcgagcggtcaagcggcgcagaggtggtgacgctggcggtggtcggggaaagggaaaaagaaggggggaaagggggttggtcctttgccatattgaggagaggggaagcagctgcttctcccattcttggacgatgcggcgtggagtggcgggggccatggatgacgtcggcgatgacggcggcagttagtttgtcatggagcgggggcaaggcggcagcacgtggcgtcggcggcgcaagggctgatggcggcggcgttcggccggtcggccacctcgcgagcgagcgcgcgcgcgacgcgggggtgcggccggatttcgaacggcggcggcgggaaatcggcgccgaggagagggagatcgaacgagagagagagaaacagcgagagagaggaagagaacgagagagcgagagaactctctctcggctcggctcacgcgcatgcatcgcacgtgcgagaggagggaggaggacggcagagggaggaaatgggctggggaggggcgttcggcccatagaacttgggggaggcaaactagactttcacagagaaaactgatttggatagaattggagagatttagggtttggattcgaattcaaatttgatattcgaactcgagggtttagggatgtatcaagggaaactcaaggagaagtcatggaaaagattcaaaaggaatacttgggtatttgttctcgggaacatagggtggagtcaaggaaatgatttggatgaggatcgattctctcgaaatcgggagaaagatttggcaacgagttcaaggaagggagagattgacttcaagaattgggatttggatgagagggagtcgccaacgggattcaaaaaaggggatttgaatctaaatttgatacttgtacacaagggttcaaggagacgagtaaggaaacaaagtgggagtttgatactttcgggaatgggaacaattatttggagaggattcaagggaagggattgactttcggaatttgatttcggagactcgaatcggaagaggaattttcgaggtggaggattttgatttcaatgagagggaacaacaggattaaattgagatccttggcacaacttagactctcacacaaagaacgaaaattttcgcgaataggattttgccgaattagtttttaacgtcacgcaaaaagcggagcgttacatgcccgcgttccgcgtgggagccgctaggagtcgctcacctaggattcgcgagagcacgcacactgccacctccactggcgagtttaagtttgagagagagagagagagtcgtgggaggggaggagaaggtgaggagaggataaggacgaaaggactcggtcgatcgactcggctcaacagtttagggtgtcgttttatttaaaaaatcggcacctataaggttattatatgtgtcgatttttataaaagaaaaacggtacatgcgactgacaatatttgggtgtcagttttgtttttattaagaaccggcgttttgtagtagtgatatgtcatctcaccaactaaactctagatgaaaaagtagaaattctaaaacccattctatttctccacataagtatcttaggtacgtaattgctatctttttctagtagtatttatatagtcaaaaccaaccacatcagttaggacaaccaatcctattagaaatccctgacgcatttattctaactatttcctaatcttcttaattttgcactctctccaaattttgatttattagctaggtctctcaattctactggcgttccctcacacatttattccaattcattcatcaatcttctcaaatttagactacctctaaatttgacccctttcaatatacacatacaacatacatcatatcatacgtaaatctgaattttatatgcaccggtccttctcttaactatctgaacctcattcctttagggtttagtttcgatcttatcaccaaccatgctcctcagaccctcaagcaacattcaaagcaaatacatgaaactcgcactgtcttgtgcagtttgtttcaaaaagaaaaaaattcaaagaaaaaaaacatattcaaagcgaaaattcatagtcctttccacgccggtcaaaccaaagctgccatagcacctcgaaacaccaaactattgctattaacattttatctaattatctgttgcaatatagtcatcactgtgatttcacacttactaggtaggtggtctggtggaatgatgctgttatactgtcaccactcatcgatgcatgagtcaggcggtcaccatcacacacacttacattcgacgatcacaggatttgaggacatctcaacactcaacagtgtgatcgaacgcattcaacaggccgtccattaagcaatacagtacatatctcgtattctcattatgtggttgtttaaatccacgtagccatcacgcatgaagcttactggttaccctccatcagacaaacatatatattcgatctttctccggtcaagttctagcacaacaaaacacaagccaaaacaccatttaaccacctccaagcttcgcattccaagagaccgagcgactgttcagccagagattaatcagagaatggctggagaaggagatgatcaactgaagcttctcggattgtgggtgagcccatacactcaccgagtgaagcttgcactcagcttcaagggcctgagctacgagtacgtcgaggaggacctcagcaacaagagcgagctgcttctcagcaccaacccggtgcacaagaaggtgcccgtgctcatccacaacggcaagcccatctgcgagtcgcaggtcatcgtgcagtacctcgacgaggagttccccaactccggcgtctcgctcctcccatctgactcctacgatcgcgccattgctcgtttctgggctgcctacatcaacgacaaggtaatcgtcaaattgcctcggttaatcgatctgaatttgcatcgattgatgtgatgttgtgtgcgtgtgctcgcgtgtgtcgtcgttgcagctgatgccgtcgtggctgcagtcgtcgatgggcaagacggaggaggagagggcggaggcgctgaagcagacgttggaggcggtggcgaacctggagacggcgttcaaggagtgttccaaggggaagcccttcttcggcggcgacaccgtcgggtacctggacgtgtcgctcggcgccatgatcggatggatgcgcgccggcgaggctctgcacgggaggaggaccttcgatgccactagaagccctctcctgaacgcgtggatggagcgcttcgccgcgctggacgccgccaaggccgccatgccggacaacaacaagctggtcgagttcgtcagggtgaggcgggctgccgctgcgaacaactgaagccgaaacaatactgtattggtcagttcccagttggtacgagatttgctctgctccaacaaagagtatcttaaggtattgatacctcacggtaccaaatcgtttctaaccgttgaatctaacaatgtccatcgatgggaaacgatttagtactgtaaggtaccggtacctcaattactttttgctgaaccgaaacaaatctcatcgtcactgctttgggcctttggccaattgtcatttttcaagttgcaaaagtgtgatgttcttccgggtcatccgttcgatcggatctccttgttaccgggacatcatttcttccaataaaggaaaatgttgaattttggtatttaaattgtttagtagtatgtgatataaaaactgaattttctatttcaattgcgtgcctagacgtcagattgttcaaccagatgcatatgctccagatgaatacatgttatttaaatagttgcataagaaattgaacaaatatattacaatgatatagatcattatatacggacacataattagctaggttttctctggagtgattttacatttcttgaggaggtaacgggatatacaatattttctaatataaaatttattatctcttagtacctccagtaaggaatggaaatttgcacagtactacctctcaaggaccgtaaaatttctcttttctctaagtgcatatcaaatttagcgtatatgactcgtgtcatcataatttatcctataaaaatctttgatttttctatcaacatttaatctgcatggaaataattaatgtatatatgcattactacctctccttcgtaacttcaggaatggatggtatgtatgtctcaatctttattggcccctgtattttagttggtgatgagagtgtatgatggcaaactcatcgtcaccaacaccaactgcctcttttaaataaaaaaattgatgtagcagagacttttttttctcattatcatatattgtatatgatgtttggacaaatgattttaagcctgcaatggcgaactatatcatttctcacatgccgtttaaatagttataataaaattgaaacaaaataggcaacatacggattgtaaaatgcagatgttattctgaaaaagaaaacataaggggggcaataaagagtgatgctaagtgttcttttgaatggtagtgtgcagttgttattttttcaacatgtatatgtttttgtacaatggagttgcacatgtttcatggaaattaaatgtgcatatttggaaatgtatgttttaatgggaatgtgtttacaatattatttgaatttttttcatggaaatgaccagatgtatttcattgaaaatgcaaaaaaaaaaatcaatacaacattgttgccacaatcaaatgttccatgcaacattgtttttgtgggtgaaaaatgggcaatgtacatatgtttttcgtttgaatgaaaatgtgcacatatgtgtcttctttgtatgaaaatgcttaaaatggtagcatttcaaataattaatcagatcaaacattagtgtcaccacgcctttttttttcagttgtaagtatgcaccatcctcttgctaggtgtggtggaatgattaggtcatgtaggtagggtccagtagggggctctcatgtattccacatcagaaaaaaaaaacccacccctacaatggttagttgactttacattaatacatactagttaaattgtcacaccccaatctgataccgccgtacaacggcacctgacaggagcgtgtcgtagggaaaacggcgcaaaccgcttcctacgaaaccgcgatctcagtaccagtcccaggacatagtgctggtacccacggtgacaaatatgaatcatagcaatccttaaaataaatggaggacttatttaccttaacttaggttgcagctcagacagcccgagaatacaaccgacgacgcggacgaggaaacaccaacagcagcagcggaaccaacggtctaacacccaacaccacaggcgacgg

SEQ ID NO: 44149 - DNA, 8325 bp, Oryza sativa
  unsure (1)..(8325): unsure at all n locations
ggatagaatgggagagattagggtttggattcgaattcaaatttgatattcaaactcgagggtttagggatgtatcaggggaaactcaaggagaagtcatggaaaagattcaaaagaaatacttgggtatttgttctcgggaacatagggtggagtcaaggaaaggattcgaggcgggatttgaaaaattctggattcgtagaagtatttggcgaggattcaaaggaaggatttgaatttcagaatttgatttcggagactcgaattgtaaggggaatttggatgagggggaggattttgatttcgatgagagggaacaacgggattaaattgggatccttggcacaacttagactctcacgcaaagaacgaaaattttcgcaattaggattttgccgagttagtttttaacgactcacgaaaagcggagcgttacagatccacccccccttacaagaatctcgaccccgagattcgaaggtggaccacacacacgaaaccaaaaagggatcttcagacttcttcacaacttcagactctgctagtctttctttatctcgagaatgcatacttgccacaaaacggtctggtactctgactcacttagcattcttcatcttattgtggctctgctcttgcctgtggaacctgttcttctcctgctctttcaacctgctcgagattcacaacttttccatttgtttctacttgcacatggttcagacgaccttgtccaacgggcggtgaggtcaacgaggcagaaccactgtttggtggctttgaactttttggtccagatacgttgggaaggcttgttgtttgttgaacttgttttgacttgactttctgagggcacttcatcttggctttctgagggcaatcccacgaatagtgtcccatctcatggcaggtgaaacattcgactcctgccttatgaccacgtctttttgaaggtgtagggcatggtacggagttgcttccttcatggctattactgttgatcattgtggcttgctgaccaggttctgacatagtcgaaagagacgtagaaccggaaccatttgaatgctgagatgctttctgatagtattgtgttggcgagtttgtttttcgacacaaaccttcttttgcttggatccctagggacattactttgcgtctcttgtattcttgcatctttttcttttcttggatgtcttggcacatgtcacaggatgcttttgctcttttgtcatcagggaaggttggacgtactgcattaacattttgcaaattcgggcttccttggggatagaagggcatccttgaggtgctcatattagcttgtagtagtgcatccatatagggtttttgggggcagtgtctcatgtaatggccaatttcgtggcaaatgaagcatatgagtccgggaacgtgtctgatcttctttgatttgagggtgggggacttgggtaagttttggcaagattgcattgtctgacattgtgggacatcttgcatgtcaacttttgatggcaaggtctttcttttgtgacaacttccttctttaaccatgctattttcttgcgatacggatttattgattgagttctgaaggttggggcaattattagctcgaagtggggttttcatccctataatcatcacatttaagaattctttgttcttctctttatgggtatcagtgccttctactgattgtgttccttgtatttctgcggcctcatccttactcttgtctggattcaccttgggctgtggtagtagcagttgttgttgtatagaagccaaattttgagctatttcttgtagtatctaagtctgattggctagaatctgataaatatccattgagaagtgttgatttctagttgcaacttccttgtttggtccaggaacagtattatcagtcttggcaacttggttggtgacttgttcagctagttgatttggattttctgacaaagctaggtcttccttagaaccaaggtagttgcggacacaagtctgacaggttggttgaggcgccatctgcttcagagggactgagaactgaccaacacagaaaatagataagaaaagaaggaaaacaaaaacactacatcaaaacggttttcgaaatcacagaagacataggtggtgtgttccagccggtaacccaactggtctaacacctgaacacggactaccaaacaaaactcacacacgcactagttcaccacaactcctaccgagcgggtgacggttctaaggttagcctaccaacaagggcttaactaagactcctagaggcttgagcacacctttcttcaactgggcgtgaagacaggtttactctaggataaaagtcaaaacgaacgactagcttctacttttggacacaaaagatttttcgcaaaactagagctaaaggggacaacgacaccttagctttcacaaatatttttgtactcaaataatgtcttcctattaaggggtttcgatcctagggccaacctatgatctgataccatctctgtcacaccccaatctgataccgccgtacaacggcacctgacaggagcgtgtcgtagggaaaacggcgcgaaccacttcctacgaaactgcgatctcagtaccaatcccaggacatagtgctggcacccacggtgacaaatatgaatcatagcaatccttaaaataaatggaggacttatttaccttaacataggttgcagcttagacagcccgagaatacaaccgacgacgcggacgaggaaacaccaacagcagcagcagcagcggaaccaacggtctaacacccaacaccacaggcgacggctgggaaccaggacgaaacccaaatcttcacttcactttatcttcccttcagggtggaggaactatatatatatatttatatagagcaagggtgagtactttcgtactcagcaagtcacgggaacttaggtgtttaatgcaagcttggaagagaggcaaggttgttttgcaaatcttttgtttgaaatcattttgaaatcactaagtgatttatttctttctaagtttgggccgaaaagagacttgcgtctcgatttgactttaagagatgtttttcaacagctcatttggtaatgtaccgacctcccgggtcagatcattacttctcggctcccagagccattccacttgattaatcggctcccagagcctttttcaatttctcggactcccagagtccagctgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggatatctcatgccacatagaaggatcaaaacctcacataaacataggccattttaggcattcacaaatcaaactccaaccaccttgatcggtaagtgagcaagcttctcgtccttgccttaccaggaacccagtttgtccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgtatcgcgagttttcacaattcattttattttcaaacacatcgacaccacatgtctagttttgaagacttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgtaaacaaaataataatgacttttcaattataggggcaattgatcaaagggtaacttgccttgctcaaggtcttcacgaagcttcacgaatcttcgagaaaacccgcgatcgacgaaaatccgataaccacaactatacgcaaacaatcgaaaacctaaacaaaagaccaaaagaaagatcctatttagactaattagtagtgccattaaatagatctcaatttacggaattattggaagtggaacggagtcaatcggagttgcgaattgggtgatatgaattttgaaagtttaattggagtttctggaataggagagatgatttatggaatttatagaaataatattctcaagaatattattgacagtcattgaatccgggaccaaggaaaatgattcatggaattttggaataaggaattgatttatggaacaagggtggaaaaggaaatcaaggagggatgtatactagacttgtttcggtggcattggtgcggcccaaaggctaacgcggctcggccgaaccaaatgggccggcgcgggcgcgaggaggcggcccatgagggcgcgcggggagagagggaggcccgtcggggtgggcgcggtccaccgcgcgggacccacatggcggtggttgggttcacggtggggagggtgcacgcggaggcgggcgctagggtttcggatgcgcgcggttcgggcgcggcgcgccgggtggacggatggcggcgggcccacgtgcagccgcacggcttgccgtggaccgcgcgcacgggagggaagacggagggaggaggcttactgggcgcgacttgacccagtcaagcgggcccagggctgaggtggctgccacgtggtcggccacgcgggcaggggcgaaaggggaggaggaggaggaggaggaggcgcccgggatcggacggccgacgacgcgcgaggcgttccggcgagcggcggcgaaccggagcgagcggccaccgccggcagctagaggaggtcagggggaatctgtttaacggcacggatttgagaggggaggtacgacggtggctagcggcggcgaccaagctcgccggcacgccgacgtggccgcgcgcgagaagagctaagggtgcgcgggctcgggcttagccgaaccggtatggtgttgcgacgcgcacgcggtgacgcgggacctgatggtcaccggcggcgcacgcacggcggcgttaggcggcggcggaagcggcgacacggcgcggagacaaaggagaaggccgacggccttggggcagccagggggaggtcatggggatccccgggagcgtggcggcgagaggaatcgacgcgagaggagccgacgacggtggattgcggcggcggcaatcaccggagatcaaaaggggaaaacacgacgagacgacgagggttcgattcaaaggggtgggagcatctccggggttcaaggaatccgtttccggcgtcggattggacggagcggcactgagattggctggcgacgagaggcggcctccgggacagagcaagagcgcgtggcgagctatggcgagcggcggcgggcgcggcgcatcgcgcggcaggaggaggattatggtggggagctcaccaatcgaagaggaggcagcgttggcggcgcggtcggtgtcacggcgaggtgttcgcgacgccgaggcggcacggcaccgagagggcgcagccggggaagaagggagggagaggtggtgcccggagctcctcgtcacgcgtctacgcacgcaccggctcctccggtgcttcggcaacggcgagagcgggacgagcagcaacaaggcggcgacggtggttcggcggcaatggcgcggtgggtgtgaggactgaggcgagtgaaaacgagagaggaaggggtttggggtggtttggttttatagcggaggcgaggtcggtttggggaggggagaactgaccttggcggtcaagtgctcggctggcggtagcggcggtttcgtgggcggtgcgaaagcggcgacggcgtggatgcgttgagtggcgaaggcggtggatcgagcggcggaaatcgaaccgctggagcgcgggctggcgcggtcggtcaagcggcgcagaggtggtgacgccggcagtggtcgggaaagggaaaaagaaggggaaaaaggggcttggtcccttgccataatgaggggagggagagtgaggaggaggaggagagggagagtagctgcttctcccactcttggacgggtgcggcgtggagcggcgggggggccatggatgacgtcgacgatgacggcggcggtcagtttggcatggagcgggggcaaggcggcagcgcatggcgttggcggcgaccggccggtcggccacctcgcgaggcgcgcgcgggaatgggcgaaggcggtgggggttttgggcggcgacggcgggaaatcggcgccgaggagagggagatcgagcgagagagagagagagaaacatagagagagagagaggaggaagacgagagagcgagagaaacagagagagcgagcgacggctctctctcggctcgcatgcgtgcaacgcacgagcgaggggggggagatgatgggctgggaggggagatgggccgggggaggagaatcggtccatccaaaaaaaactcagggaggtaaagtagacttttacagagaaaactgatttggatagaattggagatttagggtttggattcgaattcaaatttgatattcaaactcgagggtttagggatgtatcaggggaaactcaaggagaagtcatggaaaagattcaaaaggaatacttgggtatttgttctcgggaacatagggtggagtcaaggaaaggattcgaggcgggatttgaaaaattctggattcgtagaagtatttggcgaggattcaaaggaaggatttgaatttcagaatttgatttcagagactcgaattgtaaggggaatttggatgagggggaggattttgatttcgatgagagggaacaacgggattaaattgggatccttggcacaacttagactctcacacaaagaacgaaaattttcgcaattaggattttgccgagttagtttttaacgactcacgaaaagcggagcgttacataaatcgtgaatttgcatatttgatctgaagttgcgtttcttcggattgtatagcgcccgtctctcctctcgtctccttgttcttttcgctagatgagccgatgtcgcgccgttgtcacctgaagcatcgatgtttccctgctctcatttatctttcttccatgtaagcaaatttgtctaggtgacaccagagagagacggtaaataatagtaaataatagcctttgtacattcccttatgtagttgtgcagtctatttttggtgtgcgagttcggagttcgaagtgttctgaagaatctcttcttgtaatttctagaaatggcattgaggaaattaccagtcttggcttaaaaacaagtctgtctcgtcattcaccgtgcttatttaggacttgttcaactcctgtagaaattctcgaaaattcctcgactttaaatggagccttaccattttttagcagatgcaacaactattatactcctacctgatgactgatgaggactgtgcagcgatcgatatgtgcatgtggccatgtccgaagctaattaaaggacggaaggaccacaagttggtgtataataatggagagggcattgaatcattgtttcaatatccccatcagataatattcaataactcctatggtgacgtcaagcatcaatacatgaaggttacttgttaccaccatcagacaagcatataattgattgctctgatcaagcgatagcaaaacaaaatacaaaccagaacagtctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44150 - DNA, 12732 bp, Oryza sativa
ccctcccccccccccccccgcgcgcatggtccgcggtgagccatgaggctgcgcgtgggcctgccgcatctgcgtccttcacgaaccacgcgcatgcgccacgcctcccctccccaaaccctagcacgccccgcgtgcacctcgctcacggtgaaccgagtcgctgacaagcgggtcccacccgggaccacgcgggatggacccggcccatcggttctctctctctctcctccccgcccgcgcgcgcgctttggaccgccttcttgggccggccgtcccattaagctcagccgagccgcgcctttttctctcgggacgcgccctagccgcccgagggaagtctatttctcctccctctttctttttctttttcaaaagggtttaattaaatccttttcctttagatcaaaaatccaataatcttagaaattcaatatcttctcaaccgtatgaccgtttgactccgttcaacttccaaaattcctcaaatctcgagatatatctaatggcacgcttagaggtcaataatagggctttattttcgccgtttgttgagttgtcccgtttcgcgtgtagtttcggagcccgaagacccgcagtgcgagaatttcgaggatcaagcccaagatctcgagcaaggcaagtcacctttgatcatcttgcacctataatttaaatctaagtatttcttttctgtaaatattgcatgaataggattaacacgagtatttcagccgtggcttgcgagatagccaccggccccaatcctaattgctgcaattaccctccttcaattattgaacacttaaacctcctttgtcaattgttgtgcttcgatgcacgggcctccaggtacgcgcatcggaacaccttccctcaaatttaaaatatccaatgatgggtaaaacttggggctttacaaaagacttgaaaaacccgacacttgggtcggtgcttgcgaactaaatgaatttccaaaaccgcagaccggggaacgtaccgagagtacggtttcccgctcttgcacttaaggaccgttttccttggaatttcatctgaacataagacaagtgtgaccacatgggtgaaatgggacacccctgtctgagtaattagctaatcggggaaaccatgatgccaagagacatgtggagtcaacagggtggtgtcggggagaacccccgggcttcctggcacagtatggtctgggacctaacctgttgttggtctgggacccctcttgttggcatatggtaaacctgtgttggctttcgaaatgccttgtcatgaaagcctcaaggtctccagacgtggccgttctgcacgggctgggttatccgggttagtaatgtcgtgtgggtaaagtgtaccccctctgcagaggttattaaactgttcgaacagccgtacccacggtcatgggcggatgtgaggtgattcctagcgtagttttgtttgactactgctttgtgaaattgctgttgtggaatgggatcgatgtttggaaaatctgcggctgatgggatcagccaggcccgggtggccgtttgaaagctgttggccgggtgccaaccttgaatcaattcaaagactgatatattgcacatactccgaccagacgagacgcactgtctcatccgtgtcgtttgagaagcactcacttagctaattcgaaaaggagtttaaataaaatcaattgcaaaaacaacagcctttcccttgaagcctgcattaaacacctaattcccatggcttgctgagtactcctgtactcacccttgctctatataaataatcccccccagttgctgaagaagatgaagtggatcctgctgatgaggagttcttccaggagcaagtcggctacgatgagttttagggtttcggcctagttcccaagtcacgcctatgatgattggtccaagtcttggcttccgctttccccttttgtaatgcagttgtgagctcgggatctgtccgcagcccaacatgactgtactcctactctgtaataaagagacctctgttgctatgatattctgtcttcctgtgataccagcattgtttcctgggactggtatcgatgaacaggttaatttggagcgtcacgggctagttccgttcggggctagttcgggacgtgacaaaagatggtatcagagcacaggcttggccctagggcgaaacccgacgtttaggacgaccctaaggatactaagttctacttgcgaaaagctaaggcttccttttttgctttctttattttcaatagtttattgctaaaatggttacttatctttcctctccctttcaaaattgtagatggcagtgaacgccagcttcagttcccacggttttggtgagggtcaccacgtcgctcagcttcgtgacctcgcccgcttccttggcttctcgtgtcctgagtacacggggtactctgtggaccgtgttccctctcgttatgagctttcggtgtacctttaccctcgtggaggtatacacggggctggccttcgcccacaccacttcactgtggccaggcccactctccagatcgcgtaccaggacctctcctagactgcacttcgtcgcttggcccacgactacagccaccgcctcgggggctctgcctttcggcagctcctgcgccttccttctggccgcactgacactaggtacccttgcccgtacagcgagtctcagcctgtgctgactcgcatggttgagctctctgaggctcaggccacccagcacgaccttctccttgaggcttaccgctcccttgctcgccgctacgctgctttggaggcccgcctggccgaggagggtgtcacctcagttgacactgcctcttgggacttaggtcgcctctgccacgccagccacctgtcttcccacagctcccgcggctctgttcgcactcccagtggcccgcgcacccccagttcgcgtgtgccgtactccccagtgcactctccctaccctcacccagttagcccttcctacactcctggtcacaccccagttgcttcctcctgccgtggcccacgctttatccgcactgtgcggaagcgtgttgttggttcttccactgtgttccgctttgaccacccagctcgcccaccgccagcagcccgtgctgctgccggccctcgacaagttccgccgatctcttcgcgtcagccgatcgacgtctcttcgactgaggagccgactacaggaggtagccaggcaggagaggagtagaggaggcagtcttcaggagccgtccgtatgataggcccttttgttccgctgccaactcttttggagtcgtggcgaggtagtgcgtgcgtgtgtttgatgcgggtgttgtttggtagtcaggttctcctaggtggtgtgcgtacagtcaagctcggcgtagctctgtgacttgtccacacccgttgtatcaggtgtctttatgatttgagaaacccagtttatgcctagtgtgtgctatctgagttattatttaccttgcttcttgtcttcctaagtgcttatccgattcttaccttgccctcttccgagagtttagatggctagccgtccccgccgtgctgctcgtgcaccagcccatttcggttttgaggaaggtagagttgagccagaagcaaatcatgagtcagctaatgagcagtctcaccacagcaaccgttcgcaccatactgcttcccgcaatgcagaagttgagcaaccccaccgcagcaaccgctcgcaccgcacagtttcccgtaatgcagaagtggaacagtctcaccgctctccccgcgctgccattcacaattctagggaagaacgcattccttccccaccccatgttgagaacaacatgcagcacttgatggcagttcagactcaaatcttgcaaggtttagccacagccatagccggtattcagcacaacgcgcatggaaatggccatccccacacgggcaacaacagatctaagctgacagactttctaaggtctcgtccgccagagttctcccagaccgtcgagcccgttgaggctgacgattggctgaaagatgttgagagaaaactcaacttagtgcagtgtactcctgttgagaagacgctctacgcctctcaccagctaagaggacctgctgcagattggtgggagaattattgcaacgcacaccccgaacccactaacattccatgggatgaattcgctgcagctttccgtgcagctcatgtgcctgaaagcactattgacatgaagaaggaagaatttaacaggctcaagcaaggcaataccagtgtcaatgagtatatgagtcagttcaacaagttggctcgatacgctcctgaggaagtggacacagacaagaagaagatcaggaagttcttgaaaggagtcacagttggaatgagactctagttgcttgctcatgacttccccactttttagcacatgatcaacaagagacttctacttgaggatgccagaaaagaggctaccgaggagtataagaaacgcaagtctacccatcagggaaattcttcccgaggggaacctcgccctcgctttggacaacccatgcaatatcaccagtcagtcactcaggctaaccgccagccaagctatgcccctcgtcctcagatgaatcgtctggcacctcagccgcagcagcgtgccccaagtggcaataccgcgccaaacagtgttacctctttcaagtcaccgccaggactatcagcagttcagtgtttccggtgcaaccagatgggtcactatgccagacagtgccctcagaatcttaccaactccaactcagggcataccaatggcagcaccgccagaactcctactcctgcagcagctcagtcccgtcctagcacgcaggcaagtggacaaggttcccgtgcttccaacaactttggtcgagaccgagtgaaccacattcaagccgagaccgctcaggacgctccagacgttgttatgggtatgttctctgtcaactccgcacccgcaatagttctgtttgattcaggagcatcccattctttcatatcgcaagcttttgtgaaaagaaatggttggaaaacccaaaatttgcgagtaccaatgatagtacattcccctggaagggatataagggcaactaaaatatgctcggaagttaaccttagaattgaggaagttgacttcctagccaaaccgatagtcctagactcgcaaagcttggacatcattcttgggatggattggttggctaagcacaaaggacagatagattgtgccgaaaggtccatcaccttgcaaggacctggaggaaagcaagttcgctttacccccaacactcttactgcaagtcggtctatcctaaccagtttgcaagccacttctttggaatcggtacccatagtctgtgaatatcccgacgtatttccaaaagaattaacggaaatgccaccaaaccgagagattgagttcgccatagaactggcactaggcaccgcaccaattgcaaaaagtccctaccgaatggcagctaatgaattagcagaagtcaaaaagcagatcgaagaattggagagtaaaggttatgtgcgacctagctcatccccttggggagccccagtgcttctggttaagaaaaaggatggctctgagagaatggtaattgactatagagccctgaatgaagtaactaaaaagaacaagtacccgttgccacggattgacgatctgttcgatcaactttaaggagcaaaagttttctctaaaattgacctaagatcagtttaccaccagttgaaaatcagatatgaagatatcccgaagaccgctttctcaacgcgctatgggctgtatgagttcacagtgatgtccttcggactcaccaatgctccagcattcttcatgaacctgatgaacaaaatcttcatggagtacctggaccagtttgttgtggtattcatcgatgacatcctgatatactccaagaatgaggaagaacatgttgaacacctgaggctgataatggagaagctaagagatcatcaattgttcgctaagttctcaaaatgcgaattctggctggaccgagtagcattccttggtcacgtgatctcctctaacggtgtcgaagtagatcccagcaaggttgaagctgtccttgcttggtatcctcccaagaatgagtcagagatccgcagtttccttggcctagctggttactatcgaagattcatcgaagggttctctaagctagccagacctatgaccgagctgttaaagaaggaaaagaagtttgaatggtcagcagcctgtgaagacagctttcaagaaatgaagaaaagattgaccactgccccagttctcaccttgccagatatccgaaaagatttcgaaatcttctgtgatgcatcaagacaaggcttaggatgtgtcctaatgcaagagcgaaaggttgtggcctacgcatccaggcagcttaggcctcacgaagtcaactatcccacccatgatctcgagttggcagccgtggttcatgctcttaagatctggaggcactatttaatcgggaacagatgtgaagtatacaccgatcacaaaagtcttaagtacatcttcactcagaccgagttaaatatgaggcagagaagatggttggaactaatcaaggattacgatcttggaattcattaccatcccggtaaagctaatgtggtcgctgatacgctaagtcgcaagacctattgcaatgcagctcaaatatggccagaccaagatcgcctgtgcagagaattggagaagttaaggctgaccgtggtgcagtcaggtgtccctgccagcttgacagtgcagcctaccctagaatcgcaaatccgggaagctcagaaagatgatgaagggataaaagagctaataaaaagaatacagaagatgaaggacaccgatttctccatagacgatcaaggcacagtttggtgcggtccacgcatctgtgtaccggccaagaaggagttaagagacctcattttaaaagaagctcatgagtccgcctactccatctatccaggaagtacgaagatgtaccaggatatcaaggcatatttctggtgggttggaatgaagcgagatgtcgcagaatacgtagccctttgtgacatttgccagagagtcaaggcagagcatcagaggccagctggtctgctgcaacccctaccgattcccgagtggaaatgggaagagatcggaatggatttcataaccggtttgccaagaacccctagcgggtacgactccatctgggtaatcgtggatcgactcacgaaatcggcacatttcgtgccagcgaaaaccacctttgatggaaagaaactggcagaactctacatgacccatgtcgtgtgtcgatttggttgtcccaagaagattgtgtcggatcgaggcactcagttcacctcaaggttctggaagcagttgcatgaagctctcggaaccgatctaaattttagtacagcttaccatccgtagaccgatggtcagacagaaagagtaaatcagatcctagaagacatgctttgtgcgtgtgccctggatttcgaaggcacttgggatcgttgtttgctgtatgctgagttctcatacaacaacagttatcaggccagcattcagatgtcgccgaatgaggcaatgttcggaagaaagtgccgcactcccttgtgctggaataaggttggcgaagcactggtgttcggtcctgacatactcaaggcagcagaagaacaagttaagctgatccgacaatgtttaaagacaactcagaaccgtcagaagaattacgctgacaatcggaggcgtgaccttgagtttgaaaaaggagatcttgtgtacttgcgggtatcacctctccgtggaatgaggaggtttgggatgtccggcaagttagcaccccgctacatcggcccctacctcataaccgccagacgtggtgtcacgccccgaactagccccgagcggaactagcccgtgacgctccaaattaacctgttaatcgataccagtcccaggaaatagtgctggtatcacaggaagacagaatatcacagcaacagaggtctctttattatagagtaggggtacagtcatgttgggctgcggacagatcccgagctcacaactgcattacaaaagggaagcggaagccaagacttggaccaaatatcacaggcgcgacttgggaactaggccgaaaccctaaaactcatcgtagccggcttgctcctggaagaactcctcgtcagcgggatccgcttcatcttcttcagcaactgggagggggattatttatatagagcaatggtgagtacgggagtactcagcaagccatgggaaataagtgtttaatgcaggcttcaaggaaaggctgttgtttttgcaattgattttatttaaactcttttctgaaacaactaagtgagtgcttctcaaacgacacggatgagacagtgcatctcgtccggtcggagtatgtgcaaggtatcagtcttttgaattggtcaaggttggcacccggccaacggcttttaaacggccacccgggcctggctgatcccatcagccgcaggttttccaaacatcgaacccaaaccacatcagcaaatttcacaaaacagtagtcaaacaaaactacgctaggaatcacctcacatccgcccatgaccgtgggcacggctgttcgaacagtttaataacctctgcagagggggtacactttacccacacgacattactaacccggatcatccagcccgtgcagaatggccacgactagagaccttaaggctttcatgacaaggcatttcgaaagccgacacaggttcaccatatgccaacgagaggggtcccagaccaacaccagattaggtcccagaccatactgtgccaggaaacccgggggttctccccgacaccaccccgttgaatccacatgtctcttggcatcatggctccccccgtttagctagttactcagccaggggtgtcccattccacccatgtggtcgcacttgtcttatgttcggatgaaattccaaggaaacggtccttaagtgcaagagcgggaaaccgtacacccggtacgttccccggtccgtgattttggaaattcatttagttcgtaagcaccgacccaggtgtcgggttttccaagtcttttgtaaaacccaagttttacccaaggtgtttctcagtttttaagtttgaaggcgaccgtcgatactcgtgcagagtgcacgattactgaggcgcaactaggtggttacaagggaacatgatataacgattaacaaaggaaggatcagatgcaataagctaggtaggcccatcggtctgccttgcagacggggcaatcctatcaatgcataatattttgcaagcaatataattaagttcaaatataggctcaatatgttcaaaggtggcttgccttgctcgagatcttgagcttgatcctcgaaatccacgcactgcgggtcttcgggctccgaaactacacgtgaaacgggacaactcaacaaacggcgaaaataaagccctattattaacctctaagcgtaccattagatagatctcgagatttgaggaattttggaagttgaacggagtcaaacggtcatacggttgagaagatattgaatttctaagattattggatttttgatctaaaggaaaaggatttaattaaacccttttggaaaagaaaaagaaagagggaggggaaatagacttccctcgggcggctagggcgcggcccgagagaaaaaggcgcggctcggccgagcttaatgggccagccggcccgagaaggcggcccaaggcacgcgcgagaggggaggagagagggagccgatgggccgggtccttctcgcgtggtcccaagtgggacccgcttgtcggtggctcggctcaccgtgcggagggagcacgcggcgcgcgctagggtttggggagagagacgcggtgcacgcgcgcggttcgtggaggacgcggatgcggcgggcccacgcgcagcctcatggctcgcggtggactgcgcccgcgagcggggccggagggagcggctggccgggtcagctcgacccggtcttagccgagctggcgccgacgtggcgcctacgtggctgccacgtgggccggcgggaggtcgaagaagacgccggccggaacggacgacggacggtggctgcgaacggcggggcgaaccacggcgatacaggcgaaagagagcacaccagaaggttgcacgggttgaggggagacgagccaatggctcggattcgccggaggatgctcgacggcggcggattgcggcggcggcaaccggcggtgagagaagggggaaacggcgacgacgcgacgggagaccgattcgggcgagctagagcatctacgcggcttcgggagtctgttgctagcgtcggattgggcggagctacgccgagtgaggctggcgacgagcgggtgctacggagcacgggcggcgacggcggcgagcacacagcgagcggcggcaacggtcggggcggcaccagctagctacggggaggctagtcatgctactacccgaatctaaggggaggagatggaacgaggaggaagaacggagggaggcactaccgtgcgggggtgatggggtgcactgacgagaggccgacggcacgggagtgatctctctggcctcgggccggggaagaggaggaagacgagcgcccggagtccccttccgcgtcctagcgcgcacaggctcctccggcacacgcgacggcggtggtcggcgagagggacggcaatggcgtgggtgaaaaatgggggagattgggaggagaaaaaggaagggagggcgcctgggtttataaggcggcaatgtcggtttggaaaccgaccttgggcggtcaagggagcgagccagcgctcggcggtcgcggcccaaacggcgacagggggaggggaggatgacgccggcgggagaaaaaagggaaaaagagggagagaaagggggcttgcccccttgccactttggggaaaaggaggagggagagagggcgatgcggcagagggggagggagctctgcctccgtcccttggaagcacgcgcgaggaggggcggggccaagtcaatgacgacggcgatgacggccgggcggtttggagcggagcgacgacacgggtggcaggcgcggcaggcgctgacggtggcggcgactggccggtcggccaccatcaaacacacgcacgcactacgtcgccatgactccaaaagagttggcggcggaacaaaagggcctaacacacggacggctgctgaagactgcctcctctactcctcgtctgcctggctgcctcctgtagtcggctcctcagtcgaagaaacgtcgatcggctgacgcgaagggaccagcggaacttgtcgagagccggcagcagcacgggccgctggcggtgggggagttgggtagtcgaagcggaacacggtggaagaaccaacaacacgcttccgcgcagtgcggataaagcgtgggccacggcgggaggaagcaacgggagtgtgtccgggggtgtaggaggggctaactgggtgtgggtacggggagtacactggtgagtacggcgctcgcgagctgggggagcgcgggccactaggagtgcgggcagagccgcgagagctgtgggaggacaggcggctggcgtggcagaggcggcctaagtcccaagagacagtgtcaactgaggtgacaccctcctcggccagacgggcctccagagcggcgtagcggcgggcaagggagcgggaagcctcgaggagtaggtcgtgctgactggcctgagcctccgaaagctcaaccatgcgagtcagcactggctaagactcgctgtacggacaagggtacctggcgtctgcgtggccggaaggaaggtgtggaagctgccggaaggcagagcccccgagacggtggctgtagtcgtgggccaagcgacgaagcgcagtccaggagaggtcctggtacgcgatgtcacgtcccaaaacgactctagaatacatcctttaaactatgcctagaacaattaaaatccgtgtgaaagcctccaacaattaaaatgtgcaaagttaaaagtcaaataaggcttagaggatttttgtatatttcctaaaagcctaaaatgtgtaaataaattttagtggaattttcagagcacaaatagtaattattaagaaataaacaaagttgaaaatgttttataaaaagaaaaaccctaaaaatcccccttccctctcttgggccgaatccggcccatctccctccccctctctcctctcccccgcggcccatccggcctccccccgcgcgcgcgccgctgacgggcgggcccgcctgccaccctcgctgacgggtggggcccacccgtcatccccttcctccagccgatcccgccgctccgcccgcgccaagcgccgccgccgccgccgaatccgccgcatcccgtcctccccgcgtgcaatcaatagggggaattattccccgtgattccctctccctttccccccaattttccctccctctctcccttggattcgtttggaaaccctcccctaatcccgccggcgccattgatggagcctgagagcgccgcgtcggtttccttcccctccggccgccctctcccccttccaaccctatataaaccct

SEQ ID NO: 44151 - DNA, 12221 bp, Oryza sativa
gtgattcctagcgtagttttgtttgactactgttttgtgaaatttgctgatgtggtttgggttcgatgtttggaaaacctgcggctgatgggatcagccaggcccgggtggccgtttaaaagccgttggccgggtgccaaccttgaccaattcaaaagactgataccttgcacatactccgaccggacgagatgcactgtctcatccgtgtcgtttgagaagcactcacttagttgtttcagaaaagagtttaaataaaatcaattgcaaaaacaacagcctttccttgaagcctgcattaaacacttatttcccatggcttgctgagtactcccgtactcaccattgctctatataaataatccccctcccagttgctgaagaagatgaagcggatcccgctgacgaggagttcttccaggagcaagtcggctacgatgagttttagggtttcggcctagttcccaagtcgcgcctatgatgtttggtccaagtcttggctttcgcttcccttttgtaatgcagttgtgagctcgggatctgtccgcagcccaacatgattgtacccctactctataataaagagacctctgttgctgtgatattctgtcttcctgtgataccagcactgtttcctgggactgatatcgatgaacaggttaatttggagcatcacgggctagttccgctcggggctagttcggggcgtgacaagagatggtatcagagcacaggcttggccctagggcgaaactctacgtttaggacgacccaaaggatactaagttcaaaactacttgcgaaaagctaaggcccttttttcttttggattctttattttcaatagtttgttgctaaaatggttactgatcttttctccctgtttcaaaattgtagatggcagtgaacgccagcttcagttcccatggttttggtgagggtcaccacgtcgctcagcttcgtgacctcgcccgcttccttggcttctcgtgtcccgagtacacggggtactccgtggaccgcgttcccactcgctgtgagctctctgtgtacctttaccctcgtggaggtatacacggagctggtcttcgcccacaccacttcactgtggccaggcccattctccagatcgcgtgtcacgaccggaaataacccaacgggcgttccttacgtgcgtgtattattccttgtcctaggaggcaaggtacaccaaaagttgatacatttcagagtttatcaagcggaagcgtaaatagttactttattacatgggcggcgaaggcccagcacacacaaagacaaacgggaaacagcggaagactagggcgacgaccacaggcgcatgacggcaggcacgagctagatgccttcatcttccaggaagtcctcttctgggtttgggaaaaattgagcaagactgagtacaaccaccgtactcaacaagacacacccatatgtgcagaataaatgcaagggagtacaagggggttataatataaagggttagggtttgcagtaaacagcactaaaagacacttagttgctcaaagctattttgtaaacacggtcctagagctatacaatattattaaacaaggccgtgaacccacacgaacctgccttaacccaaggcctacgatgattcagaccgaactggcaaccagaccctgggtcccaactcgtcccaagccaacccaggccaaccattccacattttagttattaagcaggttttaagaattaaaaacactaacttgggtacattgctcgacttgcccataaccgagggcgcggctattcgaatagattatactctgatcagaggtgtacatctttacccacaagacacatcttcctcacgtgtaaccacgtgccacataccaccacggtatacggacggaagacatgacatagttttcaacccatcctagccataaacaagagtaccgacccaaccccatctacggccggaacccccgggacaggtaggcaggactgagcccctagcagctggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggaagtacggtagtgctactgtcaaaaccatgcaccccgaacccagcctaaaaccattttgaggggtttgaatagagggggaggtgtgaatccaattccacaataatccaaccattccatagtgtccaggtgataagagtatttccaaagtctagagttgtaaaaccacctaatgttgcctaattaaccagtgaagcatctacctaaaatcatactagtggtaccatgagtagagtgtccactagttggtgttttgtttattctagggtgaacaaggtaataataacaataacaataataaggtcataacaaaggtacataggcatggctagataaaacagtgataacgcgggaatttaaataaagcgataatgcaataatttaaatcaaaataatttaataaaccaggattcaatatgttcaaggatgatgtgacttgccttggtcactttcccaaatgtcggcttcaacctccacgaagagcggatcttccgaagctgcaacgtctacacgaccaacggaaaataaaagggcttttactctaataaactccatataacagcaggaacaaagcacaaaaatgggttcttgacttcttaaggaaaaattagagacttgaacagtccaattccgagttcaaatggccaagttatggccatttgaagtttatatgctctttaaatgaatatttgcgaatttcttcaattaaattttaatttaaaaaaaaggtttattgcgtcagccgaggggagggggcgcacggaccgggtccatgggagtggggcccacgtggcagcctcacggtccacggtggaccgggcgtaccagggctcgcaccagccagcgccgtttgccccacgcgtcagccgcacccgagggcgcgggcggctgacggccgagccccacgcggcgtccacttggcgcgcccgaaggcagccactcggcgcggccggcgggaggcggcgcccgcggccctatggtcgccggcggcggccataggcacggcggagcggctgccgagagaggggaagggaagggggaaaagacgcggtggtccacggctcaccctaggtcgacggcgacgacgaaaaaggcggccggagcgaaggaaggcggcggcgcggctcgggtcgacggggtcgacggagttccggcggtccgcgggctcggcgagggggtggacggagtcgacggtggtgcggcgaagccggaggaggcgacgccggggcgggagacggtcccggcgagcggagaaggccggccggaaacgggcgagggaggcgcggggagggtttatatagggttggaagggggagagggcggccggaggggaaggaaaccggcgcggcgctctcgggctccatcaatggcgccggcgggattaggggagggtttccaaacgaaaccaagggagagagggagggaaaattggggggaaagatagagggaatcacggggaataattcccccctattgattgcacgcggggaggacgggatgcggcggattcggcggcggcggcggcgcttggcgcgggcggagcggcgggagcggcgggaggaagggaatgacgggtaggccccacccgttagcgagggtggtgggcgggcccacccgtcagcggcgcgcgcgcgggggaaggccggatgggccgcgggggagaggagagagggggagggagatgggccggattcggcccaagagagggaagggggatttttagggtttttctttttataaaaccttttcaactttgtttatttcttaataattactatttgtgctctgaaaattccactaaaatttatttacacattttaggcttttaggaaatatacaaaaatcctctaagccttatttgacttttaactttgcacattttaatttttgcaggctttcacacggattttaattattctaggcataatttagaggatgtattttagagtcgttatgggacgtgacaaacctaccccccttaaacggaatctcgaccccgagattcggaagaactggcgaagagatcgggatgggctgccttcagctcgtcttcacgctcccaagtagcttcttcctcggcgtggttgctccattggaccttgcaaaaacggattacccgtttcctggtcctgcgctccatggcgtccaggattttcactggcctctccacgtaggtcaagtattcgcgaacttcaatctgctctgagtcggcctgctcggacagcactcgaaggcatttcttgagttgcgacacatggaacacatcatgcacgttgcccaaggaggcaggcagctccagctggttagcgacttctccgtgtcgagcaatgatacggaaaggacccacaaaccgaggtgcgagcttccctttcgtctgaaaccggtgtacgcctcgcaacggcgtgacccggagatacacaaagtcatccactgcgaattccaggtcacggcgtcggttgtctgcataactcttctgccgagactgggccacctttaaattctccctaatggtcctgaccttcgcttcagcttctctcaagatatcggtcccgaacacttggctttccccaacttggtcccacaatagtggtgtccggcatttgcggccatacaacgcttcgtacagtgccatctgtatgctggcttggtagctgttattgtaggagaactcggcgtaggggagactcttatcccatgtcttcctaaaatcttggacacatgcgcggagcatatcttctaggatctgatttagacgctcggtctgtccatctgtctgcgggtgatacgcggtgctgaaatttaagcgggtacccaactcttcttggagcttcttccagaaatgagaggtgaactggcttccccgatcagatacaattttcttaggaacgccatggagactcacgatcctagcgaagtagagttcagctagtttgttccctccataggtggtcttcacaggaataaaccgagctaccttggttagtcgatccacgactacccatatagaatcataaccgccttgggtttttggaagtccggtgatgaaatccatcccaatttcatcccatttccattctggtacttgtagaggttggagaagtccggccggccgttttctgccttgacacgctggcacacatcacaaagggccacgaactctgcaatttcccacttcatactaacccaccagtatgtccctttcaagtctaagtacatcttcgtactgccagggtggatggaataaggactttcgtgagcttcctgaactatcagctgtttaagttccttgtcgtccggaacgcatacacgacttccgttccatagggttccatgttcatcttctgtgaaaccagcggctttaccttgtttcatattcttgaggatcccatgcatatctggatcattcttctgagcctcgcggatttgatcgagcaaggtaggcttggcttccagtgtagccaagaatccacgaccaactatgcttaggttcagggcttccatctgttgatgaagttccggtggaatgccacggacgccaagagtgttgcaacggctttttcgacttagagcgtcggcgaccacgttggccttaccagggtgataaaggattcccacatcataatccttgatgagttctaaccatcttctctgccgaagattcagatccgactgggtgaagatgtatttcaaactcttatgatcggtatatatttcgcagcgattcccaatgagataatgccgccagatttttagagcatgaaccacagcggccaactccaaatcatgggtagggtagttgccttcatgatgtcgtagctggcgtgaggcataggctaccacatgaccttcctgcatgagcacgcaccccaatccttggcgcgaagcatcacagcacaccatgaagtccttgcgagtatccggtaagattaaaactggcgaggaaaccagcttttccttgagagtttggaacgccttctcgcattgcgggctccacacaaattttttttctttcttcaacaactgtgtcatgggtcgagcgattttggagaagttctcgatgaacctccggtagtatcctgccaaacccaaaaagctgcgaacctgagtgactgtcttgggttgcttccaatcagtgacggcggtcactgtttcggggtccacagcaactcctttagcagatatcacgtgccctaagaatttgacttcggacaaccagaactcacacttgctaagcttggcatacaattgatgttcccgcaactttcccaacaccagacggagatgctgctgatggtcttcctctgattgtgagtacaccaaaatgtcatcaatgaaaaccacaacaaacttatccaagtattccatgaacactttgttcattaagttcatgaagaaggcaggagcattggtcagaccgaacgacattaccgtgaattcatacagtccgtatcgcgtggtgaatgcggtcttcgggatatcctcttcacgaatacgcaattggtgatatccggaacgaagatcgattttagaaaagacagtggcacctttaagctgatcgaacagatcatcaatccggggaagagggtacttgtttttgatagtaacttcattgagagctctgtagtcaacacacatcctctttgtcttgtccttcttttccacaaaaatcacgggagcaccccagggggaagtgctcggccgtatataccccttttctttcaactcttccaactgtttcttgacttcggccagttcatttgctgccatacggtagagtcgcttgtacagaggagtggttcctggagcaagatctatccggaactcaatctctcgcttgggcggcataccgggtagttcttccggaaacacatctccgaactcactgacgatggggatttctgacagtcctatctgatgaagttctgaactgccgatagaagttgggggtgcaaagaaaacaaccggttgttccggccctcggtacagagtgacagtgcgtcttgcgcaatccactactccttggaattcagccaaccaattcatcccaaggatcacatccaagttcttagtgtctagaagaatcagatccgagggaaaaggaattccctggatttctattgggacggcagggctataatactttgctgtcataacccctctaggggtggtgatgagcagagggttcctaagcctttcgacccccaactgatttctccccacgaatggcacagatataaacgagtgggaagctccagagtcgaacaaaatggtagcagggatggaatgaatgaggaatgtaccaacgatgacgtctggagttgtcagcacatcctcggcagtcacgtggttcacacgaccccgaatgacatccttaccaccattgttggggcggggaggcgcttggccttgctggcgcctcggctttgggcatttatccgcaaagtgcccgggctcgaagcagttgaagcacagacgctgctgaccttgaacttctctgcggccttgaccaggctgcacaacgggcgcaggaggacggggcacacgggtcccttgctgactctgctgttgctgcggctgtgaggaggatccccctggatatggattggtgtagcggaccctttggttagccccctgttgattgcggagattcgccaagcgacgcttctgcgactccagttccttgtgcttggcttccaagcggatgctcttgtccaccagacgttggaaatccggatagtccccggagaccagacgcacggacagctcagggtccattcttgccaagaacttctcttgcttctcctcatcttcacgaacatcctccggggcgtaccgggccaggttgttaaacccatgcaaatactccatcacagagcggttgccttgcttcaactctcggaattcccttttcttaagggccatgactccggcgggcacatgggtcctccggaaagcggcggtgaagcgggcccaagtaataggctgcccctctggctgcgtagcctggaagtggtcccaccatagagatgcgggcccttgcagttggtgagcggcaaagatgactttctcctcatcgttgcactgcacggtgtctaactttttccccacggcatgcaaccaatccaaagcatccacggggttattggagctagagaaggtaggcggacggatgcggaggagctcggcgagtttagagtgttgtgggggtggtggtggaggtggagcattatgctgtggcggattttggatgtgatggaggaaagcagccatcatgttggcctgctgggcgaggatttgggtgaggatggagttggtgtctggtggtggtggtggaggcgggggaggaggtggaggtgggccgccttggatgttggggttgctaccttcgggttggttgccatcaccggtagcagcacttctcctggttgtcaccatctgaaatatcccatacagaaccagccaagagagagaacagactattaaagctaatcacccacgactaccaaaattcttgaatttaatactgctattaaattggttcattaaggttcaagttgcttaagccaataaaataaagacaggctccgacacagttataccacacaccggtataaccatgccccacacgactctagcagaaaaacaaacgagaagaacacacgcgcaagcctactaactgctcgtctacttttgcgacgggccagggcggaaggtgagcagcagcgcaccctccgtgctaccaacgccagaggctccctcctcctgaggaaccacgggcgcgggctcggcacgaggggtctcgacgaaacaggtccatgccaaggactgacgaacaagcttgggcctggaggtactcttgcgggcggtgatcttctggctgcggcagacgcgacggcgcttggggcgacagacctctccctgggcgatcttgagctgacacagctgcgcctccaccgcgtctaggtccttcttcagctgcagattctcctgacgcagctccaggatcttcatgttgttcttgaccaacccacggcgcaccatctggtggaagtcgatacgggccgcgtcgtacgcctccaccatgcgcgccaggtgcatgatggtagcgtcatcctccgagctagcatcttggaaggtggcgtagtcgcgggctcctccgcgacgagggtggtagcggtagggcgagtgctgcaactcgtccgggtagcgctggtgaagagtgccgatggcgaggagtgcggcgttctggcaagcggcggagaaggaatctccacccgcggtgactgccaacgaagtcctctcgggtgagccagtgaggatcactgcagtgacctcctaggcagcgtggggctctgcatcgtcaccttcctgctccaggagctgcttgccctggtagtccactccatgcggataccccaagacaacgcacatgccccgcagctccaaaacgaaaccagtcaggtccagaccacgacggttgatgctgccggccatctacaaacaaaaacaaaagagaaaagcaacattttaaaggtcagattttgacgataaatgaagcagcaggacagagagagactagaggattttcacaaataagaaaggatttttattttgaaaatattgctaaggcttgggatctaaggctcgtcctagggtcaagctggctctgataccaacttgtcacgaccggaaataacccaacgggcattccttacgtgcgtgtattattccttgtcccaggaggcaaggtacaccaaaagatgatacatttcagagtttatcaagcggaagcataaatagttactttattacatgggcggcgaaggcccagcacacaaaaagacaaacgggaaacagcggaagactagggcgacgaccacagacgcttgacggcaggcacgaactagacgccaaagccttcatcttccaggaactcctcttctgggtttgggaaaaattgagcaagactgagtacaaccaccgtactcaacaagacacacccataagtgcagaataaatgcaagggagtacaagggggttataatacaaagggttagggtttgcagtaaacagcactaaaagacacttagttgctcaaagctattttgtaaacacggtcctagagctatacaatattattaaacaaggccgtgaacccacacgaacctgccttaacccaaggcctacgatgattcagaccgaactggcaaccagaccctgggtcccaactcgtcccaagccaacccaggccaaccattccacattttagttattaagcaggttttaagaattaaaaacactaacttgggtacattgctcggcttgcccataaccgagggcgcggctattcgaatagattatactctgatcagaggtgtacatctttacccacaagacacatcttcctcatgtgtaaccacgtgccacataccaccacggtatacggacggaagacatgacatagtttccaacccatcctagccataaacaagagtaccgacccaaccccacctatggccggaaccccgggacaggtaggcaggactgagcccctagcagcaggacaccggccctgtgccatgacatctcgactaccgggccgcagctcgtgtagccttcatttgccctagagatgtccatcgactcccgacttcgtccatctccatccgtgtacttttgtttataacctgactgagccaaaaactaagccttacccactagacgtgtggaagtacggtagtgctttgcaacagaggcccgaagaccggtccttatatggccgaggtgctactgtcaaaaccatgcaccccgagcccagcctaaaaccattttgagggttttgaatagagggggaggtgtgaatccaattccacaataatccaactattccatagtgtccaggtgataagagtatttccaaagtctagagttgtaaaaccacctaatgttgcctaattaacaagcgaagcatctacctaaaatcatactagtggtaccatgagtagagtgtccactagttggtgttttgtttattctagggtgaacaaggtaataataacaataacaataataaggtcataacaaaggtacataggcatggctagataaaacagtgataacgcgggaatttaaataaagcgataatgaaataatttaaatcaaaataattttataaactaggattcaatatgttcaaggacgatgtgacttgccttgctcactttcccaaacgtcggcttcaacctccacgaagagcggatcttccaaagctgcaacgtctacacgaccaacggaaaataaaagggcttttactataataaactccatataacagcatgaacaaagcataaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaaaaaggtttattgcgtcagccgaggggagggggcgcgcggaccgggtccacgggagtggggcccacgcggaagcctcacggtccacggtggaccgggcgcacccgggttcgcaccggccagcgccgtgggccccacgcgtcagccgcacccgagggcgcgggcggctgacggtcgggccccacgcggcggccactcggcacgcccgaaggcggcgactcggcgcggccggcgggaggcggcgcccgcgcccctatggtcgccggcggcggccataggcacggcggagcggctgccgagagaggggaagggaagggggaaaagaggcggtggtccacggctcaccctaggtcgacgacgacgacgaaaaaggcggccggagcggaggaaggcggcggcccggctcgggtcgacggggtcgacggagttccggcggtccgcgggctcggcgagggggtggacggagtcgacggtggtgcggcgaacccggaggaggcgac

SEQ ID NO: 44152 - DNA, 11818 bp, Oryza sativa
cgcaactccgggaatccattccttgcgccggattaggaggaaacgcaccgagggaggccggcgacgagaggcgcttaccgagctcgggcggcgacggcggcgagcacacagtgggcggcggcaaggcttggggcggcaccagctagctacggggaggctacacaagcttctaccgaaagctaaggggaagagggggaacgaggagggagaacggggagatgcactaccgtgcgggacggggcgcagtgacgatgggccgacggcacgggagtgatctctccggcctcgggccggggaagcggaggaagacgatgcgcccgaagcccccttcacgcgtccttcgcacgcaccggctctcccggtgcttggcgatgaacggcggaggcgagatagaggggcagcaatggcgcggtggtggcgagcgaaacgggaggaggaattgatgggagggcgccttggttaaataggaggcgatgtcggtttgggaaccgacctaggacggttaagggagcgagctagtgctcggcggtcgtggccaaaacggcgacagggggggtgacgccaatggaagagaaagggaaaaaagaggagagaaaggggggcttgccccttgccactttgggaaaaggaggagggagagagggcgatgcggcagagggaggaggagctctgcctccatcccttggaagctagcgtgcggagtggcggggccgggtcgtgacgacggcgatgacggcgggggcggtttggaacggagcggcgacacgggcggcaggcgcgggctcaggcgcggtagagggctgacggcggcggcgactggccggtcggccaccacggcgcccgcgcgcgcgcgggaagcaacgggcggcgcggcgatttgggcggcgtcggcgggaacggcggcgagaacggagagggagggagaggcgctcggcgcggctcacgcgcacgcgcgtgcggcgcacgggcaaagcgagggaggggagagagagaaagagagaaagatgggccaagagggaatcggcccaccgaacctaagggaggcaaaatagacttttcgagaaggattgagattagggatttgaatttgacgatggattggggatttgagatctggaattggcacggaaacggacaacaagcaaagaaacaatcttcgcaaatagggtttttagaatttaaattttcccgctaggcgccacgacggaacgggcactacagctccaccggcgaggtgcgctccacttcctccgcctcttccctcgtgtgttcgacctccgcgacccgctaccactctccctctcggttaccgcacccgctgccgagctcctcgccgtcgccacctccctcgccgcggcggccgccggctccgatgagcggtggggttatgacaatggggagggctgcacctcgggtgccatctgatttgcgggaggagagtgaggtaggaggaggggatccggattagtacaggatactggtgtattttagccattatttttttatagaaataaaaaagagtcaacactatcatatatttagatgtaattttaatacattttagccattattttttttatggaaataaaatagagtcaacgctatcagatatttattggtaaattttttgatagaaatataagaacaaaagggcatacatgtgcttcttaagttgtgaaagatctcccatactcacacacactgacccaccccttcattcaacatttattttcatcgaagaaaataacaccttaaacagaactagaactagaagagaactggtgtatcttcagttggtggcagcagcagcggcgccagccatcctcgccatggcgagctcgatcagcttgtccacctccggcatggcggccttggcgacgtccagctcgacgaagcgctcggcccacgccgccagcagcggggtggtggccgggtcgaacctcttgacgcccttcatcgcgtcgccggcgcgaacccacgccaggaagctgccgagcacgatgtcgacgtagccgacggtgtcgccaccgaagaagggcttccccttggagcactcgctcagcccgacctccatcttctccagcgcctccaccaccttcttctccccttccgccttctcctcctccgtctttcccgacgacgcctgctgcgacgccttcgcgatctgccaaaaataataatccaccgcgcataaacaacacggaaatcggaatcgacgcggatgatcagatggatggatcgatgcgaggtggtggtggtcgagttggtaccgtgtcgtcgcagaatgcggcccagaagcgagcgacggcgcgttcgtgggggtcggcggggagcagggtggcgccggcatcggggaacgcctcgtcgaggtactgcaggatgatctgcgactcgcagactggcttgccattgtggatgaggacgggcaccttcttgttcaccgggttggagctgaggaggagctcgctcttgttcttgagatcctcctcgacgtactcgtagtcgaggcccttgagactgagcgcgagcttcactcgcagaacgtacgggctcgcccacatgcccagcagcttcagctcgtctcctcctccggccatggctttctcgtgtctgaactctgaactccgatggtctctgctctgtatcagcttgtgagttgcgagctctgttctgtttggtggttggtgttgaggtggaaggagatgacgcgtatttatagaattaggcccaaattatattagcctgagctctgaaatctgcagtttccacgaagaggccggacgactgtttttttgttatattctggtataaaattctggtttgaataaacaatcgaaagtttatatgcttgggcaagaatcaaagaaaagtatgagcatggtcaagctggtcattcatttttctttcttcatcaatgactagtatattgggtgatgctctcaaaaactcagccacgattgcacttatcttgacttcagtacaaagaagcgtaggctgagtggctgacaaatctgttccaatccttttgatatcatcatttgtattattcacgtaaacacataatactcgtcgctactccattatttgtcatctgatacgtcaatctgcaaggctgatagataagattgggtcaagactgccaggctggaaaggacatttttttacctctgcgggacgtcaacactagttacctctattttaagtgctacgccgacacatcatcttacggtctttcaagcacccaaataggtacttaaaagaattgaccgtttcagaagatcgtttatgtggaaaggcaaatatcccgatcactaaaatcctagcgacagtttgatcaactggcaaacagtttgtaaacccaagaaattgggtggggctggcctcccaaacctggatagattctcaagagctcttcaactccgctggctctaattcaagtggaaggaggagaacaaaccttgggtaggcattaatctactctgtgacgatttgaacaaaagactttttcaagcagcaacaacaatatcagtgggcaacggtgctaaaactagtttctggcatgataattggatccaaaatcgatgtttaaaagatattgtgcccaactgtttcagtctggtaaatagaaagcaaagaaccatgcaagttgagatgagagacaacaaatggcttacctcttttagacaattcacctatgtggaggaattgcatgacttggtgcagcttggaggtttgctccaactggtctcgctttcttaagatccggatgacatttcctgggattggactgaacctggttcctacacaaccaagagcgtatctctttcaattttaaggttccttcgctaggaatgattttgtatctctatggagggccctggttgaaccaaaaatgaaattctttggattgttaattctttataaaaaaaaacccttattgcccagaatttgctccggagacactaatcatgcaattggatatgttgtctctgtaccgcttttgaagatacatcatctgttcagtgaatgtgtctttgtcagacaagtttggagcctagtttgccaattccaaaatctgacccctgcaggttccaaagagcaagcgcatgcgattagaggctcgttgttaactacctggttgaatatttggttagaaagaaatagaagaatcttcccaaactcttcttgttcagaaaccgaagtagcttactttatcaaacaggacataccttctctattgttaaattccggcagatgtcctgccgtccttccccttaaaaaaaaacgtcaatctgaacttgtacctgtttcaatctgcacttgtacctgttttcttgtgcatatacattattagggagattagactgactgcttcctctctgaattctgattgccatgtgtgcgtatgctgtgacgctcaaacgatgatcagtaaaaatcaaagaagtcagctcttgttatcaccaatctggttgactggttccagaacactaagtctccattcggtggcaccagttggaggaatattttcttttttcatttttgggagttcgaggaataattttaacacacgtaaaatgagaaaactcattactacataattaattaaatattaactattataaaattaaaaaaaattatttaatttttataagtacttctacataaaaactttttactaaaaacgtaaaaacgtaagtaccgtttaacggtttgaaaaacgtacgaacgaaaagtgaggaagttgaagtttggagctgagaaaaaaagtgggcctaagttctgtaaactaacactaagtcttgttaatttatttcccattctcttgtattatccatatacattttgtgtcacgcttgcatttcttggtcgggtgcatccatacatgatgcgacgtattttcaactacaacataggcggccatgtttagttgccacataaaaattttacaccatatcacatcgaacgtttaaacagctgcatgaaatattaaatataggctaaaaaataactaattacacagattgcgactaatttgcgagacaaatcttttaagtctaattgctccatgatttgataatttggtgctatagtaaacatttattaatgacggattaattagacttaataaatttgtctcgcggtttattgacgtattctgtaattagttttttattaatgctcaaacaccctatgcgacaccctatataatacccgatgtgacacgccaaaactttacaccccggatcttaacacccccatagtcaaatttctataactacaatattagcaagaatacaattcaaattagtaatattactttacaaactaggtgggtctgcgtcactttggaaatatgcaatattaatacatttaaaattataacatcccggcctagggcttaatagaattaatagaatactcatatcaacaggttgcaacttcttttccggaagccgatctccaaagaactccagggttaagcgtgcttggcctagagcagggttaagcgtgcttggcctagagcaatttgggatgggtgaccgaccgggaatcagggggtgagggtgtaacatctcggcctagggcttaatagggtgagggtgtccggaagccgatctccaaagaactccagggttaagcgtgcttggcctagagcaatttgggatgggtgaccgaccgggaatcagggggtgagggtgtaacatcccggcctagggcttaataggattaacagaatactcatattaacaagttacaacttcttttctactcatattaacaagttacaacttcttttccggaagccgatctccaaagaactccagggcggggttgatcgacgggggcgtcgatctctcttaagggggtgagggtgtaacatcccggcctagggcttaataggattaatagaatactcatattaacaagttacaacttcttttccggaagccgatctccaaaaaaactctagggttaagcgtgcttggcctggagggttaagcttcttttccggaagccgatctccaaaaaaactccagggttaagcgtgcttggcctggagggttaagcttcttttccggaagccgatctccaaaaaaactccagggttaagcgtgcttggcctggagggttaagcgtgcttggcctagagcaatttgggatgggtgatcgaccgggaaattcttcccgagcaatttgggatgggtgaccgaccgggaaattcttcccggctgcatgtgttggtctgtgagggcagtctatgacctataagctatcagatgtaagcgggcccggcctaaaaaataacaaatgtgaatgtgaataatggatgcattagatagagtttacactaatttgttatttatattatattattattagacaataatcactatgaatacgtagccgcccttttgcgcgccaaccaatcgatgtaatagtgttcaaccaccctcttggatcagtgcacaccttcatctggcctcaggcctctgcggcggcttcttgtgcctgcttcttcttgaactctatcatcatgccggcgtccggcatgaccgccttgtaggcctcgagctcgccgacgcgctccagccacgccgccaggagcggtgtcttggcggcgtcgaactgcttcaacccgaacagctcctccatcgcatgcacccacgggacgaagccaccgagcgcgacgtcgacgtacccgacggcgtcgccgccaaagaagggcttccccttggagcactccctcagggctccctccagcgtctccgccaccgcgaacgtctgcttcctcccctccaccttctcctcctccgtctttcccttgaacaccatcttccacgcactgaacagctgcatcattcgatcagcaccaaaatcgtcagaaaagcttgcgtgagagaactgatgtacggtgatcatacgaattaccttgtcgtcgacgtaggaggcccagaagcgagcgacggcgcggtcgagggggtcggaggggaggagggcggcgccggcgccggggaacgcctcgtcgaggtactgcacgatgaccatggactcggagatgggcttgccgttgtggatgaccacgggggtcctcttgtgcaccgggttggagctgacgaggagatcgctcttgttgtggaggtcctcctcgacgtactcgaagctcaggcccttgaagctgagcgcgagcttcactcgcagtgggaatgggctcacgtagacgccgagcatcttcaggtcatctcctcctccggccatggctatccaacgctctgaggcctaagcagtagtacgtcccaaggattggagcttttggcttttgttttgttgggctccttgtcttttggaggtacgaagctatgataggtggtgtatatatatatagagagagagagatttgcctctgcctgcagggttaactgatgtagaaactattcagccagtgaccaatttgttttgaatatacttcattgatttttcttggaagtggatttttgtccctcaagaggatatccactcgttttatgcatagcattcagaaagttataaaaaaatttgaaaattttatcaatatagataaatatatgatatatcttttcgcaaacatgcgagctaaaattcgaattatataattcgaaacaaaaataacaaatttgactgtgaattacacgttctattcgtagtcaaatttattatttttgtttctacttgtataagttgaattttaatatgcatgtttgtaaagtgacatatcacatattgatctatcctactaaattttttcaattttttatgacattttaagtaacatgtaaaaatgaggggatatccccttaaagcatgaattgagttttccatttttcttgcccaccactactatgcaatactattctccatcaccctgtaagttttgagatgctgacaatccatccagattgcaactttctactgcccttgctttgcataaacgcagtcgttagactatctccaacagcctaggcatagcgacaaccaaacccaaaatgcgtgctccaggctactgtagcggaaaaaaacagggtccaacagagtacccatactaaggacctactttgggtgccaaccgaggcggaactcaaatatgagcgccctctctcctcaaccaaaacacctagcgtaactgtttcgcgggaggcggagagaagaggaaagcgcacctggccccggtgataggaaaagctccgccgccggcgagatctgctctgagctaggattcgcaagtatggatctctctccaaccccaccctccttcatccctggtcccatctctcctctctctcgacgtggatttggccgcggccgctcgcaccctggccaagggcgcatcgcgccgcatgctgtgcctagccccagcgacgccgctcaaatttttgttgaccgcaccctccctggcatgtttgtgccatgtttaattgaatctctgttgtaataggatgatggataaaaatattggtggctcaagtgctcgcgctggcgaatctgaagaaatctttcggacagatcagtgggcttttggtttttctgccgctttgcattcttttgaaagggaatgtgacatcgaacaagcaaacatgcagccggccttgtccgaacaagcaaatgttcgaacggaattagccacaaattaaaagggaatgtgacatcgaacaagcaaatgctagaaatcatattacctgtgttctgattgactctgctgcgccaacgttcggccttgtccgaacggtcgctcgccggcggctacctcgctgccactgagactcccttctcacatgcagccggggcggcaaaacaatcccgccatcgagccaacaccgcagtcccgcgccccgcgcccggtatatctcgcacgacaccctccgtttcccgcgtaaaaatttcatcgcgggcccacgaaggaaactgtccgtgttgcagggtttccttttgcgttcgctgttggagaaggcaagaaataggtgcgtgacccttttgccacaggtgacacataccgtccaatgggtctcctgttaagggtattattgttagagatagtcttatatggtgctggtctgtctcttgttcctcgttacttgcctggtctgtgctacacacgtggcacaactactgtaatatctgatcagtgacgcttgcttgttcggctgttccgttgttcgtcatcgatgacggctgcgtttgatatggctgttgtgcttggctagttagcaaggaaaataagacgagcaattaacgtgtatttaattaagtattaatcattataaatttgaaatataaagtcattgcttaaagaaaaaatatataaaaagtttctttaaaaaattatatcgtttagcagtttagaaagcatgttcgtagctcaagtaataagcagaaattttgatccagtattatcatctattaccttatgcctcgtgctactgcaaggtttgaatgatgagcttttttgccgtccagcatgctgttgtgataccgaatctatcatggttacggataaaacatacctcttatcctatgactgacgaaacatacgagtatggtataccatcatccatacgatatacttccgtatgtgataaggaaatctacaagatattatggaaaatatcctcacggacttgtgattaatagagtcctactcggagatgattgggtttatcctatatatatcgtgtagggttcattgtctccgagttctacttagagactaaggcaactcacggtataaaaggcacaccccctgaggggttcagatcatcgaatcatagtgccaacacacttaccataatttacgaagccggaggacgcgaagccagactcgtcgggagatctcgtcaaaccatctcgacaagggtctcgccggtaacgccggattcgtctgttctctttatactctgtggttttccatataaatcttatataaactagactaaggctattacctcacgaggggcctgaaccaatataatctttatctttgtctttcgtgatgtcgtatcgtatagatcctcgtaccaacgtacctcaataccctatttatcctgtctacgggtatccctcgtcgacagaatcctatccattagtttgattgatccaatggctagcgtaggtcggtaccacgaggtaccattttagtccttggggtggtagtgctcataaaatagaagtggaagggtaagattgtcctttcacattgcaaaattttttttctcggtttgaatttgtatggacggatgagtggagaaggcaaagaccaaccaatgccgtggcattcatatatctttgcatcgccgcatcttcatccctcatctacttccatgcgagctacgtttccacctctctgcctacttatgtgactctgccgtcgctgcccgccactaacacagtcgatttagtcgcccatgccgccgtgcggaggtggagagacggcggcatgggggatggagagtacacagggatattagccggcgtcgccctgcacggaggaatggcacttcggcaaggaaacgatgcatacttgcatttcgggaaggaagaatgtggcggtggcggtgacgtcgcaagcttgttccgggtgctggctttatttcgttctcgattgtacccctcgtgattaaacggttggatttgttttggtacctggcaataccagtacctaggggtatcaatgctagaccagagcaaacctcttgaatgataatgtcttgggtgacggcctttcgaaaaagaaatgaaaatgggagtaggaaaaaatacatttgtatgaagaagtttatttgaacaaatattattgaaacaaatcaacgtatgaattaatatagacgtagcacatcatacatcatcttggtagaatagccacttcccacttggcaactgcgacggtacatggcgaagatacacggtgcggcaatacgaactgatgaacatagttgcagaaacaagacgaggtacagccataggaactgcgaaaatgtggaagcacacgacaatctatatggttgtgtttcaaacttcaaactcccctccaggattcagcaaacttcaactggcctcacccgcggcggctgcggccgcccccgctgcctgtgcctgcctcatcttggcgagctcgaccagcctgccaatgtccggcatgacctccttgacggcgtcgagctcgtcgaagcgctccaaccacgccgccaggagcggcgtcttggcggcgtcgaactggttcaggccgaacacctcttcgatcgcgtgcacccacgcgacgaagcctccgagcacgacgtcgacgtagccgacggtgtcgccgccgaagaagggcttccccttggagcactcgctcagtgctccctccagtttctccaccaccgcaaacgtctgcttcaccgcctccgccttctcctcctccgtcttgcttctgaacaccagaatccacgcactgaacagctgcaacgcacagaacacacgcagatcgatcaatcagcttaattcacaaacataagagagaaatcaagtaatcaataaaagtgcatggtgatctgacgaaccttttcgtcaatgtaggcagcccagaagcgagcgacggcgcgatcgtggggatcggcggggaggagggtgacgccggcgtcggggaacacctcgtcgatgtactgcacgatgacctgcgactcgcagatgggcttgcctcttgtggatgagcacggggaccttcttgtgtaccgggttggagctgaggaggacatcgctcttgttcttgaagtcctcctcgacgtagtcgtagctcaggcccttgaag

SEQ ID NO: 44153 - DNA, 1019 bp, Oryza sativa
cacgatttggcgctgaaaaaagggtcacttttgaaataagttttggcggacggttcatttgtaaaattagtttttgcaaaggttcacattgtcaaaattaatggtcgcacttctttctttctctccgttgctcgccttctttctacatgaaaggttttcattttcctccggttgactcaggcagtcaccatgaaaaggcattttctttcataccttttcattttattttgagtaaatttcacaaaattagatatactttcatcaaactatcacaatactacaggtttaaggcaatatatctcaaaactataaattaacactaaaattaccacaaaactataaatttaaggccaagtatcacaaaactacagatttagtaacaaaattatcccaaaactaaaagtttagtaccaattcaatcgcaaaattgtaatgcttatacctccaacgtaatagtagtgctagagatctaaacttgtcgacgttttagcacgactacgatatttgcatggtatgaagatcgttggtacaaaggcatatgccagattgaggtaaaagaaacagtgacaaagatttttatacaggttcaggcctcttattcatcagaatcaggttatagctctactcatgttggccgaagccggtgttgctcttattcatcagaatcacaaaagtacaatatttgagataatctatctagctatcgtcgatatggcggcatgaacaccaacacatagtcgatgatagggtagtcttcctcctcaaatatgaactcagcgagatcagagatagcgctagatccctcttgtcggcctctacatgcactagattgggtatgtctaagctgatatctgatgtcgatgtttggcggcgtgtattagtgtctattctgactgttccgtggcccctctcctcctatggggtcttgtatttatacccatagatgtccccttttgtctaagtaaaactagggagacacgtatggatacaattagagtagtcattataggggctgcagg

SEQ ID NO: 44154 - DNA, 13127 bp, Oryza sativa
  unsure (1)..(13127): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatattgttaatgtaagatctccatctaggaataccggtgacgaattgtagccataatttgctctaggtgacgggaaaagcaattgttgagctcgacatcttgcaacatttaggggaacatctaaataggtttagatcatgctctagacctttgatggcggagggcctgcaacagtctgttttgttgccatttgtctaaactgcgttttacattggccttctcttgtaaatgctgaaaaggcacattgtcttgctgtagtttttttttactttgactggttttgaatctctggtcattgtgttaattcgcaaatgatggcatttaaagaaagcacagatatcttatgtagttgttcaatctttcttgcagggagcttctgtacaaaccagttgttattggtaagagtttgctgttcatgctaacataaagagcaacctgattgcatagtatatattttttgaaatctcatttatcaattactggtgcagcatgtggacatatgtcatgtttctggtgcgtccacaatgctatgcatatcatcagggagtctcattgtgctgtctgtaggcagccttataaacattttcctagtatctgtcaactcctccatcacttgcttataaagcttgaacctgtggaatacaaaagaagggaaaaagaggtactaggtaagtatccaaaatccaaaccattaaacctctttcataatataaacaatactgttcatagtaaatgtttgtatttcttgcgaagtatggatactgcatgtattgtgttttgcatatgaatacaccgtcaatttcgatgctcttgcagatctagttcaattttttgggggtcatgtttggattgttatagaagcatttatatttcaaaattattttgcgactgccatctaaagtgctagaacacaaccagttctactgagcaataatgcaatttcataatttgaattcaaattcatcaaatccaaattgattggggtcatcagggcagaagggaatgtgatggtgtattcatgtagagggtgaggttgttatggcatcgatggtataggttcctagttggctgtgcaaacatggatgtcagaggatgttgctggcaatatggggatagggatttgtaagttttgggtgagatcattggatgaggaggatattggtgaatacattgccttagagtttgtgtttaatggatattgaaagtgtagaaaaagttcacaatcttatgctgaacaacacagagttttttcgctttgcagttaccatgacagttcttaaatttcacaattcacactatatggatgagtccatccagttttacgttttggcttattttttgtagcaccagagtttcaagaattacagcacgcttaacaaaccaaacatggtttcctcttccaatagctgtttgcctgatttcagtaattagcacgtcctatttttctgcaagttcttactgatgctcttcttttggtttcgactcagaggatgagaagcgtgtggatacatattctccacaaatcattgagtttttaaactccaagagcaacaattgtggtaagaattgtgccatacaactgcaatgatatttgtctcagctctcaagtttgcctgaacttataagatgtgctaccttctgcaagaaattgatggggagaatagacctgaagaaagtaatagtcgacctccacaagaagttacatctgatggcaacactatcaatgggcatccgaagaaagttaagctggaggacgtgtcatgtgctctttgtaaggagctgttgtatcaacctgctgttcttaattgtggtcatggtaagatttaaagctagaataaaaaatgttacgtattgcgctaattgtctcacatactgacttacctttatttatgaaaagtgtactgcatgtcctgtttgtcgtccttggatgatggtgcactcaaatgccaagtttgtggaggtcttcatccaggagattttcctaatgtttgcttggatttggaccattttatcgaagactattttccagcagaatatgacttaagacgagagaagattaagcttttgaagggtgaatgcaatcaaggatcatcttcaggtaagcttatctcacatggtgtattttcttatataccatactgatacagcatattaaaattaaggaaaagatcctattatttttttagaagtaattttctaaccatagggcgatgttgcttatgtgaagtatttctagtatatggtgtagcattatcttctgcatgaagagattggcgtttagaacaagattcagtcaaacttttgaaactttccccatcaataacttttaaaatgcttagcttattttttttaaaagttatgtgaagatttaccctgaaaatcactatgataatatcatcaacttattagaatttataaatttatttccaatataaaattgtgaaagctgtactttgaggactgtaaaaaagtcaaaagtcatgtatgctttgaccgaagggagttactatcttactggtaacaatgagtattatatatttatatgccaatagccactatgatttatcctatgatgtgaaatgcgtagatgaatattagcaatagtttgtagaaattaaccacaagattttatactaccccagttacaggtcagtaggccacaaccagtgatacagcactggaagagtgagaggaaccagcttgctgctttctgggacagtcataggaagttggtttcgatctactataattctctacgatactgggctagttctttcaattgtctgaaaagatagcatggataatttgcctttcctgttttgctattggttatggaaagtttgggcacgagttatgaaagtgatatctttgtaaatacgtataactttcgaaaggaataccataactgatttcttctttcatggctaactgtttttttttgtggtgtggttaggtacttcatgcataaaagaaggcaggggtagaccaacaaataaggaaaaccgtgcacatcaggatgatgacttgtcagatgttcatattggggttggatgcgattcatgcggggtatgcacaagttgtgaactttttaagatttggtgaacatacatccaatggataaactgttctagtcgcctagtaatatccaccatgcagcccaaatagtgatttttggttactggtagtactttgggttcactcagtgccagaaaaaaaatgatttcgtctcttaaattattcacactaagttgttgcaatctccatattctatcttgtgatcactttgatgggaacacattttcaaattttatttaagttattagtacttaattcaagtgtagatttgtgttggaaaattagaaatttgtttgcaagacgaggtttacataagttatgtgtccagttgtttagtgttctctagcctttctggttttaaaccttctaatgtactcccaccgtcccttaatataagggaatttggagagatgtgacatccgtccaaaatctcttatattttgggacggagggaatattgttttacacaaaaaggaagccttaaatattttataaggtacatttgtatcatgcctttattctcacttctctgctaatatgaaattgacgaatgcattgcagatgtatccaatacgagggaagaggtacaaatgtaaggactgcactgaattaattggatttgacctctgcgaagaatgctacaatacaaaatcgaaacttccaggccggtttaatcagcatcatacccctgaccacaggatggaacttgatcattcagcactcttcaataggttgatgaggctacaagggatacacgaggagggcccaggagagataatcatagaaggtgcatttgttgctcctgacgctgtggtgcatataatagcagatgatcatgaggaaatcgaggataacggtgaggatgatcacttgctctagaaacgaatcagtggtattaaacctgaatttcggcattgtcctttctttaatgtggaggaggctacatgaatcatgaatggtactgtatgaaatggagggattgaacaaagcttgtaggcgtgtaacgcccatagccccttacttcaatctaatgggaaacatcttatttctgcttttgtaatctacatttatattcttgttaatggaaatacgaatgagaaaagaacggcaccaggtacagcgtatcacaattcacaactgcacaagcgaagaagcatcctgtagttattaatgttttgtaataaataccttttgttttataaatcttcttttgcacgtctagaagcctggtaagctcttttccttgaggctccagacttcaacaaaagggggtgtttagatctagtggtgtaaaattttggcgtgtcacgtcggatattatataggtgtcacatgaggttttcgggtatttatgaaaaaaaactaattacaaaatccgtcagtaaaccgcaagacgaatttattaagtctaattaatccgccattagcaaatgtttactgtagcaccacattattaaatcatggagtaattaagctcaaaagattccacaaattagtcacaatctatgcaattagtattttttttaagcttatatttaatagttaatacaggtgttcaaacgttcaatgtgatagggtgtaaaatttttctgtgggatttaaacatgaccaaaatagaatgtgcaatctcgtccctccgtcgcgagcggatttggatcggcttaaacagtaacagtgtatgtcattggatgtaaattgggcgtgccagattgcatactgtactgtacaaagtactgtagcatgaagtactgtagccgttgttactgtagcattcgatctgagccgttgatcataaaaacggacaaccaaatttgcgtgcagttgttatctcgcggttgcaactttcatgtataactgcacctcatcccaattcgtcgcgagcagctccaggatcacggcgtaaacccaggagcggagccccaccggcacggcgatcaaagtgccgctgctgcatgggcctcccccctccccctcctctcccaccaggaacaacgacgccgcgtgccccttgatcgccacgacccagagctgtgcggtcgtgtggagtgtggacgaactggcctcgggctgattacgtagttccgtgccgtgcgctttcgtttttcatgactacgattatgcttctgcatccgcttgcgcgtggagccgtgcacgcgcgagtgagcgacacggcaaggcaacgaggcaaaggcatagagcacgcgaatgggggtgggtgagtggcgaggccgtgacgggagagagaggcaacgggaaatgaggtacgctgcgtacgcaacgcgcggggggcgtagtggttgggccgtgtcttcatccagcggttgggccaggtttcagctttgaatcctgcgcgcaaagggggagagcaaggaacaagtccatttcaactctgaaatataggttcaatctaatttgtatcactcaacatcaatatcaaatgttaactccctaaccaataaaatcagtccaatttaactccctcggctatttttgcgggcggtttttgttgatgtggctcattgacctagtctaaccagctgagtcagggggcccatatgttagtgactatttttcttcacctctttctttttctcttccttctcttttacccatcaatgcaattgggttgctggtgagcgagtcccctcgaccaatgcccccgacacggcactctgtggcaccgagctcgttagatctagcccgaggctcgtcagatctagatttgagaggcggcggcggcgacaacatgagtacttcctcgagcgtgcaaggccactccaacaagggtggctcgtcagatcaaactaaagatcgatggtggcaaagacggaggaagctcgacagcggcagtggagaaagttcaggaggggactggtgcttcacatcttaagggcacgacttccccgactcctcgacacgatttcgaccgttgcctcatgcatcatgggccttcatcctaataagacttatgtgttcttatagaggcgcaacccatactaacgtgaatgaagatcttcaaattagctatgtgaggccaaacttcacctcaccgtacactgtgaatggccttactgaaccttcggaatgaaaaagattataaggaagtggacctccaccattatatcagcaaggagaaacttttgatggtatttgtttataatgaagatgaatacgaagttaggatacacaaaacaagaaaatcattagcgcatgattagttgaattttaattattgtaaactttaaatgactttattaaaaaataaattcatttaatatttttaaaacaacacctatatagaaaatttttggcataaaatataccgattagcaatttaaaagatgggctaacgaaagtcgaataaaatatgtaattttaacagagatgaacaccgccaatgagggattttgtaccggtggaaaggaaaattcttcctttctctctctctctatctccgcgggaaaaatctctcgtgtgccttttcattattctaagtttgactagcatgatactagtagcaactaacgcttctcttttcaactccatggcatcacaagctggctagttgctgctggccagtgtatcgccgcgccgcgaaatagacgaacctacagggtgtgtttggttttgcttgcaccattctagcctggtccgtatgttccatccaggcttaccctagcctggataggtgggtgcaaatagggttgttaggttggttgtacgagttaagttggttgattgtacgcgcaaattaatcctgtatacaagagatattatttggtttggtgtatgaggttagaatatggttacctcctcttttgtatggtaagattaccccttgcaattttagtgtaccattcaattgtagttatagtactattcaatcagccaaattttgttaaaatctgttgcatatgtaatgggtgaattggtataaagaattataaaaaaaataaatggtgccaacgatcaataattcgccgctttatatacgctataacaggtgagggaaaaaaataaaaagaaagaaaagaaaaaaaatgtgcatctcgttctcgtcgatgtcatcctcccgccgccgcactaatcgttgctgcaccggtcgccgtcctccacccgctgcgctggtcatcgccgcagccctcctccgcaccggtcgttgtcgtcctccacccgctatgctggctgccaccgtcctccactcgctgcgctggtcatcgccgcaaccctcctcctccgcaccggtcgtcgtcgtcctccacccgctgcgccggtcactggtcgtcgctgtcctccacccgctctgctggctgccaccgtcctccactcgctgcgctggtcaccgctgcagccccctctctttccccactgctcgctaccggctaccctcccggatctggtggccggcggcggaagaaggtgcgggacggcgacgattgaagacggtggccagggattgaagagctcatcgtcgttctctccgtcgagctcgtcgccaaaccatcgcctctggcttcgctctctgtctaggtatgaggaggggggggagaaatgaggacggggcggtgactccatcgcaagctgttgcgtgctcggtcccgactccctattaggaatgcaagtgggtagtcccgctatccgtataaaaacccgtttgctagtttatttttcacgtggtagtataaaatttagaagaaaaaataaactagaagtgagataagcgggctaaaaaaacccgcttacccgctccacttacatccctactcctaacacgtcgccgtgtatagtttgtatacatacccgggacgaggcaggcaccgggcgtcggcaagcgcgtcctgcgtgaccgaccggaagaaactttttcagttgttgcaaccgctagctctcgcgcctttgcctgccttgttgcctcatgcgcgcgccgcaacgcaagagtgaaacacggaggccgccgcgcccgcgttatggcgtaaccgcgccgcagtataccgcattaaggtgctgagtcatccccgtactgtacctgtttctctctctctttttttgacgcatcaatgcgccctctgcatgcatgcatgcatgcctgcctgattggagcccctgtccttggctgcagtagtgacagtggccacagacgatgaccttgtggcttgtgctgattctgaccgtctcgattgaatgacgactactcaaagacacagacacccacaccatgagagaggcacaggaaagagaggcgtgtgcgtctccatatgcgcttcacgcctctctcacggcctccctcaacacgggtataaaaggcgaagcagtgggtagtgctaggttgggttggtgcttggctagccacggtattattgcgtgaaagagggggaggtgaggacgtgaggtgaggtgaggtgaggcagagtgaccacagcgacggcagcgtagccatggcgaccaggccgggccctttgaccgaatggccgtggcataggctggggaacttcaaggtacacgcccaaattctcaccttctgatttctgagcgaagaaaacatgttcatcctttttccttgctcccccgttcgttcctcttgatgaacttcaacagatgcagttgtttgcatacagtgaatggccagccaaatccaaaccttaaaattgcacatcccagtacatgcatgcagtttcctaaaaaagatgattatattctcggctagtagctttgtttgacatgcatggcatggggtggcatgcgcagtacgtggtgatggcccccgtggtggcgcacggcgcgcgccgggtgatgcgcaacgggtggggcgacctcgacatcgccttctccctcatcctgccgtcgctgctgctgcggatgatccacaaccagatctggatcagcctctcccgctaccagaccgcccgcagcaagcaccgcatcgtcgaccgcggcatcgagttcgaccaggtcgaccgcgagcgaggctggtcagtcacctcaacacgcacacgcacaacaacaacaacaacaacaacaagcagctaccaccactgtatatattcgtgctgatttgcgttgcgtgctgcagggatgaccagatcctgttcaatgggttggtgttctacgcggggtacctggcgatgccgagcgtgaggcggatgccggtgtggaggacggacggcgccgtggtgacggcgctggtgcacacgggccccgtcgagttcctctactactggttccaccgcgcgctgcaccaccacttcctctactcccgctaccactcccaccaccacgcctccatcgtcaccgagcccatcacctgtaagccacacgacttaaaggctgtgtttctttactcaatattctcaactccatcctacttgtttttccacgcgcacgcttctcaatctattaaacaatgcttttttataaaaagttttctatagaaaagctttttttaaaaaatcacattaatctgtttttttaaaaaaataattagccctaatttatcatttgctaataagtggctttgttttacatgcatcagtcatgagttcacacaactcatagcagctcatctcacttcgttagtttttgtttaatgccttatcatctcatgggtgttcatttaattaacttgttagtaccgtaccgtgtctcactgttcagtctaataattgttatatatagttgattgcgttcttagattaatgaagtgcgcagatcataaatagtaagcacaaagtggccgatattgactcctctcgtttgtttaatttcatgaaaaaactttttgtcacttgccggagatgccatgccctacattcctagtatgttctcgagttaaaatatgatgaagtagcagttgcactcctcggaataacacattcttagataattaaagaattcgtcgtagctaagaacaacacacatgaaagtaaagaatgaccagcaggatgcaggaatcgaattgaagacactgtacggagtattaatttcagaccaacagctcatcttctaccagaaaaaaaaaatcacaaatgttctgccaacatcatttatgttctctgatccatgaacagtaccacagtatcttttttttttttttgcaatgcaccttttcatgacaaaagaagaaaaagaacacctacgggacgggattgtgatatgtccagtctgaggctctgagcttcacactgtgtcactgtcgtagagtaaacggcataaattggctgtacctgctaggcagagagagagagaggcccgtccagcctgcaagaaatgagaaatgcatgtgactttctgaattgcagcgctgatgtgttcgattcagtttaggaccactcccggtgcaggccaatagtaggagtattacctttccttaccaatttgaccgataaatgctggaaagaacggccggtatactcctattgacatttcacatggcatttgcagagcttcagtgatgatgggtgaacagcctacagtttacagcacagagcctgtagtttacagtacagagagtacccaataaaacgagacataaatattgcggcttgcagaaaatgcagtttggaccacctccacaaccttctgatctagatatagctgttgctattactgatactgaatggaaaactgaaaacaaacataggttaagggttggtttagttcacgccaaaattagaagtttgattgacattggaacgatgtgacggaaaatttggaagtttatatgtgtagaaaagttttgatgtgatgtaaaagttggaagtttgaagaaaaagtttggaactaaactcggcctaaggccgtgtttagattcaaacttttttttttcaaacttgcaattttttcgtcacatcaaatgtttgtatatatacatagaacattaaatgtggacgaaaaaaaaccaattgcacagtttacatgtaaatcgcgagacgaatcttttgagcctaattacgccatgatttgacaatgtggtgctacagtcagcatttgctaatgatggattaattaggcttaatagtttcgtctcgtagtttaaggcggaatctgtaatttgttttgttattagtctacgtttaatacttcaaatgtgtgtccgtatacttcaaaaattttgtcacacgaactaaacacaacctaagtagaatacttcttccgtccttcaatgacttttttttaaacaaagttaacaaattagtaataagggtaaaagatcgaagtgctcctcattaataagaaagtagtattgttagtgatagttaggggtattgaagggatacaaaatcttaattcacggacggagggtaggtaagaaagttaaaataagtcttttatgggcaaggttgaaagactagaaatgaaatccctttaggacaaagggagtagtttttatcaaacgttggcaaatacaggtcctacaagtagaacaattcgaaagggattgatcgactattatagttgctttctaagtaaaagaaaagatcatatatctgggaggaggctattacctgaaattgaacgaggtgttttagctataaaacatcagtgtgatgttcatgcataggtcctgttgtttttttataaagcacatatataagagtatgtacctaccctgttaatgcacaattactattggcacttacaacgattttatacattgcagctgttattcatccttttgctgaacatgtggtctatttcatactgtttgcaatccccatactgtcaacaatttatttgggaaatgtttcggccatgggcattgtggggtacattgcttacattgacttcatgaacaacatgggacactgcaattttgagttggtgccagagtggattttccaaatctttccaccccttaagtatctgatctacaccccatcgtaagtgcaacactcttctctcatgtatctatcatagaaatgtattaccaacgtgatgacagattggatcactgaattcacataacttgaagttcagcctcgtgagttcataaacccaatgctaacaaacaaatgctatttccttctgcaggttccattctcttcatcatacgcagttccgcacaaactactcgctattcatgccattttatgactacatatataacaccatggacaagtcatctgacgagctgtatgaaagctcactgaaaggaacggaagaaacacctgaccttgttcatctcacgcatatgaccaacttgcaatcagcctatcatctaaggataggaattgcatccatagcctccaaaccgtacagtgactctgcgtggtacatgtggacgttatggcccttggcatggctgtcaatggtacttgcatggatttatgggtcctcagcatttgtcgttgagagaattaaactaaacaagatgaagatgcaaacatgggcattaccaagatacaacttccaagtaatcacttcccctcgcttatgcatttctaaattcaaaggtatggattatggaagatactaactgttctggttttgcactctgcagtatggccttacgtgggagagagaaccaatcaacgacttaattgaaaaggcaatattggatgctgatatgaaaggggttaaagtgattagtctaggactactgaatcaggtgtggagttcttacctttaaagctcgtgtaatgagaatcaaattaatagtttaatggcatggtaaaggttgaaagtagcatgataaaacgtgccaaaaataaacaataacaagaaaatctcatggacatgtcctctgtttcatgttaaaaatgtgattagttgaaaaaggacagcaggagtgcaaaaatttaagtttgtg

SEQ ID NO: 44155 - DNA, 13390 bp, Oryza sativa
ctatttagacagaagtatccaaaattaggagttcgaattatcgacggaagtggcttagctactgcagtggtgctaaaaagtattccttcagatgcaaagaaagtttttcttcgtacaggcacttctaagatagctcgtgccattgccattgcactatgtgacagaggtgtccaggtataatctatatatcaatttgcaaatcatcgttgtcttgaatatattttggttaatttttctcataatttttgccttaaattgcattacattaatctggatcaggtgatcatgaatgaaaaggaggtataccacatgctcaagtcacaaataccagagaacagggcaagctatttgaaactctcgagcgacaacgtacctcaggtaaaaaaattgttgcaagaaatggtgacaaactctcaagcaacatgatgcacctgtagactcttctactagtaatgttaaaatgtagcttatagactcttctacaagtaatgttaaaatgcagcttatattcatgctaatacttcatgttattgcagctttggatagtacacaatattgacgacaacgagcaaaagatggcgccaaaaggaacaatttttattcccatatcacagttcccccttaagaaacttcgcaaggactgcacttacatgagcaccccagcaatgaggatcccggaggaaatgaagaatatccactcctgcgaggtaatacagatatgttatctgctttgttaatctgaaaatatacgacatcaaagaacctcttcttaatagtgctactacctttgtggtcagaattggcttccaagaagggtgatgagtgcttggcacattgctggaatacttcatgctctggaaggatggaacatgcacgagtgtggggatgagatgatggatattgagaaatcatggtcagctgccattcggcatggattccttcctctcactaaagcttgacacctctggaagcatggatggtgtattccatgctagtagatgatgctatgatttccagcaacggcataatccattcattatctagcttgggaaccagatggattattcacttattatcttactatgtttgtaatactgagcttgggtactgataagtcatgaggaggcacagtgcaaacgaacttaattccaatagctcagtattttataatctatagtctatgtcagttctgtaacattacgtttatctcttatttgaatcttgtgggggaataattaaaataataggcaatgttttcttgtttagacttcgcaaagtaaaacctgactgatcgcacggtcagtgctcttgagacgagacaaacaagaccaggtaaagctaagcttactcgctggctcgctgctactatcgttttagccttcccttaaagtttgattcgacactgtaaaattcgcccatgacgctctgcacaaaatctttgaaactagtggcaacacagcaaaatcagatgcatcactggcttcacacttctaaggctgtgttctttcctgggtgatctgggtgattgtgagtgagtttgtttcgttttccgcacgcacatttcccgaactatacggtgtgttttcttttgcaaaaaaaatttatagaaaagttgctttaaaaatcatattaatctatttttaaaatttaaaatagttaatagtcaattaatcatttgctaatggctcacctcgttttgcgtatattcccaatctcctcgatttcctctccactatcgtttggtttgaaatgcttcgttcaaaaaggaaaccatcgacccttcaagcacacagcaccagtggtctagtggtagaatagtaccctgccacggtacagacccgggttcgattccaggctggtgcacgttttgttcttctcttacctttttttttaaccgatccgatgactatgatctccaaaaagtaaacacgcagagtatcagagtgtactctctatttgagtaccagagtactaggcatatgtttgtgtcatggaagagttgcacagtgtattcttccgatgactatgctctccacgaagtaaacacgcagagtatccgactatcaactgcatgtattgattcagagtgtactctatatcagagtatcagactactaggcatatgtttcatgtttgtgtcatggaagagtggacagtgtactcttctttcttgcatgccgaaaatgaagggaaatagtgctggaagaaagcagaaatgctccacatacaaatgattccccaatataatgcattgagctagagctatatcatggcagagagttcacattccagaattctttacatcacttggtattggtaaaaggaacaaagaacgggcaaccaagcatactgctttgcgggcaaccaagcttggaaaaaaaggacagcagttcgtatgagctgttggaatatttaagtgctgaaccagcagtctgtaactctggaatctggattgtttatcctattccagagaaaaattactatatcatctttctggacgataccatcaatggctctgcattgacttccttgaatcacttgaatagcagagtagagaattcataggttaaacccgcgccctcgatttagatcctgtggcagtatataaacttttgtcagctaatgcaatttcattgatgaaccagacgagtgcagcagcatagaaccactcatctatacatatggagacacaaggtaaatgcctcacagaatcagcattaataaagccatattttaggggagaacctcaacttcctaaatgcacatatagatgccatcaggaacttactgcgcgttttgtctcggcaaaactcacttccgcaatgacatttgaatgccttcacaggatggtcgacatcatcaaaatcaatcccatagtcctgcaggtaaacacaagatcatggcaaacttcgaaaaatgacttacaacaggtagtgctccatatgctacatgattcaaccaaacaaaggggggatactatctatgggaaaagcactaatgagtatcaagtcacaaggtggccaccaaaaggtcaaaaagcccaaaacataagatgaaagcaaattcaactagaatgtctgaaaatggttatagtccacatgaaatggagcttaaatttaaattgtggagtacaacctacccatgtgagttcctcaaaaggctctattatccttgttgtgaagaacgccagctaaccaaaaaatggaagacacagaataagctcaatatggtttaacttggactaatatatatcagttacaagctaaagttgaaaaaatacatggtaataatggtggtcgggcgtctcgatctcaacaggtattcctataatattagcatcaaagcacctgaaaaccgtacaatgatatgccaggtcaagaaggaagaagtgttagattcagcagagcacagaagcaacatttttttaagaaatacttatatattcaaaatttggataagactttgttctgttagctagcttcaaataagagtaacattgacttaactatcttgattaagtgctgacatcaggcaataatataggttgcagccaaacaatcactaatctacgacatcaggcaataatataggtgcagccaaacaatcacaaatctacgatgttgttcacagttttgtaacgagaaatatcatataatgacaactgaaaagcacatattaagttagttcacagaaccagggttaaacgctatggtccatgaggttttagttgggaccccactggtagccatttaccagtcacaccaattgtcaattttcaatgaaatttcctacactttcaacttgaagcacacatatcatggagaactcactaaatcgcagaacagtcagaaaatgtacatcaccaggttctcactgggaaaaccagaaagcgacaagaaccagctcatccctttttttacccatcccatagaagcaacagcttcatgtattacagaggactccataacaatcattagacgttctggtaaaaaaagaatccattattataaataataaatggatacctgtggtttataaatcttgcgacgttaccataaaacgtggcatctagacaaagggcttcctcatccttaagaacaccttcagtaccccagtcggcatcaagtaacaatgggtatgtgtgctttgctttaccagtcttttgaattgtacggtcatacaactcaatgttcgttaatatttcaccaacatactcacaaacaaaagcacctcgaggaagtttctcagtactgcgcaatccccatccttttttttcaggggttaagaacacctgaaattttagaaagaacaagaaaaattattaaaacacgtaagcaatgagatgtttactgtgacaagcacatgatcatacacatgatgcactatcacaacaaactgctgcagctaacatcataatttcaacaatatttggcagttgacaaattatcgtcaagctagcaaaaactttgatattattacttacctgtaaatggcgtgtgatgcctcgctgcaccacacggtttccacaatttctagtgcagccgcattttctccagcactccttgatgaatttccttgtaaggtgtcctttacaaggaccaggattcatttctgtgtttgatgaatcagaatttacttctatcttcattcgttcgtttgggcaaatcttgcagtagaaatggggatgtttaagtggttctcgaatcattgagatacagctatctagaaatgctcccttaagaaggccatctgttgtataagcaaactctcctcctgtttctgcagcacacgcacaaggaagtgattgtgccagacaatctctgaaacaatcagaacagcaattgtcatctccgattctagcaagggagatgtttacataggcttcttggagtgtgatattgtgtggtatgtagtgaaatggaggaggaagaatcccattgccatattcattaataattggaatccttaaacgttcttcaccttttgtgatatcattgacatcatgaggtggtctgttggcaccaatatgtagttgatgcggaacaaccggcatattactagaattctggctaactccagcaacagtgcaagaggaagaagtaccaccaaggctcatgacattattaggtggcataaaagcggaattagcttgatttgactgcaatatttgcggcactgaaggtttggacagaatgtccagggcaggaacagtttgtatgatgccttcatgtctaggtccactagattcaacaatacactggcaagtatctttaataagattcttaaaagagaaattgggttctaggctcttgtatttcctaaggcatctagcctccattttcttgcaaattaatttaatgtcaggcagatgaaaatcagaacggtttgccagggaagagttgtatgtgaatgatagtttcccagctccataatttgacaaaactacctcaatgttggatggagaatccttgctgcttacaatttcctggttgctacacgcaacagccctgttcctttcatgcgcaccagatacaccttcatgcttctgatcatggcgagcaccagaagtcctacgtgcatcttcataacgtgaaaaatagaaaatccaaaagacttgattagaaatgaagtaaagagctagcaacaagccaaaaaaagaatataaacatgacagcaacaacaatgacactttctgcaggaagcaaaggacatctctagaatactccaatattgttcagtatcactagacaagcatgctcgcaacagagtagaacagggatttaaaggactgacatttgtacagttattagagatcaaattctagaccaattctttgccaggagatatcaacatccagagctctagacctccctgccccatcccccaaaataacagacataagatcataatccctcagacatccacacataaaattctatatatccaaaaaacagccacatgtttttttttctttttgcaaaaagtgtatacgatatgtgaataaattccacaaaaacaacactacctttcacaaaactataaaaatcacacttctaagcaacaatttcagataactatgtgaacttactctctctctatatatataccattatagaggtatacgtccactctttgaccaaaattgacaacacaattcgaaataatctctggccaaatataaatggtctttaagttaatagtcacaatgcaagattttcacaacttctctgatcgcaatatattggcaacaacattatatcaatattagtttttttcgccgggaaggccgaaggaggccatctgaatatcaatattagttttacttttggatatattgacaaccctagttcaaaaggagtgaccacaaaatcccacagaaatattacttaaataacgggtctttttcaaatccaagtttgaggatcatgattcttattgtgaaagtagtagtaaaaaattctctttaaataataatgcactcatgtctagcaaaatgctttacaatacacgcttgctctcaaagcctcaacaccccattaactggaatttatataaagtattcctttcaactctaaaccataagtaattcatcttttttttaaaaaaaaaacgctacagtgatgtgtaggtaggaagctgattaacagaccaagactatattaacataatgttaacaaattgataaaatagcactgaagttgacaacaatacaacccaacaattaaacttactccatgaattcccaacaataagtagtcattaattttggatggtctatgaattaacagcattatgaaagtaaattgatgatggacacactaatattgcttttatgcagctgatttagatacatttgtcaaatttcaaaatgttgttaccgcaccacgcccaaaagatgttttggaacggatagagtggagagaagaatatttagattagcacactcaggtagacaacattaataggctgggcgacctgtatgttttagtttatacaataaaactagattaatttgtgggaatccatcaacaaagcattaaaaggttagcattttcatataaattattaacactatgtcgcctacaaagatattacctttgcgagtactgggggctacaacttgcggacaagtagttgctactgggacctcaaaagtttgaaggtcttgaccatggcataatacagcagaattattttcaacaattgttgtattctttgcaatgctagggcatgtatgtggttccttgatcagtaattgtgaagaaggcaactccaagtgggccctggtgactttcttcccattaacagttcgggcagacagtgtgcctcgtccctgctgtggtggagcttcaacaaactctctattgtcattgccatgcatcttggatgtaggattttgagaacgcttttttgtcttaagcttcttgttagattggtctgcatcaagatttgtctcattagcttgccttttctgtccttcctggtacatcaccaaaacttgaatcaaatcaaaatggcagattaatgaaataataagatatatggtgctcacataataaagaataaaactacactactgacttaaagaaccaaatatttaataatatgccagaacaaagcaaaaagattatactttgggatctgaatcacaaaatatagcatcagcaagagccagataattatcagcttctatatgcacccagttgtaatcgaataagtttagtagattattcaacacgggcgcagcagtttcctttaggataccaatatcagccatggctctgatagcagcatcaaatctatccttggaaatctttggaggagccatcctgcttgcagtggaacaaatcagcatggcacattaacacgtgatatcctttgagaaagcaagtgataagaaaaaccatatacacatactaagcatggtatcacaaacatcttacgaatgtacaatgaagttaagattgtgatacattacgagaagttgtggactaagcacactaggctacaggaccaaccacaagagtactccaggtacaagctaacttatttatccttggagaagggctgtgcttattgctgaattttcaatctattgtgcatgttaatattattctttcagtcagcatttgaaatagattactcaccggataattgccacataccatctacttgattataggaaaaaattaaatattttgaggaataaacttaacaaatagcactataaccagaatggttatatatgccaggggaagtgactagttttcatgacacagcagtgcaacaacaggaaaaacagaaaatgagtaattcatactacttgagcagctgacatccaatctgcattattatctctccatgtgcatgcaaagttagacaacttgagcagcattcagaaatgtataccttgttcagtgttacatgaggcagtaatgttctgtaagatgtgtctatggtttagtataagaattctgagtgtgcaagacatgtcatatattcgtgaattattttttttttgctgagtgagatagagtttggaatcggataatatcatcggatgcccataaaaacaattgtattaaaaaatgctgagtaaaagaataactcttacgacaatcccgtgtcacccgttttctctttgccattgggtttggccattccagtccttagctgagatgtggaaactgctgaccctgcaaatacaatagtgtccgtgaacagaagcagaatacatataacctttagctcaattgttcatgtttctctgccatcagaatgcagtagcaaaaacaaacatcataaggaaatcatgctataaaactgtgtcagaaattggcacttttaggttatttgaacagtactttctgttcagagaactgttcaagctacagtagtaataatctctttttgaattgcagtagtccataaataggtgtataatgatcatttactaaatatagttataatgtaagccatagtgtcgagttgataagactaataatatgggcaagtggtttaccttgttcacaatggacgaacaagttcaaaaacatataaatctggtttgtagaggataggatttcctcaaaaaagatataaattcccttcttaattaacatattgaatacaaacaaagtaaaatcaatttcagatcatattagtcactggaaacggggtcagtggcagcgaatcctagacccgggaacgccatccccgttaagggaacgcggggtcattttcgtgcccaccttgtaaaaacctctcacaagtagcataccacgtttctcgaccccgttcctcaatcccgtcgacccgggaactttgtgactaacaaacgcaggaaattgcagtactatccgatcggtattgaatattggttttgaaatccagtctaaaactttacatgggtgaatccacccatttgatactacaaatatcccattgcaattgtcatggaaggaagtcgcagtcctatctagatcactcacatcaccaagtctattgtggttctgaaacataagaatgccatttctgccctagctatattatatcctgctgcatttgactgagttaatccaaacagttgcttaaaaaggcttcagcaaaaaaaaagtgggaaaatcgtagctacaaacctatggaaatatatttcaatatttcccatgcaatcattttctttaataaaacatttgatatctggtcaaatttcccacccaaactatgcgcaactccattaaagcttatttgaatatataatttattatatatatatatatatatatatattctttcttctattttcaatctacatagctataatctagaccaaccatgactagtggcatatatctttctctttttttacctcattaacatggtaatttctaggccttgagagcaaatatgttggctccatttaaccttcactaacttatataatactccctctgtcaaaaaaaatataaacaggcgccccctcgctgtcgctacttcctttggttggtcacccttaaccgttgctggatagcggaccgcctcccgagtcgtggtttgtcacacccggatcgatgtgttctttgtgatcaatgcgaagagacgattgatcatctcttggtcgaatgcccggaatcgcggcaactatggtgggttgcattcaaagctatcgggcattcggagtgcttaccgctcattaacactctttcttttcatggttgtgtgactgtcataagaagatggtcaaggaacatcgccggggtttcgacaccatcgcaacattggttgcatggacgatctggaaggaaagaaacaatcgagtcttcaaccagaagagcagaacttgggtggaggttgcaagggttatgacgggtgaagcggagctgtggcggctagcaagagctgcaatccctgttttggtagcccatgttagtggagaagggtcgcaaaaatttagttggagattaggcttttagttttttgttctcctcctgtaccctgtccccttcgttttgtctttttggcccgctttatacatacatttattccttcttaatacaaagatacgctcctcgtgtattccaaaaaaaaaacacttttggagtttttcccggacattaagaagaggggttaaattacattagggatggttgtgattggttgagatgggaaagtagatgcagaaattaaatgagggatggttgagatgagggagtaagtggagaagtagctatattttctgacggaggaagtatatagaatctagccttttgaacaaatacccaaggctgcattctgatatattatgaccttttgaacaagtactcaatgttgcatgcatctaattcttcacatagaacgcctccaactcccgaacaggaagctcacaagtcggcacaatggtggatttgggggcaatagtgccaaaggcacgcccagatctcacaaattttcacacaagaaaactaagcaggagaagcagccttattgtgatcagagcaacaaacgagcaactcaaagcgactgaacaggcacccaaaatacaatacgagcaaagctcctcaacctcggagcgatcacattcgcacacccaagcaacgcgggaggacatcgaaacttcgcagaaataggccgaagaaaaaccctcatacgaggagccctcaccccgcatcacaacaggggcggacctaacgtggtgcatggtgcatgtcccacccggccaaaaccccaatttgcttcagagaaagaggtgcgtatagagagggatgaggaggatgaggatgtgcgcgtacgggagctcaccgcggcgagggtgcggcagaggaccgccggcaccgctgccgctcgcgggatggggatcgtcgcaggcggcggccggcgggcgaggagacgggaggggaaggcgaggggactagggcgcgaggaggaggaattagaggcgccacctgctgctgcgatgtttgggcggtacgcgcttcttgtaccctcggacctcggtcggtctccctgtaacctgtatgtgtgtgtgtggatccactgccatcggctgaaacaaacccggtgcttcgggttggtgacagcttcatacattccattttgcatccgtgttaatgtgttagtattacgtacatcaaccgggtgtgtctgtcaatataacttactttctttttttctcaccttataattaatgacgattgatcttcgttcgtggttgggaggatatcctgaataggagatgaccattttaatccctataaggctgtgttcgctctaacgtgcgcacagaaaacagaacggtccattagtatgtgattaattaagtattagctaattttttttcaaaaatagatcaatatgattttttaagcaactttcgtatagaaactttttttaaaaaaaatacaccgtttaacggtttgaaaaacgtgtgcgtggaaaacgagagagataagttaggaaacctgagtaagaacacagcctaagtgtttttgtttgttggcatgggtggatgagacgatcgaaagagaaaatattccacgtagatactggataaacatatccagccaaattgaccgagtgagagtatcatatttaaccttgaacatgaaccaaacgtgcactttattgtatccagccctacaacttccttaacttgtgattaatctccattcactgtattcttattccttccatagatacaacgttcactactagaaaaagcatttttgcatatggccaaaagcaattttttcagacggagaggaggatcgcctgcagaccaatgactgtgaaaatcatctattttcgcagttggggcaatggcccgcctgcgaaaatccaataaaaaaacaaaaaaaatcacctcgtcgccgtccatgcgcatgcctcgccgccaccgccctcccccggcctcctccggctggatctggaggggaggggatgggagccgccgccgctgcaacgggagccaccgaccacacgcgcgcctcgccgccgctgccgcaccgggagccatcatcgacgtcgccgaccacgcgcgcgcctcgccgccgccaccctcccccagcctccctccgtccggatcggggaggggaagggaggggaggggagccacccacgtcgccgtccacgccgccgctgccctcccccggcctccctccggccggatctgggaggggaggggaggggagctactgccgccgcaccgggagccaccgatgtcgccgtccacgccaccaccgcgtccgcgcactccgccgctgcgcgctctaccgccgccgcgtccgtgccgccggtggagggagggaggggaggggaggggagaagccggtggagggagagagagagttgagaagataagtttggggaaatgagtggtggggaggggttggaggagtagataagtatcatttttttttgaatgtacgatttttacaggcggaccacataaggtgcgtctgcgaaaatagattttcgcagacgccgcttaagtggtccgtctgtgaaaatacagcgaacttcaccctgatttattttttttaggcagttatttgactccaaggttcatgtctacctacgaaaaaaagaccccacgtcaggaaaaatgctttttctagtagtggttgtaagaaaaagtatgttttatctatattcccatgtacatcaacaatgtagtttaaatgaacttgtccatgtctgtttgtgcgcactgccaccggctgaaacaaacccgatactttgggttgtacgcagcttcttgtttcatatttacattcgtgttaccatgtatatcaacggtgtgtctgtcaatatgtcttactttcctattttcttaccatttaattaatgaagattaatctccgttcatggttgaaatgatatgggctgcaggaat

SEQ ID NO: 44156 - DNA, 18871 bp, Oryza sativa
cagccgccagcgcgccgcctagcccggccctccgcgcgccacgccgccacgctggccgaccgggcctatgcgccccgccattgcagagggaggtggggaggagggagaggaggagaggaagggaggagggagagaaagagataagggtgactctgtgaggagatgagttaaaaaaggagaggaggagattgtattggtccaacccgcgtgcagccacccgcttatgtcgacttttttcccggttggtgagatctttagtcccggttggtaacatcaaccgggagtaaagcttatattgatcttttttcccagttggtaacaccaaccgggattgtaaatagatcttggactaaagatcaaaaaattcatcagagctttcaaactgggactaaagatgtttttattcccggtttttaatataaccgggactattgtgaaatctggtggaccgaccaaagatggttcctccaccagtgatgatactgcagtttttatactttatttgtttctcgttttataaagaatgtttcgatatttttgtttgtttgatgtttggtcttttatcaattaaaacagtttaaccatatctttttttttctttcttggatcaagcatccgacgatcgaagctacgtttttttctctttttttttttaaaaaaaaagaggacgactagagacgacactgatagaattgttgcaagttagatgctacaaaagtggagatggtttttcgtttcttgagaggatattatctctcatttcttgcatgccacttaaataaaacaagttcaagtttaaatttgacttcgataagttataataaaaacaaattaattttttaggacaaaaacaaattaaattgaaactagttttttttgcggggaaaattgaaactagttaattaacgtgtgtatatttgttataacttgtaaaagttaagggtgtgtttagttctttgggtgtaaagttttttaagtatacggacacacatttgaagtattaaacgtatactaataacaaaacaaattactgattccgcatgtaaactgggagacgaatttattaagcctaattaatccgtcattagcaaatgtttattgtagcatcacattgtcaaatcattgcgtaattaggctaaaaagattcatctcgcaatttacatccaaactgtgcaattgatttttttcccacatttaatgccccatacatgtgttaaatatttgatgtgacgtttttagccaagattttttttatctaaacaaggcctaaattaattttaacttacatgtttgcatagtgatatactcactctgtttcacaatgtaagtcattctagcatttcctatatttatagtgatgttaatgaatctagatatctacttacattgtgaaacggatgaagcatgtatcttttactaatctatcttaccagtttttttaaaaaatattttaattactatttagattacatgaaaaaagaggtgatatataaatctcaacagatgaaaacactactactgtcccacgaaagcaactgattaacccaaaaataagagaccggatcggagacggcgccgcgcggtgctacgtacgtgaccgagtccgagagtgactccactcatcgtaacgcctacatactatcctccgtgcttatatacttcgatgcacgtgcgcccgacctcttcggctcttcctcgtgttacccaactgacacgctcgtgaaaggcctcgctcactaatcactatggagccggaggaggaggaggaggaaccaaacatgtacaactcggaggccggggaggagaaccacgtcggcggcttctacgagtgcacgggcctccctcgcgacgcggatgggttcgtcgccgccgtccacgaggtgaacccggtgcagttcctcgccggcgtcttccgctacctgggcgaggacatggcgggcgagctgctccgctccgacgacgacgacgtgctgcactgcccgagcatcgccgcctcttcctcgccggaggagctcctcgcctgtgccgcccgcgcctacaccggccgcgaccgggagcgatgcggtggcagcgtcgtggagcacttgtacatgatctgctcctgcttctgcccgcacgcggcgacgacggcggctcatgtgtcggcgcccgtcgtcgccggcgctgatcacgtcccggccccgtgcgacgacaacggtgtcgacctggcttttacgcaggacgagttgaccgcggcggcggtgaccgtgggcgaagtggacgaggacgaggtggccgtggcggcggcggcggcgacagtggacgcggccgtagacgagatcgtcctgaatgcactgggattcaatgagtttgctcgcgacctgaaggagaccatcgaagcaaaggatcgtgaggacgcgttgcgcgcggagggctcgtcagtttctcccggcgttcgtccaccggtgtagccgcgtccgcgttcgtgttgtcgtgtgacatgtttccgcccttacgaatcggtgtcgtaatagctgtggattttttctggacgtccggagttggaggtgtatgctgtagtacgtaatacttcagttaacgttttgcacaaaagttttgcgctttggataattgaatagttatccaacctaggtctgcttataatccatcaccaatataggtctgcttgtagtccttcaccaacacagatatgatggttcgtgccctatcaaacattcttttccttgcaagctaactatactactctctttgattaaaacaatgatgtttaacccctattaaaactcttaaaacgttcactattaacttatctaaaaaatacttagctccaaaacataaaaaaaaagatgggtatatttattttgattttgtaagcttagtggatcttataaatttaacttttcaatagaaaattattgtcaaagtcacatataaaaataccttaaaagagttaaacgagctgtagtacctccattatgaaaattcacatttatgacaagtggtttgaaattccctaagaaaatattgttgtattggatgattacatatgtagaaaattgtttttgtttctcacgatgtgactttgtggctcatgttttacgagattcatctctctctctcttgtatgcacgagcaaatcaagtcgcgcacatggctggcccaccaaggcccacgtcacgctctacgcagtgaaacaattcagtcggccacgtgcccacatgtggaccccagactcatgtgattgcgtttctcccgtgcgatcgtgctagaatttttatgttttttcacctatttttattactgactttattttaatttcccctataaaaacatacaaataataaaatttattgttgttttaagcctttgttgaaaaaagtggcttcatgtttacttactacagtaatttgattgtaaagttttaaatttaagttgaaaattttattaagttggttgaaggttttcaaatttgagttaaaagttttgaattttaagttaaaagatttcaaatcttcagttgaaagttttcgaatccaagttgaaaattttaaatctgaatttaaaaatcttcaaatccaagctgaaaattttcaattctgagttgaaaaggttttaaatataagttggaagtttataaatcttcacttgaaaatttttaaatctaaattgaaagttttctaatataagtttaaacttttaaatatgaacttaatagttttcaaatctaagttgaaatgatttcaaaatttcaaaatttgattcagtaaaaaaaagaaaggataatagaaaaaagacgtgtgcggggaatttttttagaaaaaaaaataaaaagtaaaaaaccaagagacacacgcgggaggttagcgagaaacgcataacaaaagtgggtccaccactttctttcaccccgtgcaatatttccaaaaaatggtgcgtacgcagttacgcaccaattagccacaccctaggttctatcataaatcacgatacaatcttattcttctttgctcgagatttgtgatagagcacacatcacaataaaaattgacgctttcttaaaacaaaaaaaccttcaggtttgactcccgctcaggcgcccgatgggaggaggttaaaatcgggcgctgacggcagcgttcgatttacgtgcaaaactactttaaactgatttttctcttaaattacttatccaaatcatgatccggttgcaccattaaattcgttgtaattaaatcttcgaaacaaggccactcctagatatattccaaaaaaaaattagcttattattgaattatttttaaaggttgcacgatattccattaggtatattggaattgtttcactaagtagatcgaaaatgtttcactcgtttaaattagatgttgtttcaccttatataaaaacaatgtttcagcaaatagcgaaagaatgtttcagttcattgcaacattagatctatacatagtgaaacattgtggtacactaggtgaaacatttttcagtggaacaaaaaaaataaaccaaattcccttaataaggagtttccaaaatatgtgggggtttttttgcaatggaaggtttcgttcactgcaacattagatctatgtcatagtaaaacattgtaagtacactaggtgaaacatcttttgtggaataaagatgatggataagtgggtgggccaaacaggtgctcacgtgggggagggcgagcgatcgattttcccacctccccggtagaccgatgctgggcattctccggttttatcacaaatcgcggtacaatttttctttgtgtttgcttgagatttgtaatagagcacatgtcacaagaaaaaaaatgacgctttcttagaacaacaacataacaaaaaaacaaaaacccatccaaagcttaagcccacggacgcggtgcgagtgtgcgacgagcccagagaggcaaaccaaacgtccaaacctccgcacggcgccgccgcacgatgcccccggcgccaccgttctcctcccacggcgacttcgtcgccgccctccaccgctgcgccaccctcgcgcacctcaagcagctccatgctcacgccgtcgtcaccggccgcgccgccgcgcagaccaccaccttccacctcctccggttcgcctccctccgcctctcctgcctcccctacgcccgccgcctcttcgacgccacgcccagccccaacgtcttcctctactccgccatgctctccgcctacgccgccgcctcctcccactcgcaggaacacgcccgggactccctcgcgctcttcctccgcatgctccgccgcggccgacccgcgcccaaccagttcgtctacccgctcgtcctccgcgccgcctgcgccattggggtccagctggtcaggtcgatccattgccacgcctgcaaggacgggttctacgggcacgattttataaggacctcgctcctcgatgggtactcgaggtacgggatgatgggcgacgcgcggaagctgttcgatggtttgactgataggaacgtggtctcctggaccgcgctggtgtccgggtatgcaagggcagggaaggttggggatgcgatagtgttgttcgaacggatgcctcagagggatgtgcctgcctggaatgcgatcattgccggatgcacacagaatgggttgtttgtggaggcagtggggattttcaggaggatggttgatgaggggttccggccaaatggcaccacagtatcttgtttgctgtctgcgtgcggacatttagggatgctgaagattggaaaggtgatccatggttatgcgtggaggagctgtgttggttttggctcatccgttgtgaatgggttgattgatatgtatggtaaatgtgggaatttgatggaggcaaaatggatctttgatgcgttttctgataggggtctgaccacatggaattctctgatcaattgccttgcactacatgggtgcagcgagagtgccattgcggtgtttaattcgatgaggaatgaaggggttcaacctgatgaggttacttttgttgggctgttgaatgcatgcacccatggagggtttgttgatgaaggtcttagatactttgaactgatgtgtgatgagcatggaattgagccagagattgagcattatggttgtgttgtagatcttctttgtcgagcaggacggtttcaggatgcgatgaattttatcaatgatatgaaagttcaaccagacgaagtcatttgggggtcattactcaatgcctgtagaatacacagacacctagaactggccgagcatgctataagaaacttgttggatttgaatccaagtaatgctaattatgtagtgatgcttgcaaacttatacagtgaaggtggcttctgggaagaggttaggaaagtaaggaagctcatgaaggaggatgttacaggcaagaagctgcctggttgtagctggattgaggttgatcgcaaaactcgccggttttattctggtgatgatggtcaccctgagtcagaggatatctatgacactcttgataagttagctaccacaatggaaatgcaggctacatttgcatagattaataattcatattcaaaaatcagcatcttctaattctgtacatgactgaaactgttgacctaggcagcattatgctggtagatagatggtcgtgttcccttaaacacttaccctgagctatttatggctgaggtactgcttatatgccactactggggtgtacttctacaggatttatccattgtaatgctgttatctttgcatatcatgaaggtatgtgtatattatggatggccgaatatgcttctgcttactcccattttgtatcccacacctggtgatcttttttcttaattctgtcttcagtgctgccactgtgtttcccttggttcggaagtaacaaactgtcctatctggcatgtaatacctgctgctgctcaaccattataggtatggataacacctctatgtcggtataccatgaccaacctttgttttatggtccagtcttcacaaaatctacgctcgctgataatttgttgtcaaatgtcaacagggcatattcttgttctttttccccctcttgtacaggagcaccaaagtaaaggagacataagctaaagatggagtgaagaacagatgataaagagttttctataaactaccatttttatctgttatgcaggtaattttatattaattcaatttgtggagaacccttgcaaaatgctttcattatcaagtactttggacttttgagcctggactaacgaaaagcattacattaacagctggaatagctggttgagacttgagacgagggatatacggaaagctgcaatcagttgcatattggcctctcattatcatgtatgattgtaggagcatggttcaaagaatatgttctgctccttatctgctttgcagtaagaccaatacacattttatcattttatcttccatatcttatctcggtttctcttgatttgctctcatgtccaccatttcctccctccaattcaaagcttcttcttgtttaaacttattatgtaattcgttctaaattggtgggttctcaatctatcatctttttatcctgtctctgcaaggtgcaaaaaggtgattctttgaaagaagattctgggtacggagggaattgcgactgacgagatgcttacagttcatctgctcatgtgatgtgtcacatggcagaaaacatggagaaatgagcgccatacgttgccatgctgcgattctagagatccagtcatccagacagtggaaaggggggtcgtaaaggatggcgcagattatagaataaccatacagagtacaattgaaatggaccaacgatgaaaggaaggaaatctgagaataaattccagtgcagtgccagtgtcagtttcccggtgccatgcctgaccatgtaaattgcgatccgtatgactatccaaaagaatggcaatggctgtagtcctccgaatttagtgagttgaaagtgacttgtgagactaaataaaatataagcgactggcaatggctttgatcctgtagccactagccagcgataactgataagtgcagtaatgtctcagacaatttttagggcgagaacttttatggtacaatgtactgctagtatatactataagtatatatgatctaacggtgtagattgatttgattttttagttaattagattgcagtataaagtttgaaagggtaattttgtcttttctttgttattctatcatcaaatcatgctatcgttacgtccttcgtcatccaggaccaggtactcccaattagattcaatctgaacagaaaattactaaagagttattttattttctatcaaattcctaatatgcccttctatatactgtcagtatatactggtagtatattgtaccgtaaaagttctctcgacgagcgatgacagtggatcgaagattggccgaatatgccatgtttgacagtggatcgaagattggccgaatatgccatgtttttggaagatttactccttctgatgttccaaagaagggcgcccttggcatgcatgtcagtgctagggtatgcttagaagagcttccggcggctgtatcttataatcacaagtttcctcaaacaacctagtttttcatccaaatttggagaaattacggaatccaaaaaataaaagcaagtttttacagcctttttaggttcttaccaacttcttctaagaatcttagaacttgtttggcagagctctagctccagctccatctttcctatagctggagtccaaccaaacgatttcagctctacccaaaaagggatccatctttcttatagctggagtccaaccaaacgatttcagctctacccaaaaagggagtggagctgactagagtactctcgtaaaaatgaactagagaggtgaaactggatttacgcagctcgacaactccactacagacccaacttctaaagttaaatttagaagttgaagctctaccaaatgggaccttaaactcccataaacatgtcctaagcttagaatctaaaactccttcaaatgtccaaaaaaaatctaatcgtgggaatctaggattaagtttttttatgagacagaatgagtatgtgcctctaaaatctctttaggggaagaatttttttaaaaaataaaagaaccggaggactgccaataacattacaaagatagcttgcatgtactccttccgtatatgtgcatagctagaaataaggtcttttagggagttatgctttgagattatttggtgacctacgatttacaattttcattgcattttgtagaggtcatgcacgcttatatacagtggtgtgaatgtggcatgtgtgttaagtatatgcatccaattatactctcttgaaaaaagaatcatttttaggaagagtacaacctatgccctacaacaattgaagcttgaatcaatatattttgtctcctacattcttaattaatcggagcatgatcagggcatcagtagcaggtaatacctaaaagggtactagtgatgactgatgaggtccacatgaactagtaagttaaaattatcatgtactaacacaatgttaagtacaaggaccaccaagaggttgagacttaccagtgaggtttaaaagatcccatcatataactattaatttggagacgtttcacatatacttgaaagttgcctaagtgtgacaaatgattggcatttcctttttaagtctttaagtctaaatacctcaagtagctttcaagcgccataaaaaatcacgggtggaacgagttaagaactaacctagcctggagttcctccatgaccttatcactccaagacagaacgacaaggcgatcatttcaaattctaatatcatgagcctagcctccctccggtttcattttaattgacgttttgaacaatgacacggtctacaagatatatttttgaccttatttttctattataatatatataataaataaatacatatttatttttattatagtgctttaaaagacaaatctatatatgttgttctagttcctttaaactaaatatttttaaagttattgatggttaaagttataaaagtttgaccttaaccttgtccaaaacgttaattaatatggaaccaaaggagtatcaatactaatatctcctttggaaacatgaatttttctctcaattcacgcgatcattgatctaattcattaataaaatcacatacaacttcgataaatttgttcattctaagggtccctttgaaacataggaatttcaaataatttggaacgaaatgtatcaattcctataaaaatcctataaaattaaatagggggaaaaactttgcttccattatttgagagtgcaccaaactggcacatatctctgctcctgtaccggtccaaagtcaaacgttaatacgttatatgcattctcctagcagtcgcctatacattactgaacacgcattcgggaagtacaaaaaaaaatcatataagtggtgtacaaactacaaataccacagttgtcaaccttttatttattattacgtatggttttttttttcaacctgatagcaaacacgggctctctcctcatgtggtcacccgatcattgacaaagaaaggtagattatacccgtttccagtttttccacctgacaattatatcacacatgatactttgttgtacaaagcaaagctctacttgagagttgagataaagggatttttgctaagattttgtgtaaatttatatcaaatcttagtcaaatcccctgttccaaacagatgatctcagataaaaaatactactatctttttcttcctattatacaatcacgaaacctgcagcatcagatcaaccttgaaaaacgcttatatgcatttcgttcgatcgatgatgctgcatgtatgtactactagctcagctcctccggttccactagacatggcctcccatctcggcggcgacctgcgtgccgtgcgccgacttgagcatgaacccgccgacgctgcggtccggcttgccgctcgcgtcgtcgtcgtggtacgcgtacgcgaacccgccgtggcgcgtctggtccatgccggccatctcgtcctcggccgagatgcgcagcaagcccagcttgttgagcaccaggaacagcggcgccatggtgaagctcacccacgccgcgatgaccaggatgaccactatgtgcgccccgagcagccggccgccgccgcccatgaacagcccgtacgggcgcccgggctggccgaagatctggtccacgtactccttgcgcgcgaacagcgccgtgaagatgaccccccacgcgccgcacccgccgtgcagctgcgccgcctcgagcgggtcgtcgaacttgagcctcgccgccagcgcgttgaggccgatgagcacccacgccgagacgaacccgcagatgatcgcggcccacgggtcgacgacggagcaaccggcggtgatcgccgcgaagccgccgaggaggccgttgcagacgtcgatcacgttccagtgccccgtctggagcctcttcccgaagagcgtcgtgagcgccgccgtgctgccggcgagggtggtggtcacggcggtgcgtcccaccgccgaccactgcccgtggattgctaccgggcgggccgtaggatttgaggatggtgaggaacgagccggggttaaacccgtaccacccgaaccacagaaggaagctgccgagcacgacgagcgacgcgctgtggccgcgcagcgccaccgagcggccggcgtggtcgaaccgcccaatgcgggggccctcgatgagggcgccccagagtccggccacgccgcccaccatgtggacaacccctgacccggcgaagtcgatgacgccggacccgaagagcagcgaccccgacgtccgggaagccgaggcccacccgtcggcggaccagatccagtgggacaccaccgggtagacgaagccggtgaggaaggcggagtagatgaggtacgccacgaactgggtccgctcggcgatggagccggacgtgatgcccgcggcggcgatggcgaaggcccactggaagaggaagaagctgtagtcgaagccgacctgtgggacctgcttgaggccgaagaagtgcttcccgatgaagccgttggacggcgccccgaaggcgaaggcgaagccgaagaggtagtagaagagcgcgccggcggcggcgtcgagcacgttggtaagcatgatgttcatggtgttcttggcgcggacggacccggcgcagagcatggcgaagccgagctgcatggcgaacacgaggtacgccgagaagagcaggtacgtcgagtccacggccgacgtcgtgtccgcgaactggttgcacaggtagtccgtcgcgttcgccgccgccgtgcccagcagcgggccgagggtatccgcgcacgttgccatcctcgccgcctcgacgcgcgctcaacacagactgtagaggagaggggaggagcaatggaagtgtgggctgtgggtggagtggggagcggccgcgtcggatttataggcgacgtggagagggagcgagaaggaatccatgacttggggggtgtcgttgttgattccttcaaagtgtgaagggcccacctgccagtgaatctttggctacctctgaaatgtgggacccctatgatttgcttgttgatttgtccccctcctgttcgtggtcgtagttcatcgaatcccgtggaatctctctataggcctactgtaggctgcggcctggaggctgtgtttagttttttgatataaagtttttgaagtacacgcatacatattttgaagtattaaatatagactaataataaaataaattatagattctgcttataaattgcgagatgaatttattaagcctaatcaatatgtcattagtaaatgtttactatagcatcacatggtcaaatcatgacgtaattagactcaaaagatttgtctcgcaatcccatatttaatgccttatgcatgtgtccaaacatttgatgtgatatttttggctaaaattttctgggatctaaacaacgcctgagtcgcaatacagtggtttgtactttcttttaaaaagtaaaaacgactgtttgtacatttcgtcctcctctatatttgtctatagtgaagcacttgttatatttcctcctctgtttgtacttaaactttctttacttttttaacaatattatttttattatatttccacttgtaacacttggaaatattttataatttctaaatctaattggttcaccatgtttctaaagaaaattttggttgcacgaaaagacacacatgaatatgttaaccaaaacacatgaaatccttcaagctttctgagtggtactatctccatttcaaaacatatgaatttctaaggccctgtttgtttcagtttaagattattataatatatattattgagctagattactataaactgaattataataagattataataaaccgatatagaataagttgttagctgtttgtttatctggattattagctgtttgctagttattagctatccaataattaaaaaaagcacctttagagtggattaccagattatagtaatctggcttatagattataataatctatcataataagttatctgtttgtttcagcttactcctaataataatcagattataataattctaagtggaatcaaacaaggcctaaattgtttaacaaacattgaggttaggtcatagtctttttttactttagtatagttaattttttgaattttgaattgcttggattccctaaacccttccaagcatatgattagctatgaaatcattgagataatcggaatgatggaaactactacttatattgtgatgcaattgaattctaaaaatccttatattttggtattcatggagtacttttgaagctttcaccaaaacacagggctacgaattgaacccaatgattaatgttgtgtttttcctgtaactctaccatcatgtaatgattgtcgctctgcctttttaagcggctggtgctggttgaacgggaaagtattttctgaacctaggtgagctgcacctaggctcattaccgctagatgcgcctcaagattcggacgtacacgatacccacctgctatatgtgagaaacctgagaaatcatcacgaatcgcttaatcgatcgggcggcagacgccctaggtgcagctgcacctaggtgtagaaaaaccgcgtccctgttgaacatgtactccctctgttttttaatagatgacgctgttgactttttctcacatgtttgatcatttattttattcaaaaaaatttacgtaattataatttattttgttatgagttgttttatcacttataatactttaagtgtgacttatatcttatatatttgtataaaatttttgaataagacgaatgatcaaacacgtgagaaaaagtcaacggcgtcatatattaaaaaacggaggtagtattatcgttcatggtacttctctacccacctgaaattttcgttgtctatcatcgaagaagatcagccgttgcacctcatgctcaaagtgcaggtgctcgcgaaaaagtccagcacgagaattcctggaaatcttttataggagtacgtacttctctaactgtcaagctaacctgtacaagtgtgcaccacccaagtaaataagccatcgcagctatctcccattttgcaccggacttttggaaaccacagatcaacgtatctcctcattggcacaccacctgtcgataggcagctcacgcacgacgatgcgaccatcgtgccgaccgcgagaccacggcgagaggcataaaaacaaccgatcccgagagggcaggcatatcggcgtacgcacgcagcccggtgagacccgccgcagttggagcgcgcatcgccatcgccgcgagcccgcgaagtccacggcgccctcgtcggcggaacaccccagttgctgacgagactgacaggtgacagccgagacagccagaaaagaaaaacgaagccggctgtactaacgacatcaaaaagaaatgggagccccgtctgtttcagacgtaatggcaatggtaatactaattagtaataagataagctcccagttgacgctccacaactagccaatttccatttcgcatgttcgattattccccctgacctccatgccatccagtgtgcatcttccgtgtcccgaagagctgctcccgagtaaactatgcctgaatccagagtccggaaacacatatgcggtgtctggatctgccgttgacttgtggattgtgattaaggaagtgttctcctctctgtttttcgtctgacatcaccgtcctgctgccgattatagtattttgagtttacagtggatttggcctctcccctcatttgctgaatcttatgaaaatgttttagctgtttgctcctgacagaatagtgtgacctatcatgtgaaacgcgagcgcaattgtactgtactatcatgtgaaacggagtatttccgatttcaaaccgtattacctgccaaccgtttcatggtgtcaggggtacgcgatccgaggaggtcgtatattgtactcattgagcactagtttggcgtatcgtaacgttgagcttcatttagaaatcagaatgtacagaaaaaaagagttcgctgcctgtgattcagttctgaatctgatcgagctcacctgcatctgtgctcgagcgttggttcgtttcgtaatttattgcagcttgaattttgatgacagctgttactgtttctggacccttcgagatggcgattgctcgagctcgctacgtcaacaggagggccgttgaatttacccattttccacgcttgcgtacgtacgttgcggcggaggaatcggcttgctcttgttttcttttttaaaaaaacgcagatatattgtttttttactccgtacctctgatccaactaaccgtatgctgtatagtgtatatacagttcttatcttaatcaggaacacggaaatgtcgccgtcgtgatagggggggccgagaaatcgaaatgctcgagaggtgggggtggtacgtcgtgtggtaccgtgctgtattgtttttagttttccacgttctcatgatcgcctcctgggcagccggcttctatctgtggaggaagcaccacggagaggagcggagagggagggcgcggatcatcaacggcgagccgcgagccgcacgggaagcgcggcacatgcagatgtaggcaatggcgcacggcggcgcggcctgaagccctgaaccgcgcggagaacgacgctctccgtctctccgagtcccttccgtgcgagaagccactaccgcacggtgcgcgcggggatgcagccatgcaggacgaacggggcgcgcgggggagtgcaggccgcagtccgcagtccgcagggcaagcggtcataataggccgttcgcagaagcgtaaggaaggcctttcatggctcatctgtcacttgggggttgggcggctgggcctactttgcgattgggcctcagccatacgttccttagcggaaaaagtacaccaaaggtccctcagcttgtcatcgggatagaaaaacgtcctcgaaccacaaaaccagatatgcggggtctcttaactatacaaaaccgatcacgcgaggtccttcggtgattttgattccgattttagtctatgtggcagctgagtcagcgtgggacccacgtgggtcccacatgtcagactgtccacgtcatctctctctttcccatcttctctccctttctcctctccatcactctcttgttagggactctggtcaggccgacagccgatcgatgggtgtggaggagggggctgaggcgcagctgttgcgacgtggtaaattgctcggctacctagcgacggcgggagcagggggtgcggagtggcgtcggcattgcgcggggaggctggtgcggcgcgtgaaggtgctatcggcgggccgacgcagtgcgtgaagacgtggtcgacagcgacaagaggccagcttggctaggaggtacagccggcgactgtgcggagagcgggtggacgcgggaggcacaactacagggggcgtcggtggagcagtgtccacgcgtcaatggaggatggttgatggtggagcaatagagcgttagctatggatctacaagggaagagcgacccagtgtaaacctagcccgatcttggccgggccaccaacgatggcgctttgggcgtcgtcttccctctcagaagtgttgtcgagccatcctcttcctctaactaggctgccgcgtgaaaaccctgtcttggttctctctaagaccttgatggagaggagcagcggtgctcatcgtcgctcttctccctagagatgtcgtctaggaaggtcccttgccaaaactcctcttaggcagctggtgcatgctcgctctagatgtcttgtgctcttgtgacgatgctctaggttatgcaagtcgaccacgttggcgggccctaggagggagagtagttccttcttctctctcaccctctccctctcaatctcaaatacatggctagaattgagatcggtggtcaaccgtagggcttggttttgggcggtcttagctgtagtttgcttgttggtctagtggcgaccaatcacgctttgcgatggtcggtccagtgcaagctttctcctgaactatgtgtatttgttgttagtgcgtggtggtgaaatttttttcttccctttcctggctactgtcttccaagatactagccttgtactactattcaacgaatcatcgtgttgtctggtggtgctgatcgttaaaaaaaaaacttgtagtactactatagcagtagtctagtacaagctagtttctccataggaggatactttggaccatctcgcagcgattctcccaaatggcatatgccgagctccacgttaacatcataatgacctaaatactgatacaaacaggacacgtctaaacatgtacaagaaagccacaaaaatccatacaggtgcaaatgcagagaagaaaggaagcaaatatcaaaagaaagccacaaccaccatgggctgaagtgccaccacgcccacacgactgcctcagcttatatatgcacacttcacaaaacactttccccaaacggacacgatcgatatgatcctactacacaaactggcccgccgcggcttgctccggcgactttctgggctccacgcgagccgtctccgccgccgacttggccctgacgcggcgctcgccttcgtcctcgtccacgtacccgaacccgccgtggcacgtcgggtccatgccttccatctctgtcgcgggcgagacgcggagcagcccgaacctgtgcagcacgtagaagagcgtccccatggtggcgctgacccacccgacgatcaccaggatctgcacgatgtgcgccgcgagaagcctcccgccgccgcccatgaacagcccgtacggcctccccggcaccccgtagatcagctcgacgtactccctgcgcgcgaacagcgcggtgaagatgatcccccacgcgccgcacccggcgtgcagctgcgtcgcctccagcgggtcgtcgaacttgagaatcagcgacagcttgttgcagccgatgaggacccacgccgacacgaacccgcagatcaccgacgcccacgggtcgaccacggagcagcccgcggtgatcgcggcgaagccgccgaggagaccgttgcagacgtcggtcacgttccagtgccccgtcagccatctcttgccgtagagcgtcgtcagcgcggcgacgctccccgccagcgacgtcgtcacg

SEQ ID NO: 44157 - DNA, 43989 bp, Oryza sativa
gggttgaagccgaaccacccgaaccacagcaggaaggtgccgagcacgaccagtgaggcgctgtgccctttcatcgccaccgtgcggcggcggcgtcgaaccgcccgatgcgagggccctcgatgaaggcaccccacaggccagcaatgccaccgaccagatggacgacgccggagccggcgaagtcgatgacgcccgacttgaacagcaacggacccgtcaaccggccggccgaagcccacccgtcggtggaccagaaccagtgcgacaccaccgggtacacgaacccggtgaggaaggcggagtagatgagatacgcgctgaagcgcgtccgctcggcgatggaaccggacgtgatgccggcggcggcgatggcgaaggcccactggaagaggaagaagtcgtagtcgtaccctgtctgcggcatgtgcttcagcccgaagaactgcttcccgatgaagcccttggacggcgtcccgaacgcgaaggcgaagccgaagaggtagtaaaagagcgcgccggcggcggcgtcgagcacgttggtgagcatgatgttcatggagttcttggcgcggacggagcccgcgcagagcatggcgaacccgagctgcatggcgaacacgaggtaggccgagaagagcaggtacgtcgcgtccaccgcggaggaggtgtccgtgaacctgttgcagatgtagttggccgcgtcggtggagttcgccgcgccgccgagcagcggcccgaggctgtccaagcacgtcgccatggtgtgtctcactagccaagtgtggcaaggttttgtgctgcttcttgctagggtttaggaactaatggaggttttggtgtgtgattctttgaagtagacgagagaatgagatgctggactatttataggggcagaacacattggaatccatggttgatggttgtttttaattggatgattcgtgatcacagacagcgggaaatgcaaaaccgaggtgcgcgtggatgcatgtatactgttttggattccttctaacatgggagtggattctaatacctcaaggggatatcccctcgtatacctttttcttccaaattcgatgtaaatagctatggaaaaaatctgaaaaaaattaacaatgtagagtataatgatacctactagtccaccaaaattcatattcaaattcgatctacacatcgagaaacaaaaaagacaaatttagatataaacagtacgctactattcatacgctgaatttgtcttttttatatctcgaagtgtgagttgattttggacttaagattttgtgaagttgtatatatgtgttgtatgaatgttgtcaatttttttcagaatttttcataaccgtttagatggtttttgagtaaacgagggaacatcccctcgagggattagaatagtttcccttctaacatcacatatactagtgcctgaaaacctttttttttcttttttgccaactgcaatgagttgattaatttttttagtggcagcaaccaatcttttcatccaacaggtgtgatgagtaaaagaacgagcagttcacctctattaatgaatgattgaatattactgagataattttatcatccttaagaatacattgcagataccattttttaatgtaaaatttggcacatacaattacttttttttagtgaattaaatttctcttgaaataaaggtacgctgcaattttatttttttgttttgaaatttcacaaaacaagatttttaactgatcttgatatcatatttagtttcatgtataggttggttcattcataaatttaagttcattgagaaagacatgtgattcacttatcttcaaaaattgtcagtgatgatttaatttgttacctagacgtctcggcgctggtgttgtaagactgttaaaattatcccaataggtttacactggttttgcgacagtgatatttgttttgtttttacttaagtattgtcttgacttttgatgatgagcgactcaactagcctgagttcccgctttgctcagaaagtttcagacatcagtaatttatgctgggttgggagtatccgacagatccaagcaaggtcgcatacgcaagatgccagattcaactaagatccaatgtcactatcagaaagtcgtgttgttgccatcacagctaagattcttttatgcattcaacattttttaaaggaagattcagaaatgttcttgttattatatcgtctgaagaatcgcattttgtcaacttcaagtattacaggttttaatctggtatctcctcgcatccttgcacgaggtagttgcttgtcgtcacgtccgactatacgcatactgttgtgtcatgaagttgcatatatacaaccatatacttgtatgcgtaatatccattgactttgttgattaactgtttaagttcttcaggcatgcatgtaaacccagcagcggataggtcgtacctagcagaacatggcgacaaaactcatcaatcgagatggtatatgatgtgtgcaatgcgtacttagcgaacgattagatattcgataaggttattggcacaaacggagataaacccatttgcttccataccataccggcggcttctgtcttggaagaaccttgtgattaatttgcctccctgaagaactcgtgtctgactgaaaccatgtaatcaacaggtagtccatgctaaacctgcttgctgactactgagtactctgtaattgtcaatcagatctctgtgttggtctggctacattaacctgtacgatattttcactgaaactatatgttttaactcactgcaaatttatgttgtttgtcttcagaaatgagggtgtcaacatagattaaccatgtattcttacttcttggcatagcagtaggtaatttcttccagtagaataaattcagatgatgaagcaattccttaggtcaaaactctgacaagactggataagatgtggtggatagggacgcaattgcttcttccttgcaagtatgacttgcagatgctgcgtatctaatttttacactctggagatagatcacgctgatgcgattaaatacctattgttttatacttttgtcgtgcctgctaccacacctgtatgcatatcagaaggttgaccttcagaagttcagagaatggacggatctctagtaaacgaatcgccattggacggaaacgagtgtttcttattagcaaattgcaaaccgggtgtcctcagcgagacgttgatgtctagtgacaaatagttttcacggatgagataaactagtcttctcggctccagggatcaaatgtcaataaacgccaccgtaaaagattttttttctcttcttacccaaatgctactcttgacttattgataaaccaatgtacagaaattgtactgctcgttaagtttatgagatatactagtcacggtttctgccttctgccgcagctgatttggggatctctctacgttactgttgtatgtgtatttcagtcacccctgaacttatctgaagctttgtaatgcttttctgaaacttttcacgggctttgtaattgatggaggcccaatttcaggcccatttgaactgcacttatctttggtcttggcgtcttgctcacagctgggccacatctgttcatatgtagtatattttttccacctcggatatctgcagcgcgcgcgagagaggaacagagcaactcgccaacaagccgatgacgacaacgcaaagcagcctctgttcgcatcggcgatgacgcgaagccacaaaccgcgaacgcgaccgatgcatcgccggatgcggccgcgcgcgcgagccgagggcccaacgcttacgtccacccgcgcgcacggagtcgtggccgtggtcactccaccacagctgcacggctgggcggttggccggttgcgcagcagctggttaaaattggctgcacggcggcatcattcaaggcgttggagtacgtagacaaacaggttcccggtcaagatccggtagctgagtggagctccctggtcaggtgtacaatcttgtgcggctatcctaaacagcgagataactttggatgatgtcaaacataatactgacattgaacaaaacagctggctacaaaaaaaaacaccttaattggctagacatggtaatttaaccctgcgcatcaaacaaagaaccatggcaactactactccacagtccacacatgtctcaggcagaggcaggcgacgacaaagagtacagcagcgtattcaagctgggaagcgacagccgacaggcaagggtgctgcgaagaaacagtagctcctgcaaaccgtgaggaccggggtaatgcagggtctgcgggtggcacaaaagctaccagcagcacgaatgcgctgggaacggggagggcaccacagcaccattcgtgctcagcctcagcagcagcagcacaactcgcaacgatatccacacaaacagagtgcccggccaaaaccacagaaaaatcaggggaaaaaaaatctcatgctgatccagtgatcctcctgccggccggctgccagagatgagagatgcaaggtatggtattcatccattcgtcagtcaaaaggcactcactgaatgtgagtgaatgcacaccgagagagagagagagagagagaggcatgaacagccacaggacgagtcaaagtaaagcaagcaacttcactcgctcacatgctgcaacaaccacactttcggtggcttaagtgaataatagtaggccggaccacctgcttctagggcagcaagacgcccgggcggccggccatggctgcctgatcacaggttcagaaaccaccactgccacacgcacacacacacgcagctgctagctagagtcgccgaccgacccatccatggctagttgccatggaccatgcgtccaacgaaccatcaattccgagctctcaacctagtgctcgatccactagctcgggggaaccaaatagctgctactaccatccaaggattcggtatattctcttttgtaccatacccccattttccctcctgcctgaatgaaacggattgtgtggctagtaaggctgtgtttagtttacgctaaaattgaaagtttggttgaaattgaaacgatataatgaaaaagttggaagtttatgtctataggggagttttgatatgatagaaaaatttgaagtttgaagaaatattttaaaactaaacacggcgtaaatagtgttgctatcggtgcgagtaaagacgctgcagatagcgactgacaggcaaatcaatgaattggccatttttcatgcatcaccatctcataattttatttcgtgtgatccaatccacttatcactcactgatctatgtgcaatgaactaagtccagaaaatatctgggtagctgcactttggtttgtttgatttgtacctaacttctaattcatccattggaacaattataatgtttttaagcagcgataactgtgcgatagacttatggttacatgactccaacttatagaatctaaatcctactccctctgtcctattaaaaacgaatctagaaccggatgtaacatacatatgtccagattcataataataactaggatgtgtcacatccggtactagattagttttaatgtaacggagggagttggacgacatactcacatattagttcattttcaatgaaaatttagtgggaccaagtaattgttgttagttactccctccctcccaaaaaaaccaaactactccctccgtcccaaaaaaagacaaaccctggtttccgtgtccaacgtttgaccgtccgtcttatttgaaaaaattatgaaaaaaaattaaaaagacaagtcacacataaaatattaatcatatttttatcatctaacaacaatgaaaatacgaattataaaaaaaatttatataagacggacagttaaagttggacacggaaacctagggtttgtcttttttttgggacggagggagtagtactgaatgtgatatatttgtccagattcgttgtactataatatgtcacatccagttttagattcatttttttgtgggacatagtgagtatgtctctttatgcttgtgttatggacgcactagcttgtgtatatgtgcgttccaagtaatcgaagaaaacaattttgaatacttttgattcctcttaattggaatctcaccaatttttaagtaccatcataaaatgacacttccgctctaaagttatgacggcattatattttaagcattggcccaaaatacaccaaatgactaaccatgtgcactgaaaaaggtgtcatattaacattataatgctgtgaaatatctcctgaggcacttagccccattactcatttttaaataaaataattcaaatctttaagctgatgttgaaatagtttggctatgtttggcttttttggagactcaaggtgtgattggttagggatggtaaaactttacatagtaaaaacattattgcatattttagattttgttttcaaaaagaaaatagttcatattgcatcagggaaatttggcaaccaatgaaaacaaccaattccttcaaaacaggctagagtatcgcgtctatagctttgagattttgtattttattcaatatagaaatttggttgcaccaagaaaattataataaaaaacaaccaaagtattaatattttttattttatactttaaagattttggttcaaaagaatagcggaaaaccctgatggaaagctcaaagcgaagtcccgctaatatcgagtattcgagtctcacttctttattattctgaaaaacctattatccacaccactataattgacatggcataattaaccatgtaacaacgcttttatgttgatatactgaaatgccataatccttgtcgcaccaatttttttcacggcgtaaaagtattatcttacggtaccatttatagttgtgttgttgtaaatgttcccaatcgtacataacgtgtagaagggtttatttcaaaatttgtttagaataacgttcagaaaataaaattttccactgccttcgcccgagagcaggaaaatcaaatgcacctacaaagagaaacggcgcaggaaatgaaaacaaaagacaattaatggagtctagtggcgccggtcaaagagagcattcaaagtggattgcactcggaggaataaacaagaatactttgaacagcccctgcattgaccggtttttggggctcctgaataaccactagcctctcaggggctagatgcccctgccccctcgcacaccattttttttttacacgcagagaagaagagacattatcacattaggcacgggcttaattatctagcaacaaattagctacagaatgaggctaagcgcagtcaccgaactaatcaggaagcgaattagtcaccgaattcggcgagggagagagatcgatcgacgacgagacagacgtcaagatgaatcgaacttgtagtacttgtcgacggcggcgaggacgtcccaggtgcagcttagccccttggggaagacgacgaggtcgccggcgccgaactccacgcactccgacgagcccttgatgtgcgccctcaccttccccttcaccaggtagcacgtctcccgcgcgtcgaacttcaccgggaacttccccgtcgggcaaccccacctgcgcacgcacgcacccgcccacgcgctcaattaaacacgtacgccatgaaggagcaggaaatggacagcgatcgatcggcactgtggcgactcacttgggccaggacttgacgcctagctggagcaggcgcgactccggcgggttgcgctccacggcgatggagagggtgccgccgccgccgggagggtccgtgtccatggtgtccgggtttgagctcgaggccatgagctcgcgcgcgaggtcgaggaggagaggagggagaccgggagagggtgagcagtagcttgcagttaggagtaggaggaatgagttaaggagggttgtgtcagtttgggaggtgagatgatgagttcttctacttctagttctcgcgaggggggaaggctccaagagagggcagttggactgatggctttcctgtatcaaaacaagggcaagaggaatctccttccttcatgtttttaatatatacaagtgtgtgcaataatattatattatttttacccagcatgtgtatatcatttgggacaagtcaatattatacatatttttttctgaatggaaacaagtcaattttatcctcttcctatgaggccaaaatagctctatgttgcttactatctctgctctaaaatatactatatccgttttaaaatataagtatttttagtgataaatctgaagatgtagttatccaaattcatactctctttatcccaaaatataagaaccaatgattggatctaatatttcgtggtactacgaatctggacaggctgtccaaattcatcctatccaaattaatagtcctaaagaatatctcattcaatcctaacttcttatattttgagacggatgtaataactaaaagtttttatattttgggatggaagtagtaaaatattttgcctatgttattagatggacaaaatcccttatattttagaaaggcgatattaccttttatgagagaattttctcttatttgtactcttcatctaaaatataagtatttttagatatgtgtagagatacatagccagaaatatttatattctaaaccggagggagtagtagtattttgatatttgtatcaaaattagcattaaacacatatccatgacacgaacatatactttggtttttttttaataaaacttgtttggaaatgagatatattatgtttttctaacattttttgtgcctgcttgattgctcccgtacaactgtttgctacatgaaacagcaatgccatggcttgctgttgcagactaataagctgcggtcagacagccaagagccatggtgcattaactttgtgcaaataagatagtgaaaaattaagttattttggaaccaagggaatattattgaaaaggaaatattcacacaacaacttatgtatccacaacatttacctattgttgttttaaggcccaaccctacttgtcaatgtgatagcaaacataagtgtattctatactcctatattggtaatacttatcaaatttgattttttcacaaacatgtggcttttgactctttaagttttaagtttagagatataaatgcgaaccactctgaatgtataacttttgttaggtacattacaatgtaaaatgacacttttatgttgcataattagatattttaaatgctttacgttattattaaaagttgatcagtcaataagaggagtaatgcgacatcttatctacctgttctatccttgtcctatctaatctttttctctttacgtaaaactatgtacctctttgaacttgtggctctaaccacctccaaaccattcagttcttaaacgaattggcgagccgccaaattcaataaatagagcagaaaatattgaacaaggtaaaaagaaaataaaaactatgtacaactattcctggttgcccgggctaacgactaaggtagccattgaacttggtccttaaccatttagttggataaagttgaatttgattcctaacacattctattatgcaaccggtctagcaataatatattgtggcaatcagtctagcaagtatcgttgtttgaccgatgaaactttagacattatttcgtcgatcaatcattgcatatactacattacccctagcaacttagtacaatatatttatatctattgaaaatttggttgtggggcggataacaagtggtcaattctcatggaggccacaccgttcatcgcacatgaaaagaaaaaccgtcgtcatatgaaacacatgcttagacagcttagtgaacattacataaataaacagagacatacagtatcagagataattgttgagctcggggggcaaagaaacaactctcagccggctgcaaacttgaaagcaacctccaccgaatttgtcacgagaagaacgagacccaccgaccacacaccacacaatcacacaccacgccaccaccggagaagcggtcaaaacagctagagctcgcgatcaaccgcgagccgcgcgacgacgaaggggttaaaaccccgccgtccctatccgcttcgctgacgtggcgcctcgggcggggcccaccatacgaccaggccattgaccgccagcccccgccggcccgggatcccgtgcggcgacaggccacatggcctccttccttccttccccccgcccgtgcgggcgggacacgtgcggcggacgggaccgcgagatgcgatcggacggctggcttggctggcgcggcagcggggccctctgccgggcgaactggcctatgcgccgatggacggtggcgatgcgacggcttcgatggatgaggggatgatacacccatccttttcccctgttcgtacgccgtgctccccgaaacatgtggggccagtgggcgcgcgacgcgtggccggcgccggcgcagctgccggagggcgcggatcgtttgtgcttttctcgcggcggcagcgtgacacaagacgacagagagtcaaacagggcgtggatcgcgcttcagctttgagtttgcaaatgaaatcgtagaatctggtatgattcggtacaatacgacggaattcgagttaaaacaacgaaacacgaaatgcccgctttttgtaacaaactgttggtcgggtttaggaggggcctaatcaggaaaattgcagggtccattacaacaagccaacaatacgccagataatggcctacccgcggcaccatggcagttctcccctctgaagagaaactggttgaacaaccaattctttattacagtatcttttgtcaacatgctgttcaaccaattctttattacagtatcttttgtcaacatgctaatgcaatgctacattagggtgtgtttagttcctgaaaaaaattggaagttcgaagaaagttgggagttcagaaaaaaaaagttgaaagtttatgtgtagaaaattttttgatgtaatataatatgatggaaagttgataatagggggaaaactaaacacggccttagtatctggattccaaatctttcaggtaaaattgtttgttcacacagttgagggagtcagctactaggttgtagcagtaagaaacaagcaatcccgcagaagtgaagaatcgcgtcacagaactcagaagctaagtggtaacagaaacatagcacggatcaaacttcaagtttcaagcaggtactgtcaattagacgctacagtgacgttttggttgaaacttgaaagatttccagcattgcaagttcacaaaacaacagatcagcggcaaagctggagccaagaacgaggaccagctgctggcggataaacagttcacgcaagtggtagatctcggaaacaagaaatggaatgataccacaacttgacgtttctcccttggtagcagtctaacaatcaatcaggcaaccagcagtcaaatgcagcagccaagtgaacgtgaaaacagtctcgtctttcattttcacctcgtctagccaaatatcagaggacggaatatctgaaaatttattttcaccacttttctggatgacaaattcaactgatggacaaatcagaaataatattcaatagcacattcaatgtgataatcactttttcgcggggccaataggataatcaatatagataaattctaaattgcagatcttgttgacattgtttcagtcagttagaagcaaagacatgcaatctcatatggaaacaatcattgcttgaacactctcgcttcagaactctagatggcatagcctcatggtaaacaaaatgagggctgtttttaggctacttgcaagttagaactaatttcaagagaaattgatcaaatctaccataggatccccaaacttttttttgttgtgaagtggagatagccactaccagtactaccaaacagtttgtcaaatctattaaattggcatcaaatcatccccaactgtagcacaattcaacccaatagcagtttggtactcttgaaagcatttaatattactaatcaacaatcagaagcagcttgttgactcatgaacgcactttacacccaacatcaacaccttctagctagaactagcaatgtgacatgaggctggtcctttcccgactgactccaactagtgctcatgggttacaaacataaaagtatttcctctgcaatttcagacagaaatttgcgtggtagagacttttatttaggttaattcgccgtgctaatggagtttccactgcaacgccactactgattggatgaggctgctaattatcccattgcaacagtacgtctggaccctccagatattcctgttgtggaaaactctagcaggaaaaatcgaagccaatcgatcaatgtgacatcgacgttacacccacctgcttccaacatcgcgcacattgaagccaacatatataaacaaaaatctatcttgtgaatcaaagtactacgagaatttaagaaaacctcgcagagattggtaccaatcaagagccaaaagcactaaccaagcaaccaacaatgcaggcaaggcatagagattcaaaaacatcggcagcaaaaggtacccagattgatctcacgacgtctcgagatacatgaaaagaaatctaaccgacgaactaactagaagaatccatcaccatagagacagatcagcctctcaaacttccaggagagccccccacaagagcaccggcccccacacgttaccgtaagcgcctcaggcgaggtcggtgtcgtcgaagtcggcgccgtcgaaggagttgtagaagccggcgaaggggaggggcccgcgggcctcgttggcgcgggccgcgcggtggccggggaagacctccgcgtcctcctcgtcgtcgaggaagacggcgccggcgccgctgctgcggggggagtcgtcgatgtccatcagcgccgtgatggcgtcgtcgtccatgtcgtcgtcggcggcggaggcggcgggatggctagggtttttgcgggaccactgcggggaaggaaggggaggagcggggtggcgagggcggagagggggaggagggcccggtggtggggcgcgcccgctgcggtgccttggatgggggcgacgcgtcgtcctcgactccatataaagttgtgcttgtgccccccgagttctggagatttgtgcgtcgccttcgtcgtgtgccacgagtttttttgttttgtttttaattttatttatttattttcccttttctttttagagtgacggcatcaatgagcccctttgccttccgatctctgggcctatttgggctggccgcgtcgctaggccctctcccctgttctacatgatgctatttgtgaattcttcttttttttcatacggatttgctcgacattgttaaaaggtaattcatctcatcacctgccaaattttatttggaatgaataccgtcttccttttctcgttgcgttttgtgattgtctcgtgtgcgtttgggcctttggggatgtgttcaggccttttatgtgaaccataccaaaattcggtcgcactgagaaccagtacgtgaacaatacgatagtggttctatccggccatccggagaaataaccacgtataaaccaattatggaaagcccatgtactttacgtttacgtacaaattgttcggaaggaatcgcagttcaggattacattgaagatctgcattggcggtactcagttagcaagagtccaaacatataaccagcttatcccgtgctacgaaggatagcacatagcaggcgtcctgttatcgcacaggtcgcataaaagtgggagctactaatacttctttaagacattcacaacatcttgactgtcttctgttctggcagtgaaacctgcgaggcaaggtgctaaggtagtgagtaaagattacggcaaacgagcaaatgcacgcacaggaaatgtggcgagatagaggggaaaatggattacctgatgctaaccgcttgtggtgtccattgacgttccaatcaatttgatcgtcaatgttctcaacaatcttccttttcataccttccagtttccgctgaaatagtggtattacgttcacaagatctgcaggtatagcacagttagtcaggcatgttctgaaccagagttaaccaggctgcccaaaaatcatacttatgaagaatttactcctttgtagttagtatcgagatcctataaacaacattgaactgtatttgtacgtgacataaacaaattaacaaaagcagattaagaaatgtcatagaatttgggcggcgggcaagaatattttgctttctgaaactcaaaattgttgatgccagtggctgaagcttactagttttttaaccatgcgaagtaacccataaccaatatgcaccatacgttacaattactaacaatctgccatgtagcatgtcaattgtcaaacaaggtgacaaggaaggatataacatcagcatcatcacaattactcaaattatgtcaacaataattacccaaccataagtgaacaggttggagttctgatcacttgaaaaattcaaaattgtaagccttatttcatggaaaggcattggcctaaataaaataaaagtcttttaatgccagcaatatcgaagtgaaactgcagcttaagcatgccaaataactatttgtgaaaaacaaaagcagcgtgaaacttaattgatgtttaatcataatcaaatggcgtggatttctcttcctcctgttgtacacaactactgaatctaatgtcataccttgaaaattgtcttgaaaggccttgctttcaaacaccttcaataattcagccatagaggaatccaaatttctctggcactcagcttgtctttctaaggaagaaagctctttttgaagttcttcagattcattgttagcctgatgaaacaacatgtgtttgtcatataaatgcagatatagagaagctaattcatttaagtaagctgcttacatcttcaagttttttcctaagagaaacaagttcagcatcgagatccgaatcagaattcccatcattgagtgatttttttgcaggaatatcctgatgaagaaaacaactcatgtttaaccatcttcatgacaccattttttgaaatagaacattgaagtaaacataaaagtaaagcaaggtttcaggaaacagaattgtatgttctgcttcatcataagaacatatgaaaatgaagactgtacaactttgacacaatatgaattccaaaagaaacatgatgtagtataattaaatatcttgacttcactaaatcaatcacttcaacctcacaaaaaaattaaataaaccaatcacttcaatatgaggaacatacatcttcacgtgtcaggaatccttcaggtattgcgaaacaatgtcgaaggcagtatttctcccaattgctcattctcttatccaatacatccttcaccaagttgtgaatgctgattacaccctaaaaagaaaatcataagaagaactatacttttcagaacgttcaagctggactggtctattgggggaaacatgtgccaattgacaaacatatgaacgatatgcaatagcttccagaataaaatatactaaaaacattactgcaccatgataaaacaaagcaattgttattaaatatgatacatgataactcatagggctactaaatcattagaagtgttaaagtaatgtaatgcttccaaggagagctagcctgataggtccatagttgcttttgaccacaataagtggtatcttttttttaaaacaaaatgaacaatatccattccatagttctgaaaccaaatgaacaatatccattctatagcaaaaatatgaaaacagagaagctaacaatcgaaagaattgttatctggaaccatgctttgctttggtatttttctagctgtttcaatatttacactcagtaatccatttgtgttttaatttttctttttagaagataaatcattgattgacccagctttacaagaaagccacacttagtaattcatttggttttaaatttatgcgtagaaagtttccgcacaagtttgtttatcaagcatatatgcaaatagaaacatatgtgttttataggccattgcaaagtggtactgatggtctgatactacacactgtgcagcacggaaaagtcatctgaattgaaaaaagaaggacggcacgtcacatcctgtacaaaaggggctacaaaacaagtaatcatagttctgcagctgaactgctgaaaggcacatccacatagccgcataaattcctttgatataggatccaatagccagcttgagccttgaaatgaaccaaaattgatcaatgtctactagtcataaccgctggctgaccccgataaattggtgaacgctgagtctgagagtgctaaggctgataaattggtgaacatcacgagcgctaaggcaggtgaagctaccctaagactacgatcaagcattgttaagaacccgacgcacaaagatggaattcgtctaaaaacacaaccacaccatacaagacaccttctatcgaatcgtggaatgggaaatcgcgttccagaaccggattatttttttaaagggaaaaaaactgagggggccggcacgcttcatgaaatccagtggttggggggggaacttacccgctccagctcctcggccttctgggtcgccatggcggcgccgacggcctcgggggcgccttccctggagaagagagaagaacagcaagagggcaagttaacgaacaaccgagcagcgaaagagggggcgagcgagaaagggggggaggagaagtagagagggttcggtagccttactggaggcagtactcgaaggccccgtagcggacgtcgtcgaccgcgttgaggaccgagttgacgaagaacgaggcgctcagccccagcgccgcctccacggcggtctcgtcgctctcctccatgcctggtatgagggggtcctgagtggtggtggtgtgggtcggcggacggcgaggggagcggcggcggggggttgggcttgggcacccgcggtcgccgccgacgacgggtggggggaattcgaaattttccgcggccactttttgggaggaaaggaaacagatgcgcctctctcttttttccagagcccgagctgcacgacgccactgttcggcggccgcaggtgggcttaatccatgtgtatatgggcctagttcgacgtcagttgtgggactaaagccttattacgcatcggaagttcagaaatggaaaaagtacacccaaggtctctcaacttgttatcgagatacaaaatcgtcctcaaaccgcaaaaccagatattccgcgtcccataactaatcaaaaccggtcacaaaaggtccctcggcagttttgaccccagttttatcctacgtggctgctgagttagcgtgggacccacataggccccacatgtcagcgtaatccacgtcagcctcctctctcttctcttcccccgcttctctccctttactcatatctctctctcactaatctgcaagctagccagggcagcgagagaggaggagggcagcaccgcaacggcgacggcggtggccgtagtggggaagcatggcggaggcgcggggaggccggcgtcggcgtcgcccaggcggtggcggcgaggcgctgggaggccggcgtcggtctcgcccaggtggtggtggcgaggcgcggggaggccggcgtcggcgtcgcccaggcggtggcggcgaggcgctgggaggccggcgtcggtctcgccctgacggcgcagcggccgtagttgggaagcacggcggaggcgcggggaggccggcgtcggcgtcgcccagtcggtggcagcaaggcgcggggaggccggcgtcggcatcgccctgttggcggcggccgccgcagtggggaagcacggcggaagcgcagggaggccagcgtcggcgtcgcccaggcggtggcggcgaggcgcggggaggccggcgtcggcagcgccctgacggcgcggcggccgtagtgaggaagcacggccacggcggaggcgcggggaagccaacgtcggcgtcaccctgtcggcagcgcccgcagtgggaaagccgctggtcgtaaccggaggtggcgaggggggaggagttgtcggcggtgtcggctttggaggaggagcgcttgtggtcggggtcggggacggcgacggcaagggagcacgggaggcagagggtgaggatggtgtcctcgaagtcgagccccgatgccacggacgactccgtggagctccgctccgtctccttcgatgcggcggggaggagggccggcgtggccggcggctaacgaggaacgagcgtggtggagaggagggccgtgcggagccattgtcgtggccgcgctctcctccgtgtcctcactaccaccgctggcgagccgccccttatggcatcagcggccaagacctacctctgccgcaagcacgatcccaaccgtgccgtctccctcttcaaggccatcgacgacacctccctctcagcctcccaccgagccgcaccttgtcggtgtcttctgctcctacgccgccgtgtccctccccgagaaggctctcgccgccttccgctccgccgcgcagagctcggccggggccgtcctcaacgaccgccactccccatttggcgccgggtgcatcgagaagagagggaaagagaagaaataaaagaaaagataaaaaataagaagaaaataatgatgtggcatcctgacatgtgggacccacgcaactcagctgccacgtcagataaaaccggggtcaaaaccaccgagggacctcaaataaacggttttggaagttaaaggatctcatatatctggtattgtagttgagggatgattttgtaactggacaacaagttgagggaccttcggtgtactttatccttcagaaattttctaggaaaaagtgcaccgaaggtccctcaatttgttatcaggataaaaaaattctcgaaccgcagaatatacgcggggtcccttaactatacaaaactgattacccgaggtccttcggtggttttgaccccggtttttgtctacgtggcggctgagtcagcgtgggacccacgtgggccccacgtgtcagcgtgccacgtcatctctctctttccccattcttttttctttctttactccatccaggcggtgctccatggaggccaatggctggcgtcgctaggcggggctcgtacgcgaacacccagaaaccagcgccggcaccagcgccgccgtgatgcgcgacaacacatatatgtgggttgttgtgttcgtgtatgtgagttgggaactcattccctccacacgaaaaacggagcggtctattagtgcgtgattaattaagtattagctaatttttttccaaaattagattaatttgatttttttaagcatctttcgtatagaaacttgttgcaaaaaacacaccgtttagcagtttgaaaagcgtgcgcgcggaaaacgagaaagaagggttgggaaaagaggatgccgaacacagctgccactcctcataggtacacatggcttagttcactttgttgtccgaatcaatcatatcaaattttagtaattctatttttttataaattttagtgttgactttgttttgatgccttcgctaaattttattttgatagagtttttagagaggaagcttctgaaaataccaaaatttagtaagatagcaatggttgatatgtgtctagtttgtcacctactttaaaagcggcgacaaactgaatagtcccacaatttgccacaaacgtggccaatttgttatattaggtccaactcttttttaagagtatcaaagatggatcgagagatacgatccagctttctaagaaaacgaacagagtagggtgtattaggcaccccttttttcagccccttccccttatttttcacgcgcacatttttcaaactgttaaacggtgtgttttttgcaaaaagtttctatacaaaaattacttaaaaaatcaaaataatccatttttttaaaaatagctaatacttaattaattatgcattaatggattgctcagttttctatgcgggagggactagtttccatccctaaaaccaaacacaggctaaaactgtccgacacaacactcacaacataaacctaaaacacgctgctgtgaatttgagcttacattatcagcaccctaacaagcttaccaccaaaacaacaattccagaacccagctattgcgtgttttcaactcaggttatgttcggtaggaggggttgcaacattactgtggctacaactacagccagacatgacacaaacaactgatgttggcttacagttgcagccacatagctacagtaaaaaagagcagctgaacatactctacatgtctaatgaaagaacatctattgatccaaatttcttcatctttcagatttaatcttcagttagcttttatccaacttgcttgcaccttatccctttttcaaaccctttcacttttgtaagagagagatcattttatataccatctgtaaaggagatttcacaagtatatatgctttccaagacataatcatttcttccagtccatggaccctactccctccgtctcataatataggagtagtaatctagaacagacactttatagtacaacgaacctggaaaagaaagcatgttcggatctattgtactatgaagtatgaagtgtcacatcctatactaggttactatattatgggaccgagggagtaactaatatactccctccgtattttaatgtatgacgccgttgactttttgataaacgtttgacttttcgtcttattcaaaaaatttatgtaattataatttattttattgtgacttgatttatcatcaaattttctttaagcatgacataagtatgtttacatttgcacaaaaattttaaataagacgaatggttaaacattagtcaaaaagccaacggcgtgagggagtagttatcagtcatgtgataacaagctcaaccatgcattcttagggtttctttggagcgttctttttttaattcctatagaattatattattatgccatgcatagtcatgtaaaactcatttgtttcaaaagagaagccactgctggttataacttccatgttaaaagcaccacatgtgacaaagctcccacgaaattgacgtggaaacgtcaaacgtgaactccagcaaattagtgaaaaacccttttctccaccgtcgtgctagttgctacgctagaggtcagctcgctccttgcctccgctttaccaaaaagggcaaagacgagtcctttttccgctgccgggcgtgcgtggataagccgaagcgcctcccccccggccccaccccctcttctccccatcacccgcgttgtcctatcgtcgcagattcacaggaccccaacctttcatggcttattcggaatatagatagtaaaaacgaagaaatagaaaaattataggaatatggtaggattgtatgtgtaaaacagaggattgaaaaacataagaatttcttgttctccgtgcgcaggattcttacaacaaagaggctaaagtggattctttttttccttgtgaaaacatgggtagggaatagtattcctatggaattcaagatagctaaccctttcaaacgaatgcatctatagtacccagttcaaaggaatcatcaatcctccatttttttcttcacatttcctccattccgaatgagccctcttcctgtttctctcgcaagtggaatctccagccgtccagcgttaatgtggatagagatagagaaagagagtttagggcccctttaaatcgtaggaatgaaaaaacagaggaataggaaaaatacaatattctagcaggaatacacaggaaaaaaacaggaatggccgtttgattggaccacaggaaaaatgcaggaatcagatgagagagatggactcaaagtaaatgttccaagaggttagacctcttgctaactttcctccaaaatgtgcataggattgtccattctataggaattttaaaggattgtataggattcaatcctctgtttcaaaggtcttcataggatttttttttcatagaattgaaatcctctaaaatttctatatttttcctacaaatcaaaggggccattagagtttagagagagctgatgcactttctggcacacgactacacgaacaatcaatcactggctgagaaaacagggagctaattggctactagcatacgacgatcacaattgccggtggaccacgccggcagaggcagtgtgctgttgcggtggacaaaggcaaacgcagagggcggtactacgttcgtacgtgcgtcgcctgtgcacggaagtcagcacgtgaaacgtcgatccagcgcatcccacatgcgagcgtgtcagcgctcaggcaacacgaacaacccccggacggatgcacccccacggccccacacacgcacctcttctctgctggtaatcagagtgctttgtcagcagtacacggctacacgctaatattactactgttccaggccatagcaagcgttattgctgcagtgctgctgccagtaaaatgcatcctggtgtacgtacagtaataagctctacggtgtgttgtgtttgttttagcggcatcaagccaacaatggagacgagagatgtggcccggacggatggcgccgtccatgcatgcacccgtaaatcgtggtcccccgtctgcgtcgccgttttttgaggggatcccaggcttttcgagggtaaagtcaacacaaaagcgagcgccttttgcgctcgtaaaacgaatggcttttcgtgtagctaccggtggtggactcgtggggcgcgcgccctgcgcacacgctgaacgctgccctgtgcaacggcgacgcgcggcgcagtcgtctcccccgtcgtctgcgccggcgggcggaactccacgagagagccgagagccgcccggcgcccgcgcgtctcgacccaaactatctaccgtctccgtttctaaatatttaacgcttttaacttttttaaatatatttgaccgtttatcttattaaaaaaatttaagtaattattaattttttatcatttaattcattgttaaatatacttttatatatacatatagttctacatatttcacaaaagtttttaaataagataaacggttaaacatgtgctaaaacgtcaacggtgtgaaatatttagaaacggatggagtatttgtctaggggtgtgtttagttcacgctaaaattggaagtttgattaaaattgaaactatgtgacggaaaaattgaaagtttatgtgtgtaggaaagttttaatgtgatataaaagttagaagtttaaagaaaaagttgaaaactaaaccaggcctagaatttatttattttgttgaatggagagagtatatatgagtcacttcctcctagctcccagcttctgtaccgacttctcatggttagcgttggcatagtgcaggcacgcaggaacaatgatcagtcccagcttgagtaaccaaggcctgagtgcctgttaaacatcaagatgggctgggtcagactgtaccagatgggttgtgttgccgctggcctggatcgccaaatttgaacttcgtcaagagtggtttgatcgacaaaacgttatttatattttataacatgtttagcctgaggggtcatccgtatatcatttgataaagcttctactcttactttattggtgttttttttcgaacaagattttatgataaattttttacctatacaaattcgatttcttagtttacatccaacacggatgaacgatgaacggatccacagtttgccttagtctctctaaaaaaccaccaccttcacaaaacccgctaaactcatatcttcgtagttgccggagatgaacattagagttggagaaagcattgcgaataatttaaccggatggttcaaaacatgtcaatattcttttgtaagaaaaaagtgtatctttcccattatttcccgtcaaatgacatttatcaaatttgaattcaaatctattatattattaaaggaatagaaaaaaaagccttcaagtttgctttaatggtctagaaatttccacattaataggagaaaaagaaaaaacagagtctatataagaatacaatttaataatagctgaaatttggaattaaaagtaaggaatataggaagctaagattagagtctaaatcggtatacaatagaactaatggaaattcagaattaaaaaaataaaaaaaattaaatgtaaaggttagagtccatctagaaatacaatttagaaataaaaaaaatcgaaattaaaaaaatatattggatgaagaatatagagtccatatagaaatagaatttaaaaataattaaaattcggaattaaaaaaatattgaaagataagtttagaatccatatataaaaatacaatttagaaataatagaaattaggaattaaaataaggaatatcggaataagagtacagaatacatataagattttaaaatttagaataaaactaataaaattaaagtagaatttagagtacaaatagaaatacaatttataaataactaaaattcaaaggaatattggaagtttgctctcataagagcatctccaacagcctctccaaatctaactctccaaacacccatatagccaactctccatttgatttggctagtcaaactagttgttcactccaatagcctctttatctacgctctctactttaactctatgggctagtttggtttgtagcctaaattggccttaccaatttttgtcaatgtcaaattttggcaacttttggcatggctaattttggcaaaagaaaaaattgtgtttggattgaagccaaaatagcctaaattaactgttgaaatggcctatttcttaggcatgccaaaatttggctccaaaccaaatagacaataaacactattgaaattgccaaatattggtaaggccaatataggcctcaaaccaaaccaaccctatgacaccgggacccatatgtcagcctctgccttcttctttctccccttccttcccctcttcctctttttttctcgcgttggctgggagcagacgacgccgacaagctgggaggggacggcggtggaccggtggtgggcgcggcggggagcttgtgccgcacgggtggccgcagcgagcggaggcggcagccgcggcgcgcgggggacagcggccccggcgagccgagacggcgggccgcgccgcgcgtgggacggcggtcgcggtgagcgggggcggcgcctcggcgcgtgggggtgttgacagaaaacacgaggcctaagagatccgcttaactccagtgcatgtccaaaactagacttcgtatgtatgagcgtgccagttgatttgatcctgcaatcaacaagaaataaaacaaaaaaaccgcaattaatcctataaatgatagccgatcagctaggtgccgatgacatatcatttatttcaagccgatgtcatgcgtacatcgatcggcaaatatcaataagcaaatcagaactaaatctactcgatcggctgtaaatattaatgatatataatccttatatcgatatatacttaaatcaagtgattgagatagatcggttgccttgccgagacagtataaatcacttagatcgaaatatatattaatagtgggattatatacatttatagcatagccgatcaaatggatctagcatgtatcggctaatactccgataccactctatattaagatgttaaagcaagtagaatatatcaaacagaagcctaatatatttagatgcgacaaaatcttaacataaagggcagatttaacatatagattaagcatatggaataaaagtagttaaatcagataagatcggctgaaactccgatactaccctgatcggcaaccagaaagcaggctagagattgcagttctaaacacgacttaatagatcaaactcaactgatgtagcattaagtatgaaaagaaaaaacaatatctagacaatcaagccgctggaagttttatagagtggtagatatatcacataatctaagttaacattgttgtctaacctaatcggctgccttccattaacagatgttagtcgattataggttagataaagatattatcgaagattatatgagatatatgataactcgacgaattacatagacaagattagagtatcataaagatggaagcactaatcctaagaacataaatcgtcgcgacaagttttacctcttgttgaagatcgaagccgatgcagctcaacccgaaagcacaaactcgtcgaaataaaagtaaagcaaaaagggtggcgatgcgccgagattgtattgaatgtcctttttttttacatagggctcgggtctatttatacccgagaattacaagatacgtccataacagacacgactattatctctaacaaactctaagataccataagtctctatagcagacttttgcccaaacatatctctaaggaaattacatagaatattctaattaataaatacaattgccttcccaggactctatccatgcgtggcaatcatcttgaagcacatcaacttaaacccgatgacgtacaccgggtcatattatcgaaattggctgtatcggctagccccgtctgactcgaactctgccgatcctgaccttagccgatttggactgcagccgattcttactttgtttccgcaacgatcttcatcttggattccacttcgatctgatcttcatctccgatgccaatagtgatagaatttaccaaatttggtcgttaacagggggacggcggccgcggcgagccgagacagcaggccacgccgcgcgtgggacggcggccgcggcgagcgggggcggcgcgccctacgccgagcgggggccggcggcggcggcgagcagaggcggcgggctacgccaagcggcggccagggctgcggcgcgcgggggccggtggttgcggcgagcggagaacggcgggccgcgccgcgcgggggacggcgaccacggcgagcggaggcggcgggccgcaccgcgtgggggacgacggcggcgagcggaggcctgcagccgcggcgagcggaggtggcgggctacgccgagcggaggatggcggtcgcggcgagcgcctcctcctcgtgcagtcgtgctccttccgtgcctggttgtcgtgtggggatggaggagatgggctgtgtggggcccaccattggccagccaaatggagtggctaaatttggctagtggagggagggttttggccagccggttggagaggctgttggagcacgatttttggctagaatggctaaattttgacttggagaatgggatggagagattgttggagatgctctaagacatgcaaaattatgttgtcattttaatatatttgaataatacattgagaaaatatatatgctattataagagagaaaatatagtaatactagccgtgcaatctacgcgggccactatgctagttactgtgaagtgaacttgcaaggaactgaccatgcatattcgcaaagtgaattattcaaccagatggttcaaaacatgtaaattttcttttgtaataaaaaagtgtaattttttcccatgatttactgtgaaatgatatatatcaaatttaaaattaaattactgtgaaatgcaaggaattgaccatattcctgtgaaattccgtattcactactgccactcggtacatgctcattgcccaggtaagcagataccatgtgatatacggtaaccggagtagatgggttatattgacgatggttcgtggtttattccttctggtgcaagtgcaatgctaaaaggcttcaaagtgcaaacatatcgcagtggtccattaatccttagtacacaaagtcggatccgttgacatggccccccaagaggacaggcttaaacagagtcatctttcttgagctgtggtaggtactaatcaatgaccttccttcatctctgaatagactgtcatatcgtagtttagcaaacgtaaacgacagctccttcaattccagcgataaaaaatgaaccaaacggcggtcaatacatgcggtttcgcatgtttatcgtttttgttgttgcaataatcaggtcaaatatattcacgcttcacttgagagcgactccttaaaaaaaaaactttggtcagtcaaactcacacgatcgtgccaaaggggtactcatctttttttagtgtcaaatcaactttagcaaaccacaacctccccaggggccagggggtggttaaaagggtgttaaacttcccgtgccatgcatgatgcaacctttttacagtcttgtaaacttaacaaagatgaatcaccccctgacatagtagataaagtccatgctactttatgggcagaaagcagcactactcctactatactgtcctactactaaaacctgggtatcaaaaaggacacctagctaaggtaagctaaccactactctcgcagcgttatcatggcagagattgcaccaacatgagaccacctgctctgctttgcatctcccagcaggagccttgctttgcatctcctagcaggagctcggctccagactccagtgcagcactgcagcggctagccgcttgcatatgcagtagacatgcagatcactttacgcgatcacgtcgcatcaaatccgtgctcgatatggcctaaatccgtaaagtaatctgccggcgctgattgctggagtgcgcgaacaagggtcaggtgatggccgaaaagttaaactgcaaatgggcaatttgggctcgaagttaaggagaatctcgcctgagttgagatcgcgctgcacgtgctcgcggtcgcggcctaaaataatttactagtagtaataaaactatacaagtaggagcatgtgcaagacggtcaaattgaaaaatcgatacaaataaccggtcgtagcgcgtgcgtgcgtgcactggcctgtctggtctatcagcttgattttcagtctctgaggtgtgctttaaccacagtataaacgtaaaaggtgtttaaatggtgctgtcaaacagagatggacgaacaataagttttttaaggagtaaagtgaacgcctgatctctaaatttgcatgtgttattaggttaacatattctcaaatataaatttaagatccagaacttatcaaagtgtgtcatcccggtttaaaattgtcacaaccatattggatcctaaatggtgccgaagcctgcaagctagctcgggaagctagcgtccgcaggtgtgtcagcccttcttcatcttctatgggttccacaagtgaaactttggatccgaccctatacttggttgtgtttagttcacactgaagtttggaaatttggttgaaattgaaatgatgtgactaaaaagttatgtgtgtatgaaaggtttgatgtgatggaaagttggaagtttagaaaaaaaaaactttggaactaaacagagccaaaagtcatggcctcacctcggtcaacccgtaggttgaaaaatcgcctcggacctggcttgtaggtggaaaccgcactgaacgaaaaaattgctatcctagtttagtatatgtaatctggcagtaattaaagttttaaatgtaggccgaaaatcaaagttttaaggcttcgttcgtttgttatggttgggaactctcccattggcagaaattacgaagcaattcattagcacgtgattaactaaatattagttagaaaaacttgaaaaatggattaatatgatttttttaaaacagcattcgtatatacatttttttaaaccacaccatttagtagtttgaaaagcgtgcacgcggaaaaagaggggcaggagttgggaacagtaagtaatgaactcagcctaagggcatctacaaccaaagccacccctagagtgtcctcactaactgagggtactctctatgaaactcatctctcaatggagaatacctctagatgggttcttcaaaatctgaggccacttgatggagaaacgccagctcataatgggtgtcccagcccaaggtaccctagtgaaaaaaataccaaccgtacccctcctcttttttctcatttcgcctgctcctctctccgccttgtctcctccgctggctcctctctctgtctcatctcctctgcgaagaaggcgacggcagtcgcgtcgagcgcaaggggtgccaccggcggttcccgtcgccgccacctccctcctcgccctctccagcaatcgtcgtcgactccctcctcttcatccgcaaccccatcttgccgccgtcaccggcctccagtcgaagtggttccggcactggcggtggccgaaggcgacagatcctgcgtcgtcataggcggatctgcgcccccctcccccccatggccagatccggatggagcggcaccggccgcgccacatcgagacattggacaaacacaacaactactactactccatatgcaagcacggggacaagagtagtacgctgctggtgcctggtgatgagcaaatggatcattgaatggagtgttggactgcctcctttaggtggtgattgaattcagtcacttaaagtcacttaactttagtctttatatttaaatactaattaagaatttttaagcctaattaatccacaattagagaatgtttactgtagcatcacataggctaatcatggattaattagactcaatagattcgtctcgcgaattagtccaagattatatctaagattatggatgtgctttattaatagtctacgtttaatatttatatttagtgtccaaacatccgatgtgatagggatttaaaagttttagtcccatctaaatagggtcttaggcctctttgggaaacatggacttgttccaagtccctgtcacatcgaatgtttggacactaatttggagtattaaacatacattaattacaaaacccattccataaccttggactaattcgcgagacgaatcttttgagtctaattacgccatgatttgacaatgtgatgctacagtaaacttttcataattatagattaattaggcttaaaaaattcatctcgcagattagctctcatttatgaaattaatttttttattagtctattaatactccaaattagcgtccaaacatccgatatgatatgtactgaaaaaattttagccccatctaaacacccccttagacaaatgccaatcctataaatgctgcttcaccagtaccaaggttgttaggatcgggataccaggcagtatcgttttgctcaaagtaatatcgcatcgtaggatcgtatcgtagtatcgggatactatgagattttctttttttaagtttaattaatatttatattaattatatatagacattctatataaaaaaatgtagtaatgatatatgtcatacaaatagagacctttatcaagagaaaccatgttggttttgatatatttaactgatttttatataattttgagtatatttatttacattattttcaaaccatgatattttaaataatattttgtagtatcgtagggatcgtagaatcgggataccacctaagattttataggatcgtgtagtaatgaatagtaggatcgagatactatgaaaattaggatactaggtgggatcggtatcgtttcagcttggtaagatcgtagtatcgtagtatcgtaagatactaggatatgaatcgggatactgacaaccttgactagtactagacatttctatgtcacctgcctatgcgatgcgcctcatctacaaaccgcaagggtaatagttcgatgtcaagaaaaaaaaaagagaaaatcccctgtgtactctcgaaagttcacctaatcccttctgtaccccttttgtacccctgaattttgctcaatcccttacatacccctgaattttagtttggatccctttcatgccctttccgctagttgaccggtagttgaccgttaaattcttatgaaaaagtccattttgccctttggtataaagaagcatataaattaatagagtatattgttagagcatataaatttgttatatgagactattatgtttatgagatagttatgcaccatattatttgtgataaatatacttagatatgacataaaaattaatacttatttattagttattaaaagattttttttagcatatgtattctgaagtaataaacaaatctgttgtattactatgaaaacacatatgctacataaaagaacttttaataactaataaataagtatcaactttttatgtcgtatgtaaaagtaaatttgttacaaataatatggtgcatcacatactcataaatataatagtctcatccaataaatttttacattccaacaatatacttcattaatttattatgtttcttcatagcaaaggggcaaaatggactttttcaaaagaatttaacggtcaactagcggaaagggcatggaagggatccaaactaaaattcagaggtgtgtaagtgattgagcaaaattcaggggtatagaagagattagatgaactttcatggatacttaagggattttcttaaaaaaaaggcgcgattattgcatgcgagaacttgacaaaatcgcattctttcttgattctttctctatgggcctaaagttgatagtatatactaatatttagagcgtgtaaatcaatgcattagctctctcacggaaaaaggaagatagtaggccaaaacaacggtctacatgctactagtacatgccttgaactggtactccaggaacattaaaaccatatttacctgatctatgctgcacatcgcaatgagcagcagagacacttccatcgttttgagcttggtgggcaaaatatgggccaatcctcccagccacaagttccgctgtgatttatgaccggagtcggcgcccaccaaccggggtgcgtgcgacctgaccagcaccgcacatcggcagcgaaaacccctccgttttttcttcatctcttcttccatttcgcttctcccaccaccataccaccacgggtcataaccccctcctcctcctctcatccacccaccgtcacctctctccctcctcaacctctgcttggctgtctgcctcctcgcctgtcatctgtccctctcatcagcagcggcgcacgggtcaaaccaagagccgcagcatcgccaccaccattcaccaccgccactcagactctccaatggcggctcctccccctcctcctcgtcaaaaccgcccctctcctctccttgtagcgggtagttgcttgtcgcgagtagggacgaatctgtgctaggggcgagaggtgtgtgcgcgctctagggggcaatggaggggatgtggaggaaggccaagaaggcgctgggcgccggcctctgcgttcgcctccccgccgtcgccggcgactgggaggacggcgtcagcgagcgccgcgcgtcggatgcgctctcccacgacgcgtcttcggcggcggcggcgcatgtgtcggcgccgaatacgccggccgcggcgttgccgggagcaggcccgctccggaggtccaagtccgggaccaagtccgccaaggttaggctcttctccttttctccctcttcttctcattgtgagttatataacctgtgccttggattgtatccgtggtagccttggttcggggtggctggatgtgaaatgcggagcagattggggtttcctccggggttaggcgcggatttggagcaatgtggcttcacccgtgaacgatttagattcagatgtgcttcccctggccgacagtttttggttgcagtaatgggcgtttcctttgtttgtgtctactgtctagcaatttttttttgtatgcatctgtttttttaatactgagttttgtcttgagcctcgcctctgctagtttggatttgtcattacctttgttactttgtctgcaattgaaatcatcctatgttgtttctgaggaaacatgggtcttgcccattttataataaaaaaaccattttgtgtgcagattttgatgattctgcaaactatttattctctaaattattcaaaggaatatccaaaaaagaaaagagatgcatccgtcattggcttcatcttgttgctccattcttcgtgtcatgttccagcaaactatcataccattttgttcttcaccattcagaaaggaatcaatttgtgttttatagcttctttttgggctctgttgtatttatttcatatcttccatagtacaaaaatttgctgcttgtttctttttctcaaatttatacgccaacagagattcttacgaatttctatcagctatcagtctgctggtatttttcccctcggtatcgcgcttcgttatgggttaattcaaataaaaaaacccagttgttttttttttctgtctaagatacattcatatcttaacgtaagcttcttttctactgttccacttgctcgttccggaatgggaaagttcgcttctttcctcagcaactccccatgtgttcacgtgtagtatcatcctgccgtctctctcttactccgttagtactactactacgtactccaactccaattaattttgtaaaggcgtgttttccaactgtagctgtcatccatcactgaaaatttgtatcaccagcctcttattagaattaccttatactgttctttttatatttatctttatttagttgtcatggcatgtgcgtgatctctttgaatggtcaatgtcaatttgtgatgttttctgatacaatactattttttcgtgtggtgttcattgatgccttttattgctgtgttcacaccttttgtttagtagcagttctgatttagcgagatattgtgtatggtagtgccctgtttgaccaactacttcacgaggatttcctcattactcattactcaattggttgacatttatctgccttggtcagaagtgaagacttgaaaagttctgataataagcatcgcacagttatttattgtgatttccgcattactgcctttgctaagcttgatttgtctatattatcaaatttgacaatttggtaaactggcatgaacgcttactgtgtttagttgaatatattgacacgcatgcaagtctgacaattctttgtggtttctctggtttaaaatgattttatttgtcaaggtaatgccgcgaaatgcaacatatattgggtgcccaaatgcaaaatatgtatttcttttaagttatcagtaaggaaaccgtaaaatcaggtgtgctgtttccattggtatttatgacgtgcatacgttatcataaaatataaaatacagttgtggttgctgacttggtgttagtcaaaagatgtatttgtttgaacatgctttggtttttatgttttagtcaaaatcaataacagtacctatcttaggtcctgtttagattccaacttttttcttcaaacttccaacttctccgtcacattgaacttttctacacacacaaacttccaacttttctgtcacatcgtttcaatttctccaaacttccaattttggcgtggaactaaacacagccttagcttatgatggcaccaatgaactaatagatccaacaccttgtatgtcacaaaaaaagatggaatggatgtgatatgacatcaattcatttagttctggtatgtgtttgtgatatatttttgtttagctttcatgtgaggccctattcgagttgccatattgatccaatgaaaataaatcaagaaagtagtaactttagtccatgaattgcagtttgtgtctatccgactatgtttcagaaataacaaacaaatatattgttcgacgtggatacactttgatgaagaattgggatgaaaaataagtctggataatggtaatttaaggtgggcctaagtaaatttgttgaacatgcagattagtggagatatctatgcagatcttggagttgattcagaatttgagatcggcttctgtcatagtatggcaaactctaggcagggcttaattctgtacagtggaattgatctgtgaagataaggacttaaataggggtgtacggggtgtggatatcaggacaaagggttgttgttatatgccagtctgttcactatgttggatgtaacatacaaaaagttttgttctcaataaagtatcattaatatcagttgaaccgtcttttcgcagcaaggctcatctttaagcccttatgtttcatgttttaaaacacatgtctccatgttgattgcacatttcaaatgtgaaggggtgagttctgatgttgcacaattaaattgatacatctttctttttttctctcaacagggaatgtgcgcaatatgtttcgatcccatgaagtcaggccatggacaagcacttttcactgctgaatgttctcacatgtttcacttccactgcatctcctccagtgtgaaacatggaaattatgtatgcccagtttgtcgagcgaagtggaaagagataccctttaaccgctcgttatcttctattgtacctcgtggtagaagtgggttgaatgtgaatcaagctcgattaccccaacaaggcacctacatggctcttctacgccaggttccaagtcaccatcgagaagcttctggttcccatacttctgagccagttgatttcaatgacgatgaacctttgcagctgatagagtctggtgacagtcgtgatgctagatgcagtagagctgtggagatcaagacatatcctgaattctcagccattccacagtcgtcatctgaagatgattttgctgttttgatccatctaaaagccccttgtgctaacccagaacaagtcacaggcagaccattcaatgccacctcaattggataccctacatctcgcgctcctgttgatctggttactgtgcttgatgttagtggcagtatggcaggcaccaaactagcactcctaaaacgagccatgggttttgttattcaacaccttgggccttcggatcgcctttcagttattgctttctcatctactgccagaaggttgtttcatctccgacggatgtctcactctggcaggcagcaagccttgcaggctgtcaacttgcttggtgctggtggtggtacgaacattgctgatgcattgaagaaagctgccaaggttattgaggatcgcaattataagaatccagtctgcagcattattctgttatcagatggtcaagacacatacaatatttcctcaaatgttaggggaacccgtccagattataggtcacttgttccatcttccattctgaatcatactatctgcacagtgcctgtccatggctttggttttggtgcagatcatgattcagatgctctgcactcaattgctgagtcctctggtggtacattttcctttatcgaggatgaaagtgtgattcaggatgcatttgctcagtgcattggtgggcttcttagtgttgttgttcaggatatgcgactaactgtggaatgcgtgcatcctagtgttcagcttcatactatcaaatctggtagttacttgagtaaggtggctggagatggacgaaatggatcaattgaagttggtcatctttatgctgatgaggagagggacttcttactatctttgagcttcccacaatctcgtgatcagaccatgcttttgaaggttgcatgtgcctatagagattcagtaacgaatgaagccatcaagattcatgcagatgaggtaaaaatcctaaggccaaagtcacctacgtctgagccagtttgcatggaggttgatcgtgagaggaaccgtgtccgtgctgctgatgctattgaggctgcaagggcagcagctgagaggggtgctctttctgatgcagtggctattcttgagcattgtcggaggatactctcggaatctttttcaagaaagagtggggatcgcctgtgcatttcccttgatgcagagctaaaggagatgcaggataggatggctagccggcaacgatatgaagcttcggggagggcatatctgctatctggattgagctcacattcttggcagagagctacaacgcgtggtgactctacagacagtaccacacttgtttactcctatcaaacaccatccatggttcagatgctgcagcgctcacagaaccaatgcccttcacctccgggcctgaggccgcagctccgacaaactaggtcactcttggagaaaccccatccaaggtagaaggcagtttgccattgtctcttgcgaagcaagtgcaaagatgatggtgtagaaatttcattggtgtcattgcttagtaggtcagtagtgcagtagcttagcattcatcctttgttcttctgttcaagtcaaggatggcggtataccggaaatggggaggtgagcttggaggtaaatatgtttttgggggtatactggagaaagtgaatgggggcttggtggtaaatacattgtgaagggggcctgggaagaaatagtagagaactggagcagtggtgtaattgctacaaggagtaagattgtgtaggttggtaatttagattgtcaggatgtttctaattgatgaacctcttttcattttgccttttggtgatgtaaagggtctggtatgggggaggtataccatagaatcttggggaattttgatttggggtggcaatgtaattccatggatttcttgtttttattcaccagttattaattgctggtgttctgctgtcgccttgccgtgaattgcaagtattatccactacatgcacgtccttacttttccgaattgtaagtattatccagttcattcatgcccttgtctttcagggtcatatatgctgatataatctttcttgtgccttattacacaaaccgcacatgagtacacacacctttaagatatgctcataagaagcaaaccccctaacctcacaaaatcaatattgactaaattcatattgaaagtgaatagactaaatttagggggtgtttagaactatgggtgtaaagttttggcgtgttacatcaaatattatatagggtatcgcatagggtatttgggcactaataaaaaaataaatacagaatccgtcagtaaatcacgagacgaatttattaagcctaattaatatgtcattagcaaatctttactgcatcaccatattgttaaatcatggagtaattaggcttaaaagattcgtctcataaattagtctcaatatgtaaaattagttatttttttggcctatatttaatacttcatgccagtattcaaacgttcgatgtgataggatgaaaaattttagggtgtgatataaatagggccttatattgaaaatgtataagcgatattgataggttgtgtgaagttatacttttatgattttaccgccagtgtaattacatgtgaaagtttttagagattttttatgtcgaaagttgtacttccaaacgaatttgctatactactatagtaatttagggaagaaactcgatatagatatttcggggaaccgtgggatacacttttaagggaaacatattcgctttttcgaccatgggatacactttaagggaaacatatcctctaactttgtgcagtctgtagttgtaacactgattatatgggccctactttgttatggcccacatgtcagtgatacaattgcacactacataaagttaggggagtcttttttacttttaagattcatgcacaggatagagagcaaaaattaaacactccatgcaaggtgctagagtcaaacccacaacatgccaacgacatgctcgcgctatccaccaccaagctacgtggttttagttataatgcaattacatagtacttatactttagttacacatttgttacaatgtacctatattagttttatattgtaattatatcttaataaagtttttaggaacttctcaatggaaagttacatgggtagttcctttataaaatctctctcatgaatccactattacgaatgattacttgaattttgagagatcacttgatcattaacaccaggatgccagatgcgtcaagaaaaaaaaacactttcaatcgtcaacatcaataaaaactgaatgcatatggatcactgactcattgtcattgtcaaataaaaacagatgaaattcattaaaaaacgaaatccttatgatgctgttacaattgatttcctcccaaaaaaaaaaaaacaacctagattagcaacctgactaccacctgaggagcctcctccctggctgcaatacctgatacagcggatacggcacgtctgggctgtcgggaaaggtcgggaaatccgtcgtcacgccgcaccgcggcgagaactccccgctgcccacgcgatgcttgcactcgatcaccgtctgcatgcacgacctgcagtacctcgccggcgtcgtcagggtcacgtccaccgccgcgtccccgcggcggagctcctcggcgaggcgctcccgcgcgaactctgggacggcgttcgcgtggccccacgccatcacggacctcgcctccgtggtgttctcgttcctcccgcagagctccggcgcgggcccgctcgccagctggacgccgcggtaggacacggccgccgtcgtgccgcgctcgacgcacgccacgctgtacctgcgcggctccttgatgcggacggtgaggtcgaacgtggggtccagcgtgggccgcccgaggtcgcggtccgggtcgagcccgctgacgccggcgacggcgacgctgaactccgcggacttgccgtcgtcgaaggaccacttgtagggatagtagagcaacgctgacatgagcaccagcgccgtgagggcgccgaggatcccctgaaggatattccagcagaaccccttcatcatcacgccgcagtcttccatcgtaagaatcaacgagccgctcgcataagtactcccgcgagcgccccatgtcgacgatttcgtaggtttctctccgtacgcgatctaagcaacagtagaagaaaggcggttttgctaaatatttatcgggtgatttttttcatagtatttgacgtttttctcgccgcacgatgttttccaagatttgtgcaaaaccacggtcagttgattccatgaccgagtcaacctgactttgtatcgatggattcctatacatcacgcatgttagtagccatttatttcttctctctatttctttctttctttttctagttacaaaaaagtttacagtgcacttatactaaaattacagtctacttacatgccatatctactatttttccaaatataattttaattataaagcactgtaattttagttataaatgtaacatttaacacttcagatatctgcatggtttctcaaacaatgtatttgtactaaaacgacaaatattccagttaccaaaatttatagcgcacttgtactaaaacaatgcacttacatgccatatctactatttttacaaatgtaattttagttataaagcactgtaattttagttataaatgcaacatttaacacttcagatatctgcacggtttctcaagcaatgtatttatactaaaacgacaaatattctagttaccaaaatttacagtgcacttgtactaaaacaatgcacttacatgccatatctattgtttttacaaatgtaattttagttataaatgcaacatttaacacttcagatatctgcatggtttctcaagcaatgtatttatactaaaacgacaaatattctagttaccaaaatttacagtgcacttgtactaaaattatagtgcacttacatgccatatctactgtttttacaaatgtaattttagttataaaacaccgtaattttagttataaatgcaactactctactaacgagcacaatcacaggctacatggacggtttctctgtactgttaatttttttttaccgttagatgcagatttgaggggaggaaaaatttgagtgattttttctcaaaaatcacacgacagatgcctagacagtcccgaagaaaggcgttatgacttagcgtccgccgtatcaaggcgtcagttatatacaggtcgcagttggaagattaatccaaggagtaatcagattgggagtttgatttacagatgagttcggcaatgatacgggagataatttgatttctattcgaatgtttcgcgttgatgcgttgtagaattctgcgtttgccgcggccgattacaattgcaaactccatggatgtccacgagtacgtgctggtaacaattgacacgacgtcacgtcaagcgtagaagcccaaatctggagaggaggccatgggtgcgttcccggagcaagaacagccacctctccttggtcgacgcagctcctttcgaccggaggaagaagaagaagacgatgagtacacggatgccttcggtgtatgcttcggcctgtttctggccatcttcgcgatcatgctggtcgtcctctgcatccgccggcccgacacggacgggatggcggcgagcccgcccgactacttcgtcgcgatcaacgccgtctcgggcgtcgacccgtccacggacctcggccggccggcgctcgacccggtgttcagcctgaccgtccgcgtcgcctcgcggagctccacccgcggggcgtgcgtcagggccggcacgtcggtgctggtgtcctaccgcggcgtcccgctggccggcgggcgcgcgccggcggacccggagctctgcgcggggccgatgggcgcggcggaggacggctccgtcgtcgcgcgggggagcggggcgcgcgtgccggggacacagctggacgccctcgcggaggacatgcggcgcggcgaggcgctgttcgaggtgacgctcgcgatgccgtactacgggcagcggaaggtggcgtcgtgctgggacagggtcggcgacgccgcggcgctccgggtgccgtgcgacgtgtccctggtggacccgcgccgccttgccggaatcactggcttcagcgatctacctagtgccgtgtaaaacgacatattcgctgggaactctaaccacttttgagtctctcgtggtttacatgtaatttaaataatttttaaaaattattaaaatatcaataatatatatgataaatcactccattttagtctgtctttttattttttaaaactttttttcaaccattttaattataagcaaaaaatacaaacaatgagaagatggttccttcagagtttataatccaatcacgagatcaacacaacagcaaccactcccacatgtgttgagttgtaactttccgtagtttctagagtagtgatcactcgtgtcctcaggatgtatctgatttggtactttcttggttttctttaaaatctctatgtgtaaggactttgggggactgattttcccccaattattttttcacactttatctaacgttcgtatagagatttggttttatggacgcattctccgtagattgtatttgaattatgttgtgcatatttgtcaagctcccaaggatatatctgttctaaaatatactcatcacctaatagggttcaacatttgtactaaaatataataacctttacacctattctcatcttgaaaaaactaatcggcacatatgcgcttgataagttataagttgctggcgtacgctcagcccaagccggcccacatgcttctcttttctccatacacggtcgcacttccattaattttgacaatttgaccctttgcaaaaaaactaattttacaaatgaaccgtcgccaaaactaatttaaaaaataaccttttgttcagcgccaaatcgtctgg

SEQ ID NO: 44158 - DNA, 3060 bp, Oryza sativa
tatacaaggtatgattccgtataagatttggaatatggtgggccccgccgaacttaatcgattactattggatatgtgttatccataaccctgacaaaacttgataatttgcagttttgtgatacttagtttcaaatctgtagttttgtgatataacgccttgaatctgtagctttttgatagtttgattaaaattctgtagttttttaaaatttactcttttatttttataccatatttcaaattattaaaacttaacaaattcaagtaaagtttgacactaaatttgaaattttcaattcaaaacctgaaactttcaactcaaatttaaaacttccaactcaaaatttgaaaactttcgactcaaagtttgaaaactttaaagtcaaaataaaatatttcaactcattttttaaaactttcgacctaaagttaaaatatgaaagctttaaatgtcaagttgaaagttttcaaatttgatttgaaacttctaaatttttaattaaagtttcaaaaagtgggttgattttttttcaaaagttaagttgaaaagttttaaaatccatgttaaaattttcaaattctagtaaaaagtttactagattttttgaatttgaatttgttgatgaatattttaaaattaattttgttgatgaagttggcctacaatttgagcttgtggtcctagaggcccagtagatcagaggacgagagaagtgagcgcatgccacatgggagaaaattgaagatgcgtgaatgagaaaaatccatgtgggcctggaattatgcgccattttattctcctagcgcacctgcgctaattagacattccctcctcatctaaactaatcacaacatctcgcattttatttccccttctatttcatctaaactattttttgtttaatttttttgcgtatttctttatcttaatctagtcacaacctatactcattcaatttcacacctcatttttctaaaagtatttatgaagtgattattttgggacgtacaaagtactctctccgtccacgtcccataatataatttggagggatgtgacaaaatatagtacgacgagtttggacagattcgtctgttgacagaaaacacgaggcctgggagatctgtttaactccagtgcaggtccaaaactcgcattcggatgtgtgagcgtgccagttgatttgatcatgtaatcaacaagaaacaaagacaaagaaaccgtggttaaatccataaatgatagccgatcggctaagtgccgatgacatatcatttattttaggccgatgtcatatgtacatcgatcggtaagtattagtaagcaaatcagaactaaatctactcgatcggctgtagatattaatgatatataatcctcatatcgatatatacttaaatcaagtgattggaatagatcggtcaccttgccaagacagtataaatcacttagatcgaaacatatattaatagtgggattatatatattcatagcatagccgatcagatagatctagcatgtatcggctaatattccgataccactctatattaaaatattaaagcaagtaaaatataccaaacaaaagcctaatatacttaaatgcaacaagatcttaacataaagggcagatttaacatatcaatcaagcatataggataaaagtagttaaatcaggtaagatcggttgaaactccgatactaccctaatcggcaaccagaaagcaggctagagattgaagttctaagcacgacttaatagatcaaactgaactgatgcagcattaagtatgaagagaagaataatatctagacaatcaagccgctggatgtttcatagagtggtagatatatcacataatccaagttaacattgttatctaacctaatcggctgccttctattgacaggtgctagtcggttataggttagatgacgatattatcaaagattatgtgagatatatgataactcgacgaattatataaacaagattagagtatcataaagatggaagcactaatctcgagaacacaagtcgtcataacaagttttacctcttattgaagatcgaaaccgatgcagctcaacccgaaagcaagaactcgtcgaaataaaactaaatcaaaagggtggcgatgcgccgagattgtattgaacgtgtgttaataattacatagggttcggggtctatttatacccgagaattacaagatatgtccataccggacacgactattatctctaacaaactctaagataccgtaagtctttgcagcagacttttgtccacatttatctctaaggaatttacataaaatatcctaattaatagatacaattgcctttctcaggactctatccatgtacggcaatcatcttgaagcacatcaactcaatcccgattgtcggatacgagccatattgtcagaattggctgtatcacttaacccagtctgactcagacttagccgtagccgatccggactccagccgattcttactctgcctccgcgataacatcgtcgtactagattgtgtcacatccctctaaaatcccttatattatgggacggagggagtgcgatttttttttttgaaaatcttttcttcattagtaatctatataaagttttcaaaatcaacttaccaacttttgtcataatcaatttgtgttctagaataataatcagtttcagtttcatccgtcatccatcctaacaaagaattcatctaggagtacgacggagagagagtaggagttagcgtaagatatatctaggagtattttttatttcgaatatagaataacgatatacggtactataacagattagtatttgtttgatacgtaatgtagcatagttggcccgtaaaccaggactcggatctctttccgggcacccgaagaactccacgtccgatcaacttacgacgtgtttcgatccacggacatatagaccagccttccggccgctccgtccgttccccctcctctctctccgcccccacccccaaaaaaaaaaaaatccatctagtctctcaatctcgatcac

SEQ ID NO: 44159 - DNA, 11602 bp, Oryza sativa
cggcgcctctggtccgagagcagcaagggagcgcggacgctcacagacgagcgacccgtgcctggaatgctgcggcatgatcgtcgggattgccttatttggggtcctcttcggtgccttgggctggttggccatcaatcatcatgggggagtactacgtcccagcgatgccgcagtactccgtcgagatcgcctccgtctccggcctcgacccggcgacggacctccacgccggggcggcgctcgacccggtgttcaacctgaccgtcggcatcgcctcgaagggcgagtatcgcggggtgtgcatcgagccgcgcaccgccgtcaaggtgtcctactcgtacctcggcctcccgctggccgggggccgcgtgccggaggtgtgcgcggggccgaaggagccggccgagaagcggaccgtcgtcgcgcggggcgtcggggtgagcgtgccggggtacatgctggacagcctcgccgaggacatgaggagcggggaggcggtgttcgaggtcaagctgatcaagggagacggcgacaggtacagcaggacggtggcgacgtgctgggccagggtcggcggcggcttggacgataggtgcatctgaatacaaacttccaatcgcgaaaaatcatcacggcttcgtagtgtcagtttatctgaggttttttttcttccttggatggaaattcatggaattttgtcggtcagcatatatgcatttcttttctttgatggattctaccaattggtttatacgtacataatattgtttacaaaatatgcatatgttggaattttcaaatgttgactaaatattatcctaagtgtcaaatatttatgacttaaccaaagaaaggaaaatatttgcatggtatgatcggtctaaaacattgttgatcgatcgagatatataccaaatacaatcggatctatggaagcaaaaagggtgaatagcttatcgaaacccaagtctatttctaatatcaattgcatacaaattgcaaattgcatgtatgtaaacaaaaactaagagttgtggtatattaaatctatttctattttaaaatttaactccacgtaaaattatacggaatattattatttagggattatgaaaaccaccccaaatatcacattgagtttgagattcctccctataggatgatttcaaataccgcccccctataagatgatttcaaatactttcttatttaccagtttgatatttctccccaattgttgttcatgcttttattttttcatctttctgaatgtgttatataatttaaaacatggccctagacacatattctttctcagcgacacaatatcgtatcatatgctcatctttatcgtcctgtatgtaccgaagaaccgtgtactttcagacctcatgaggcaagcacaatagctcatcttttatcgatctcgatgttcaggagcaaagactcatgaccaacattgcccaacgacgtgctaagctccatgaggaaggttgccacggtcatgtcaatattcatataatcgcctgtggggtttgtggccacaagaattagtgagcaacgataatcggagaaatctcaaaacaaactgaatagaggggatatttgcaacaaatcttcttatgtttataggaggagttttaaactcaggtaggcatttagggtagccttttcaattcttttcttgttttaaggaaaattttaaaatccaaaaggaagagagatgatcatatctctaccatatagttcaacaaatagtttcactcatcactcattctttcatctccactatagtacgttcaacaaatggtttcactatcactcattctttcatctaccctatagttcaacaaatggtttcactcttcacccattctttcattcctcattgaacaaatggtttcacttatcactcattctttcattcctcatggaacgatctagatcatctctctaagatccaacgtccctatagttcaacaatggtttcgcttatcacccattctttcattcctcatggaacggttcaactgattcctctcatcttgcgcgtgcatgcccctcccacctgtgcgcataccgccgatctctcctaaaatcatgcactcatggtgatttcagaaaagaaaaaaaaatcatgcactgactatactgtgctaccccccctcaacccccaatctggtgttcatcaagcccgctgcctaagggagccatcgtttcgcttattcgtggaataagcgaaacaacatatttgcaaacgaaaagtaatttgtgaataaaacttttatatacgtgtttttagcgatctaaaagcaaaggttgaaaaataaacttggatgaaaaaaacctcaaaatcaactccaaatttaaggttgaaaattcaaattttggctgataagcataagcgaaaagatgagactgtacgtcagcgtgtcctatgcctaccaagaccccccgctggtcaccgggctggtgccggacttctgcatcgggccgcgggaatcgcggggcgagcttgccgtcgcacgggtgccaatgtgagcgcgctagggtactggctgccaagcctcgccgatagcatgagggcagtagcaatgcgtcacgcctcattgaggaaccaaaatgtccatgttggaaaaaaagcagtcgaagctcacctcagctcccctctccacattgcacttgagctttaggtaggtccaccaccttttcttttcaggccggccccaccaccttttcttctccttccccctctctctcttcctaaagctgacgacgctgacacaaagcggatgaagaacacgtgtctcagtttggtcacacgttcttggtttagtcacgtgaaatgcacacgtggctgagaatctcctatgtgtaagcttgaggctgaatgccacatcactacactgtgaaagcccttaggagcgctcaagtgatgtttgacgtcaatctgcagaagcggaacaggtgggatgagtgcaggacgagagtcggcgagaaggcttcatgccatttagattttgccgaatagttattaggagacattataattccttctgttaatatgtgatacatttattataagaaaatattatgttttcgtttcgttttttaagtgatgtttgacacatttattttgttcaaagattatgtacaaatgcataagatataaattatacataaaatatttttatgataaaacaactcataacaaaataaatgatagtttcgtaaattttttaaataagataaatggtcaaacgtgtatctaaaattcaaaaatgtcatctattaaaatacctaggtaacactaatggtattttctctcattaaatcacaacattctagttatttctaacatttggatgattcacctatatgatgcatatcatgttaatatttttaagagtggctatatttatgatgttatattttgcactaaaagacaatcaaattttcggatatcgaagtttaaactctcccgtatatccacggtggatagaacaaatcaatcgattcaggcgcataaatacataccagacacccgctctgtttggcaagataagattaaaactctaaagtagattccaaagcacaacgtgtgctgagaaagcgatgtccgccgtgatcgcgccgccggcagagcatgagctgcctgtccattgggccgtcgctgagccggacaacactcaacgccgaggtgtactaggaggtgtaagattgcgtatagacaccgtatgcctcgtcatggtttgcatgatcctcatagcagtagccttcttggctatgatgattgttgccatcgtcaaagactggacgcaaccggcctcctactccgtcgcgatcgattccgtcgccggcctcgacccggagacggacctgccccgcgacacgctcaacccggagttcaacctcacgctccgcctcgcgtcgcaacgtgccgacatgggggtctgcttcgaggccggcaccaccgtggcggtgtactacggaggagtcctgctcgccggcgccgccgtgccggcgctctgcgcggggccgcggccgtcggccgaggaggagagcgtcgtcgcgtgggggagaggggtgcccgtgccacgcctggctcgggaccgcctcgccggggacctgcggggcggcggcgcggcggagttcgacgtcacgctcacggtccaaaggtacacctacgccgagtcgtgggatgtcgtgttgtgcagcggtaaggtaggggatgccgccgcgttgataactccgtgcagcctgtacgacgaaaatgtgcaggagccgtcgctggaaccgggttacggcgggtattcttcgcagccggagtcaccaccagagaccggcgatgacggttaaggtgaaggttttgctttgtgatctgtgagccatctgaattttcagatgttgcaaatattgggtttttgttgttgcaatcggtgtgttgcattcaattgaaacatctttgataaagcggctaaatgttctttagtgaaagatgaaacatcaagaaacaatttatgttgaaatatttttttcgagcaatggaacattacgcgcaacattgtccggagacgtctgatgcataggtctatccaaaaagaagcagtcggatgcggacgtttagtcgtcaactcctaacaagaaccggtttcgaaaaaagtgccccaagcacgcacgtcgacatggccgatcaaactatattaatcggagtcgtgcactcccaatcccaactccacaccccatcgtccgtgaggccggcatccccctcccggccacgccacgccaccgtccaagccactaagccagttcatacatacgaaacaggtagcgccgcgtcgtcgacgacgacgatgcccccggacttcggggcagaccaagatcggattcgacgtctcctccgctgtttcagtggcatcgcaatagcggtgttggacgtagtggccgagctcgacttgagcgcattggaggcctccaaggccccgcggctgtccgtcgcggtcgccatcgtctcgggcctcgacccggcgacggacctcgcccggccagcggtggacccgcagttcaacctcaccctccgcgtcgcctcgcggagcctcctgagccgcgcgtgcgtcggggtgagcagcacggccgtggccgtgtcgtaccacggcgtccggctcgccagcgcgcccgttgcgccgcgcgtctgcgcggcgcggaggaagtcggcggacgcggggccgttcgtggcgtggggctcctcggtgcgcctgccggggttcgcgcgggacagcctcgccgcggacatgaggaacggcgcggcggcgttcgacgtcgcgctcatggacgggcacctggtggtgtgcaggggcaggcgggtcggggacgcggacgccttgcaggctccgtgcgtcttgacccacgtggaaacgggtgcggcggtgccgcacacgggaacgtaaagaggctcgccgtaagagtatatctttgctcggccggccgtgatcatcttggcacagttttttcttagcccagatcttagcgcaattgtcttagtatttcgaactgatgcgatttttgggttacttttgtatttcctgcaagattattagtccaaattcaggttattttcttattctttaataatgtaaaatcctaaaccaaaatttctatacacacatcctttacttgtaagaaactcaaatggttatgaacaaattatacattttgactaacctagcctatgatgatttaagtcaatatataaatgtgtggtttcttcatctatatataccgttaaatttaaattttgacgtacatgcttatgaaagaatccttatattatcataatctaccgtagcaacttctattaaatgttcccctcaaaaatatttctattaaatttatctataacacgagcacgtacgtatgtgtgcaacatactctctccatctaacaaaactagcctagtattaggatgggacacatcctagctagtaaatctggacttatattttatattagtgaggttgtctttagttccacgcctaaattggaagtttaattaaaattggaagtttgaagaaaaaagttagaagtttatgtgtgtaggaaaattttgatgtgatgaaaaaattggaagtttgaagaaaaagttgggaactaaactcagcctgatacttactcctcctgtcaaaaaaaataacctagtacattttctattgtaaatttgatacctcttaatacttagatattatatagtattaaattttacattaaattaaatttaatacctcattatacctcaataataacagtaaaattgctcattatataaacaacagtttcttaaccactccctccatccggtcttaggaaacgtaacgtcggtgcgacaccagttactataccttcgttgaaaccaaacgctatattaggtaaaaaagaatacattaacatatataatttccgggatatggaaggctcaaactacgggaactatccgtgtgtattcgatttcagactgcaacatataccatttttaaggcttcagaagctaccaatatgtcagatcaacgtgtataaaaacccaggccgccgtacccctgctttatccatcaaaaacgcgaggacgaagcgaatcgaatacaaacagaggctaaaaatcaacgtacaacaatgctgcgcgcggcgccgatccaagtgcagccggcagagccagggccacctcctcgtcgctgcagcgcctgcgtggctgtctttatcacattcgtcatattgtccgggttgttgttcgtgttagtgctctcagccgctctatttggtgagcagaagtactacgtcgccatagacaccgcctccggcctcgacccggcgacggatcttccctggccagtgctgacccctgagttcaacctcaccctccgcgtcacgtcgtggagcgtcgttggagccgcgtgcctggatcccgccatggacgtggcggtggcctaccggggcctcgccctcgcgcgcgcgtcgccgccgccgcgtgtctgcgcgcgggggtggggccggacggagcaggtgccggtcgtcgcctcgtcggggaacggagtgcgcctgcccggtttcgcgctgcacggcctcgaggcggacgcgtggggcggggctgtggcgttcgacgtcgcgctgactatgccgccgaagggcagagacaaccggcatcagctgtggtgcagagctgtgccggtcggcgatgacggcggcttggggatcccgtgcaatgcaaattcggagtactaaaggtattagcggtgcgaattaacttgtgtcaacagtgatgtgcgtgcatgcacgcgtgtgtctgtgcgaacataatactatgtgtctttgtgtttttctcccgtgatatagacttgattatcttggatggtgaaatactgtaacgttactacagggtataactatttatagatacatgtgccataatttaaaatagggtctaaacctcggacttgctggtgatccgggtctagcaaaacaacggcgtttgtctactatatcggcacacagatgaaacctctcgttgcttgttcatagactgcagatacacaaggaaaagctaagacaccattgccaactagatagcctataaccccatcaaaccaacaaactgggtgcatgtgacccagtctatgattggtgggagtcacttgcaacacgtcagagcgcacccaagcgtagtacttgatccataattctcctagtctcatgggaaatatgaaaggaacggaatcactgaattttccgaaataaggagttatccacggcggccctcattgtgaacataaaggaagagtcaaaatctcgggctttggcgggagccaaacacctaacggagatgttgccatagttccccaatcttttttttttgtaaatattaccttactccttacttaaatattacttccttctacataatgagtgagacatggggaaaaggctagcttctcctctctttctcaatcggttttgtgattaaaagtaattaataattaaaaatagttttattactctgattggtattcgggctaaaattctagaaccaaatctggctcgggtaaggtaacaggcttagtcgaaattaatactacaatattgtgatgtccgattgacgaatttgttttttttcttataactcaaggttaccgagattaggatccatccaaacctgcgacgcgtagtgatcatcaatgaactcgccggaagaacgaggcatgtcagcggcagcggctacggaggtggaagcgcacgcagcaaacagccctcctcgccgtcgcctgtcgggtcgcaaccatggcgataactgcctgacggttttgttggtagtgctcctcttgctcatcgtcggcggggtagttttcttcgtagtcgattccaacacgagaccgcggtactccgtcgcgatcgacgccgtctccggcctcgacccggccgcgacgggtgatgacgggcggggtcccacgctggacccggtgttcgacctcaccgtcagcatctcgccgcggagccgggtaagaggcacggactgctacgagcccggcaccaccgtggaggtgaactaccacggcgtcctcctcgccagcgggcccgtcgagcagctgtgcgcccgggcgacgaagacggggcgggggcgcgccgtcgcgtggggcaccggcgtgcgcttgccggggttcgtcctggacgcgctcgtgtccgacgtgcggcgcggcggggtggaggccacagggttcgacgtcacggtgaagatcccgtccaccggcggtggcgaccgctccagcccggccgggatgctcgtgtcgtgcagggcgaggcgggccggggacgacgccgccgctgtgttgaggactccgtgcgacgcgctgagcgcgaacatcgtcgtgccattgccgaacacggggaggacgcagacgggcggtgccagttaacattgtgtgaataacggcgacgtcgtcgtagcacgctgcagcctgcacgcagccatcgctacaagtctacaactcacaggtcgcgagtcgcgaccagttaattcgacggaaagtctgtaccgtaccgtccggcaacgaagcagaggattcaagaaaagcgactaaacagactttcactgtatactatttatatgtttttttttgcttcacttttgttgaagctattgatcaatgaacatagtgttcattgcaggattatatttgtaaattttttaaacagaattactaaaacaaggccggaaagtattccttcttctacgggaacatgcatctatatgtgggcatgttcacttcttttgttgctgaatagtaaaatatgaattgtaataatcattcgagggcataaacgaatttaattaaatattataaagttaaaaaggatttaaaacagcattgtaacatattcatatgtagaatttttttttgccaaaatctcttcatttagaagctcgggaagcatgcacaattatccaacattctactgcacagagagaaagtactccaggtagttaggtacctcgagttaccaaaacctttgatacttaccgtaaaatttctccttttctaatttgtgttttcttttgatattgtatgttaaaatgttcttagaattttaactggcaaacttttaagggcttattcagttaataggttttcaaaatcgaaggaatacgaaaagcaaaagattagcaagttatacgtactccactccttaggatttttatcaaaagttctcaccccatgataagaatcgtatgaaatagggttataagattacaattcttagaaatttgataggatccaatcctataaaacaaatgatgcatatagaaaaaaaaaactaagattttaattactacaataatcttacgaaaattctttaaactaaatgagcccttaaggcgtggatctttcggtgcttgataatcaattttgctagctgatcctggctcagctcgtagctatgtctcataccggtggttcatgctagcagagttataatcttgatggataattttatcatccatgagaaggtatcaggaggtaccatattttgtaatgtaaaaaaaataaggacaattttaccatacttaaaaagctatctagtgttaaacttggtacttctaggtactaagtatctcaatatatcaaaaattttattgcaaaatttagatacctcaaggtacattctcaaatactataaaattcctcaaaacttaatactttcagataataggtactttgagatataaagtttttattgtaaaattttgatactatagatactttctcaaaaactctagaattcctaatgtcaattggccgatgagtttcaagccgcggcgagatgtcgatttttcgttagtttcatctcttttggtaaatttctaactagtaaaattcaacgagttttgagccggctcgatatgctcgaaattcactaaattcatcgattgtgaatccgggcaccaatttgctccagcgggaagaaggaaagagaggagaagaaagaggagggaagtagggaacggaggaatacatattcggatccgacttgtactgggagacctagctagcttcggagtctccagttgtttccaaacaagagtcgacggaactccaaaaaaaactggcccgccttgctgatcgtgaacacaaaaatccctcgacatcgcccctggtcttcaagccaaaagcagcgacgcgatttgaagttatcgacgaagtccgctctagaaggaagagatgccaagggagcgagcgatgcagatggaagcgtcgccggaagaacttccctggggctgctgcgtctgcgcgtgcgtactcatccccgccgtcgtgctgttcgctggcttgatcttcttcgcaatcgacgacaatgacgcgctgtactccgccgctgtcgacgccgtctccggcctcgaccccgtttcggagcttggccgggatcccacgctggacccgactttcgacctcaccgtccgcatcaggtcgcggagctggttgcgcggggacgagtgcctcgagcctggcactgccgtggaggtgacctaccgcggcgtcctgctcgccagcgggcccgtcgagaagttctgctcgggagggaagaaggcgaaggaccagcacgtcgtggcgtggggcaccggggtgcgcttgccggggttcgctctggacgcgctggtggcggacgcgcggcgcggggcggaggcgttcgacgtcgcggtgaagatgccgtccaaacacaggggtcacgtgacggtcgacgggacgctgatatcgtgcaaggcgaggcgggtcggggacgccgccgcgctggggacgccgtgcgacgtgtccagtatggacatccccgtgccatccccgaacacggggaggacgcagaagactggcggtgccaattagcacgtgtatgaataacgtcgctctcggcttgtggtagtagctacagtacacatccgtctgctgtgcggagtttcatgttaagtttagagttggggctcttttttctttgtttaatctgtttcttttggaagagattggcagttgatcaattgatggcctcaatgtgtttttccgatatagaa

SEQ ID NO: 44160 - DNA, 3662 bp, Oryza sativa
attcctgcagcccgaaacaaaggaagtccaaattataacagtaagaaaaacaatcccgtacgggcctgggaatttttttagaaaaaaaaaagaaagagatcgaccaactaagatgtctgttgaagcctctaagaattgcaatagttctataaggtgacaattttagaattgtttctctacaaatccaaaagatcatgcatacccttatttgttccatcctattaaccgacggtccttattcagaaagtagtagccggccgccgactcaattttatcatatattttctggacgtgactacacagctagtggtagctggtttgtctaaaccaactaccactctatatatgaaagacactatccacctataattttaatacaattttctcttaaactactcatccgatctacgatccgattataccgttgtgttcgtaacaattaaatctttataacaagatcccacatgattatattttgatgaaaaattataaattaattttataatatatataaattacttttagatttcactaaattacttcttagacatatgaaagtaaattcaataaagcctaaaagtaatttacatactccctctggttctatattaattgatgttttggacaagattgaggttaaacttttataactttgaccatcaataactttaaaaatatttagtttaaagaaactagaaaaacatatatatatatttgtctttcaaaacactataataaaagtaaacatgcatttatttattgtatatattataatagaaaaataaggtcaaagatatatcttgtagagcgtgtcattgtccaaagcgtcaattaaaatgaaaccggagggagtatattatagaaataacttataacaaaaagaaagtaactttattgaatgccttttttctcattggacatgactacacagctaaaaatgaaaggaaaaaaaacaatcgatgattaaacagatttatagagagttacttttgaaccatgcaaaagttacttccaattaacattgaagttaggtggtgtttggatccagggactaaactttagtccctaacatatcggatgaatttggagtattaaacatagactacttataaaactaattacataaatgagagttaaatcgtgtgacaaaatttttaagcctaattaatccataattagcgcatgtttactgtagcatcacataggctaatcatagattaattaggctcaatagattcgtcttgcgaattagtccaagattatggatgggttttattaatagtctacgtttaatatttataattagtgtccaaacatccgatgtgatagggatttaaaagttttagtgccatctaaacatggtcttacttttaaaaattgttaaacttacgtgtgttgatctgtgttgattaaattttatttctagataaagtcatatttttatccctacaacgaatttacttctaatgtcgtgacaaagttacttccgttttgttttaagttacttttataatatatgtaacttacttttagactctattaaatttacttttatatgactaagaagtaatttagtcaaatataaaagtaacttatatatatgataaaagtaacttacatatatagtaaaagtaatttataaatataaatattttttcatcgtaatataatcatgtgaaatcttgttgtgaagatttaattgtaacgaacacaatggtgtaatctgattgtagatcggataaataatttaagagaaaactttgtttggagaggaaaaggacatacatgtgctgtagtagacttctcaaaaaaaaaaaatgcatgcatgcagtacgctatagtagacttctccacacgttgaggcgtcgctggttaaggcaaaaacgagaggcctctccaaatagattttacgatattttctctaagccaaaataaaatgaattttagtagatgtgacacattttaatattatacgaatctagatagaaaactagtactagatggatcataaccaaccaaaatctcttatatttcaaacaaagaggatatatttgcaatgcgtgcgactacagaaataaattctaatccttcgagagtcatgtccctcgatcttacatattatctaaatggttataaaaaaatgtaagaaaacttggtaagatagccacacaaacatgcaagttctgccgaatgttattccattattaaaaaaaggtacagtgtaaatttgatctacataagttgtaacaaaaatagaaaatttaactcttaactactctacgtgtgttcatagtattcctttttttacaatttgtataagtcaattttacgtatagtgacatattacatactgtattaatttatcttatcaaattttatcactatttatatactcccttcatttcatattataagttgttttgaatgttttttattaaacatttttaagttcgactatatttataaaaagtataacaaaattactatcacaaaacaacaatttttttttaaaaaatatattcaatgcttcttttaatgaagctaatttggtattatagatgttgctaaatatttcaataaactttgtcaaatataaaagagttttactagaaaaaaaatcaaaatctctatctcttctctactattataaaattttaagatgattttaccggtactttggtaagtcattcgtgtatgagtcgggttttaatttcctttgcttttgcaaatacgtatccgtatttgatattacatattaaattatcttatcaaattttatcactatttatatactcccttcatttcatattataagttgttttgaatgttttttattaaactttttttaagtttgactatatttataaaaagtataacaaaatttctatcacaaaacaacaattttttttaaaaaatatattcaatgcttcttttaatgaagctaatttggtattatagatgttgctaaatatttcaataaactttgtcaaatataaaagagtttttgtcacgccccgaactagtcccgaccggaactagcccgtgacgctccaaattaacctgttaatcgataccagtcccaggaaacagtcctggtatcacaggaagacagaatatcacagcaacagaggtctctttattatagagtagaggtacagtcatgttaggctgcggacagatcccgagctcacaactgcattacaaaagggaagcggaagccaagactcggaccaaacaacacaggcgcgacttgggaactaggccgaaaccctaaaactcatcgtagccggcttgctcctagaagaactcgtcatcagagggatccgcttcatcttcttcagcaactgggggggattatttatatagaggaagggtgagtacgggagtactcagcaagccatgggaaataagtgtttaatgcagacttcaaggaaaggctgttgtttttgcaattgattttatttgatatcttttctgaaaacaactaagtgagtgcttgtcgcgtcccaaaacgactctaaaatacatcctcgaatttatgcctagaataattaaaatccgtgtgaaagcctccacaattaaaatgtgcaaagttaaaagtcaaataaggcttggaggatttttgtatatttcctaaaagcctaaaatgcgtaaataaattt

SEQ ID NO: 44161 - DNA, 8863 bp, Oryza sativa
ttctccaaaatcgctcgacccatgacacagttgttgaagaaagaagagaaatttgtgtggagcccgcaatgcgagaaggcgttccaaactctcaaagaaaagctggtttcctcgccagtgttagtcttaaccggatactcgcaaggacttcatggtgtattgtgacgcttcgcgccaaggattggggtgcgtgctcatgcaggaaggtcatgtggtggcctatgcctcacgccagctacggccccatgaaggcaattaccctacccatgatttggagttagccgctgtggttcatgctctaaagatctggcggcactacctcattgggaatcgctgtgaaatatatactgatcataagagtttgaaatacatcttcacccagtcggatctgaatcttcggcagaggagatggttagaactcatcaaggattatgatgtgggaattcactatcatcctggtaaggccaacgtggtagccgacgctctaagtcgaaaaagccattgcaacactcttgtcgtccgtggcattccacccgaacttaatcaacagatggaagccctgaatctaagcatagttagtcgtggattcttggctacgctggaagccaagccttccttgctcgatcaaatccgcgaggctcagaagaacgatccggacatgcgtggactcctcaagaatatgaaacagggtaaagccgctggtttcacagaggatgaacacggaaccctatggaacggaaatcgggtatgcgttccagatgtcagagaacttaaacagctgatacttcaggaagctcacgagagtccttattccatccaccctggcagcacgaagatgtacttagacttgaaagagaaatactggtgggttagtatgaagcgggaaattgcagagttcgtggccctttgtgacgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggaccgattaaccaaggtagctcggtttattcctgtgaaaaccacctatggagggaacaaactagccgagctctacttcgctaggatcgtgagtctccatggcgttcctaagaaaattgtatctgataggggaagccaattcacctctcacttttggaagaagctccaagaagagctgggtacccgattaaatttcagcaccgcgtatcacccgcagacagatggacagaccgagcgtctaaatcagatcctagaagatatgcttcgcgcatgtgtcctagatttcgggaagacctgggataagagtctcacctatgccgagttctcctacaataacagctatcaagccagcatacaaatggcaccctatgaagcgttgtatggacgcaaatgccggacaccgctattgtgggaccaagttggggaaagccaagtgttcgggactgatatcctgagagaagctgaagctaaagtcagaaccattcgggataatctaaaggtggcccagtctcggcagaagagttatgcagacaaccgacgccgtgacctggaattcgcagtggatgactttgtgtatcttcgggtcacgccattgcgaggtgtacacaggtttcagacgaaagggaagctcgcacctcggttcgtgggtcctttccgcatcattgctcgacgcggagaagttgcttaccagttggagctgcccgcctccttgggcaacgtgcatgatgtgttccatgtgtcgcaactcaagaaatgtcttcgagtgccatccgagcaggccgactcagagtaaattgaagttcgccaagacttgacctacgtggagaggccagtgaaaatcctggacaccatggagcgcaggaccaggaaccgggtaatccgtttttgcaaggtccaatggagcaaccacgccgaggaagaagctacctgggagcgtgaagacgagctgaaggcagcccatccggatctcttcgccagttcttccgaatctcggggtcgagattccgtttaaggggggtaggtttgtcgcgtcccaaaacgactctaaaatacatcctcgaatttatgcctagaataattaaaatccatgtgaaagcctccacaattaaaatgtgcaaagttaaaagtcaaataaggcttggaggatttttgtatatttcctaatagcctaaaatgcgtaaataaattttagtggaattttcagagcacaaataataattattaagaaataaacaaagttaaaatgattttataaaaggaaaaaccctaaaaagttccctttccctccccctctccctcttcggccggtccggcccagctctctatccctccctctcctctccccgcggcccattcggcctcctccccgcgcgcgcgccgctgacgggcgggcccgcccgccaccctcgctgacgggtggggcccacccgtcatccccttcctcccgccgctcccgccgccccgcccgcgccctagcgccgccgccgccgccgcgaatcccgccgcccccgtccaccccgcgtgcaatcaagaggggggaaatattccccgttattccctccctctttccccctatttttccctccctctctccctcggattcgtttggaaatctctcccctaacctcgccggcgccatcaatggcggccggatcttccgcgcccgtttcctcctcgtccggccgctctctctcactcccgaccctatataaacactccccgtgcctccctccaccgtttccgccactcgccgccctctctccccgtcggaatcgagctcgcgccatcgctctctctctccgccgtcaccgccgagcaccggtccgccgccgtcgtcgccccggaccacctcccgcctcggcgtcgccaccttcggcttcaccgcatccccggcgacctcgtccacccctccgtttcattcgccgaccgccggaacgccgtcgaccccgtccacccgagccgcgccgccgtcttcctccgctccggtcgccgtttccgtcgtcgccgtcgacccggggtgagccgtggaccgccgcttcttttccccctccccttcccctctctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgccctcgggtgcggctgacgcgtggggcccacggcgccgcccggtgcgagcccgggtgcgcccggtccaccgtggaccgtgaggctgccgcgtgggccccactcccgtggacccggtccgcgcgcccctcccctcggctgacgcaataaatccatttttaaattaaattttaaatgaagaaattcgcaaatattcatttaaagagcatataaacttcaaatggccataacttggccatttgaactcggaattggaccattcaagtctctaatttttccttaagaagtcaagaacctatttttgtgctttgttcctgcttgttatatggagtttattagagtgaaagccttttcttttccgttggtcgtgtagacgctgcagcttcggaagatccgctcttcgtggaagttgaagccggcgtttgggaaagcgagcaaggcaagtcacaccatccttgaacatattgaatcccagtttataaaaatatgttgatttaaattattgcattatcgctttatttaaattcccgcgtaatcactgttttatttagccatgcctatttacctttgttatgaccttattattgttattgttattatttccttgttcaccctagaataaacaaaaccccaactagtggacattctactcatggtaccactagtatgattttaggtagatgcttcgctatttaattaggtaacattaggcggttttacaactctagactttgggatattcatatcacctggacactttggaattgttggagtattgtggaattggattcacacctccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccggagattccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataacctattcgaatagccgcaccctcggttatgggcaagccgagcaatgtacccaagttagtgttttaattcttaaaacctgcttaacaactaaaatgtggaatggttggcctggattggcttgggacgagctgggacccagggtcgggttgccagttcggtctgaatcatcgtaggccttgggttaagacaggttcgtgtgggttcgccgccttgataaataataatgtatagttctagaatcgtgtctacaaaatagctttgagcaactaaatatctttaaatgccgtttactgcaaccctaaccctttatattctaattcccttgtactcccttgcatttattctgcacttgtgggtgtgtcttgttgagtacggtggttgtactcagtcttgctcaatttttcccaaacccagaagaggagcctctggaagatgaaggctttagtgtctagctcgtgcctaccgtcaagcgcctgtggtcgtcgccctagtcttccgctgtttcccgtttgtctttgtgtgtgctgggccttcgtcgcccatgtaataaattaactatttacgcttccgcttgatatactctgaaatgtatcaactcttggtgtaccttgcctcctgggacaaggaataatacacgcacgtaaggaacgcccgttgggttaattccggtcgtgacaagttggtatcagagccacccttgaccctaggacgagccgtagatcccaagccttagcaatattttcaaaaataaaaatcctgtcttatttgtgaaaatcctctagtctctctctgtcttgccgcttcatttatcgccaaaatctgatctttaaaatgttgcttttctttttgtttttgtttgtagatggccggcagcatcaaccgtcgtggtctggacctgactggctttgttttggagctgcggggcatgtgtgttgtcctggggtatccgcatggagtggactaccagggcaggcagctcccggagcaggagggtgacgatgcagagccccacgctgcttgggaggttactgcagtgatcctcactggctctcccgagaggacttcgttggcagtcaccgcgggtggagattctttctccgccgcttgccagaacgccgctctcctcgccatcggcactcttcaccagcgctacccggacgagttgcagcactcgccctaccgctaccaccctcgccgcggaggagcccgcgaccacgccacctttcgggatgctagctcggaggatgacgctaccatcatgcatctggcgcgcatggtggaggcgtacgacgcggcccgtatcgacttccatcagatggtgcgccgtgggatggtcgagaacagcatgaagatcctggagctgcgtcaggagaatctgcagctgaagaaggacctagacgcagtggaggcgcagctgcatcagctcaagatcgcccagggagaggtctgtcgccccaagcgtcgccgcgtctgccgcagccagaagatcaccgcccgcaagagtacctccaggcccgagcttgttcgccagtccttggcatggacctgcttcgtcgagacccctcgtgccgagcccgcgcccgtggttcctcaggagggggaagcctcaggcgttggtagcacggaggatgcgctgttgctcaccttccgtcctggcccgtcgcagcggtagacgagcagttagtaggcttgcgcgtgtgttctttctcgtttgtcttcttgttggagccgtgtggggcatggttatgccggtgtgtggtataactgtgtcagagcctgtctttattttatttgcctaagcaacttgaactttaatgaaccaatttaatagcagtaataaattcaagaattatggtagtcgtgggtggttagctttaattgtcagctctctctgtttgctggatctgtgtggggttgtcagatggtgacgaccaggagaagtgctaacaccggtgatggcaaccaacctgaaggcagcaaccacaacaaccatggcagcccacctccacctcctcctccgcctccaccaccaccactagacaccaatgccatcctcacccaaatcctagcccagcaggccaacatgatggctgctttcctccaccacatccaaaatccgccacaacataatgctccaccaccacccccacaacactctaaactcgccgagttcctccgcatccgtccacctaccttctctagctccaataaccccgtggatgcattggattggttgcatgccgtggggaaaaagttagacaccgtgcagtgcagcgatgaggagaaagtcgtcttcgccgcccaccagctgcaggggcccgcatctctatggtgggaccatttccaggctacgcagccagaggggcagcctattacttgggcccgcttcaccgccgccttccggaggacccatgtgcccgccggagtcatggcccttaagaaaagggaattccgagagttgaagcaaggcaaccgctccgtgatggagtatttgcatgagtttaacaacctggcccggtacgccccggaggatgtacgggaagatgaggaaaagcaggagaagttcttggcaggaatggaccctgagctgtccgtgcgtctagtctccggtgactatccggatttccaacgtctggtggacaagagcatccgcttggaagccaagcacaaggaactggagtcgcacaagcgccgcttggcgaatttccgcaatcaacagggagctaactaaaggatccgctacaccaatccctatccagggggatcgtcctcgcagcagcaacagcagcaacaacctcgctccgcgccccgacctcaattcgtggtgcgcatcccacagccgcaacaacagcagagtcagcaagggacccgtgcgccccgtcctcctacgacagccgcgcagtctggtcaaggccgcagggacgttcaaggtccgcagcgtctgtgcttcaattgcttcgagcctgggcactttgcggataaatgcccaaagccgaggcgccagcaaggccaagcgcctccccgctccaacaacggtggtaaggatgtcattcggggtcgtgtgaaccacgtgacggccgaggacgtgctgacaactccagacgtcatcgttggtacgttcctcattcattccatccctgctaccattttgttcgactctggagcttcccactcgtttatatctgtgccattcgtggggagaaatcagttgggggtagaaaggcttaggaaccctccgctcatcaccacccctggaggggttatgacagcaaagtattatagccctgctgttcctatagaaattcagggaattccttttccttcggatctgattcttctagacaccaagaacttggatgtgatccttgggatgaattggttggctcaattccaaggagtagtggattgcgcgagacgcactgtcactctgtaccgagggccggaacaaccggttgttttctttgcacccccaacctctgtcagtagtttagaacttcatcagataggactgtcagaaatccccatcgtcaaagagttcggagacgtgtttccggaagaactacccggtatgccgcccaagcgagagattgagttccggatagatcttgctccaggaaccactcctctgtacaagcgaccctaccgtatggcagcaaatgaactggccgaagttaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcaatcagcttaaaggtgccacggtattctccaagattgatcttcgttccggatatcaccagttgcgcatccgtgaagaagatattccgaagaccgcattcaccacgcgatacggactgtatgaattcacggtgatgtcgttcggtttaaccaatgctcctgccttcttcatgaacttaatgaacaaagtgttcatggaatacttggataagtttgttgtagttttcattgatgacattatggtatactcacaatcagaggaagaccatcagcaccatctccgtctggtgttgggaaagttgcgggaacatcaattgtatgccaaacttagcaagtgcgagttctggttgtccgaagtcaaattcttagggcacgtgatatctgctaaaggagttgctgtggaccccgaaacagtgaccgccgtcaccgattggaagcaacccaag

SEQ ID NO: 44162 - DNA, 2010 bp, Oryza sativa
tagctcgtgcctaccgtcaagcgcctgtggtcgtcgccctagtcttccgctgtttcccgtttgtctttgtgtgtgctgggccttcgtcgcccatgtaataaattaactatttacgcttccgcttgatatactctgaaatgtatcaactcttggtgtaccttgcctcctgggacaaggaataatacacgcacgtaaggaacgcccgttgggttaattccggtcgtgacagtgcttgcctcctgtctgaacgcagagtgcacgatttccgaggcgcaactgggtggttacaagggaacatggtataacaattaacgaaggaaggatcaaatgcaacaaattaggtaggctgccattctgccttgcagacgggacaagcagattaagtgcgatcctatcaatgcataatatttttcaagcaacataattaagttcaaatataggctcgagatgttcaaaggtggcttgccttgctcgagatcttgagcttgatcctcgaaatcctcgcactgcgggtcttcgggctccgaaactatacgcaaaacaggacaactcaataaacggcgaaaataaagctctattaattacctctaagcgtgccattagatagatctcgagattaggaattttggaagttgaacggagtcaaacggacctacggttgggaagatattgaatttctaagattattggatttttggtctaaaggaaaaggatttatttaaatcctttttgaaaaagaaaagaaaagaaaagaaggagggggaaaaattagacttccctcgggcggctagggcgcggcccgagagaaaagggacggctctgccgagctaaatgggccggccggcccaacaaggcgacccagagcgcgcgcgcgggcggggaggagagagggagccggtggaccgggctcacctcgcgtggtcccgagtgggacccgcttgtcggtgacacggttcaccgtgcggaacgcgcacccggcgcgcgctagggtttgggggagggacgcggtgcacgcgcgcagttcgcgggggacacggatgcggcgggcccacgcgcagcctcaccgctcgcggtggaccgcgcccgcgagcggggccgaggggagcggctgaccggggtcggctcgacccggtcttggccgagctggggccgacgtggcgcctacgtggctgccacgcgggccggcgggaggtagacgacgacgccggccggaacggacggcggacaacagcggcgagcggcggagcgaaccacggcgatacaggagaaagcgagcacaccgggtggttgcacgggacgaggggagtcgagccaacggctcggattcgccggagggagctcgacggcggcggattgcggcggcggcaaccggcggagggaaaaggggaaaacggcgacgaggtcacggggggccgattcccggcggcgagagcatctacgcggctacgggaatccgtcccttgcgccggattaggaggaaacgcatcgagtgaggccggcgacgagaggcgcttccgagctcgggcggcgacggcggcgagcacacggcgagcggcggcaacggtcggggcggcgccggctagctacggggaggctactcgtgctactacccgagtctaaggggaggagatggaacgaggaggaagaacggagggaggcactaccgtgcgggcgggcgcagttacgagagccgacggcgcgaaacgtgatcgtttcggcctcgggctgaggaagaggagggggagggcgcgcccggagtccccttccgcgtccttgctcgtgccggctcctccgacacgtgcaacgacgaacggcgacggcgaacagagcacgggaggcggcgacaatggcgtggcggcgagagacgaaaaagagggagattggaggaggaatgagcttgggtttataggggcgacaatgtcggtttgggagaggggaaccgacattggacggtcaagccggcgagctggcgcccggctagcggccaaaacgacgacaggaggtgacgcc

SEQ ID NO: 44163 - DNA, 12084 bp, Oryza sativa
ggcccatcgaacccgagggaggcaaaatagacttttgcggagggattgatttgggaaagatttggattcgggattgaactcgatgatagatcggggatttgagatctgagatggcacgaacactagacaacaagcaaagaaacagatttcgcaaatagggtttttaagagataatttttcccgctaggcgccacgacggaacgggcgctacagaccaacccccctaacaagaatctcgaccccgagattcagcacctaagggagcagctccgggaactcggcgcggagaagatcttcttgctcccaggttgcctcatcttcagaatggttgctccattggactttgtagaacttgatggtcttccttcgagtctgacgttctgcctcttcaaaaatcttgatcagtctttccttgtaggtcagattcttttccagctcgatattacccagggggacttgctcttctggaactcgaagacatttctttaactgggatacgtggaacacgttgtgcacatatgcgagaccttcaggtaactcaagctgataagccacttcgccacgtctggcggttatgaggtaggggccgatgtagcggggtgctaacttgccggacatcccaaacctccttataccacggagaggcgatacccgcaggtacacatgatctcctttttcgaactcaaggtcacgccttcgattgtccgcgtaattcttctgacggttctgcgctgtctttaaacgttctcggatcagtttaacttgttcttctgctgccttgagtacgtcaggaccgaataccagtgcttcgcccacctcattccagcacaagggagtgcggcactttcttccgaacattgcctcattcggcgacatctgaatgctggcctgataactgttgttgtatgagaactcagcatacggcaaacaacgatcccaagtgccttcgaaatccagggcacacgcacgtagcatgtcctctaggacttggtttaccctttctgtctgaccatcggtctgcggatggtaggctgtaataaatttagatcggttccgagggcttcatgcaactgcttccagaactttgaggtgaactgagtgcctcggtctgacacaattttcttgggacagccaaatctacacacgacatgggtcatgtagagttctgctagtttctttccatcaaaggtggttttcactagcacgaaatgagctgatttcgtgagtcggtccacgattacccagatggagttgtacccgctaggggttcttggcaaaccggtgatgaaatccattccgatctcttcccatttccactcgggaatcggtaggggttgcagcagaccagctggcctctgatgttctgccttgactctttggcaaatgtcacacaaggctacgcattctgcgacatctcgcttcattccagcccaccagaagtatgccttgatatcttggtacatcttcgtacttcctggatgaatggagtaggcggactcatgagcttcctttaggatgagatctcttaactccttcttggccggtacacagatgcgtggaccgcaccaaactgtgccttgatcgtctatggagaaattggtgtcattcttctcctgtattctttttattaattcttttatcccttcgtcatctttctgagcctcccggatttgcgattctagggtaggctgcactgtcaagctggcagggacacctgactgtaccacggtcagccttaacttctccaattctctgcacaggcgatcttggtaagaccgtatttgagctacattgcaataggccttgcgacttagcgcatcagtgaccacgttagctttactggggtggtaatgaattccaagatcgtaatccttgattagttccaaccattttctctgcctcatatttaactcggtctgagtgaagatgtacttgagacttttgtgattggtgtatacttcacatctgttcccgattaaatagtgcctccagatcttaagagcatgaaccacggctgccaactcgaggtcatgggtgggatagttgacttcatgaggcctgagctgcctggatgcataggccacaacctttcgttcttgcattaggacacatcctaagccttgtcttgttgcatcatagaagatctcgaaatctcttcggatatctggcaaggtgagaactggggcagtggtaaaccttttcttcatttcttgaaagctgtcttcacaggctgtagaccattgaaatttcttttccttctttaacagctcggtcataggtctggctagcttagagaatccttcaatgaatcttcgataatatccagctaagccaaggaagctgcgaatctctgacacattcgtgggcgggttccaagcaagtacagcttcaaccttgctgggatctacttcgacaccattgggggagatcacgtgtccaagaaatgctactcggtctaaccaaaattcgcatttcgagaatttagcgaatagttgatgatccctgagcttttccattatcagcctcaggtgttcagcatgttcttcctcattcttggagtatatcaggatgtcatcgatgaacaccacgacaaactggtccaggtattccatgaagattttgttcattatgttcatgaagaatgctggagcattggtgagtccgaaggacatcactgtgaactcatatagaccataacgcgttgagaaagcggtcttcgggatatcttcagatctgattttcaattggtggtaacctgatctcaagtcaattttagagaaaactcttgctcctttaagttgatcgaacaaatcgtcaatccgtggcaacgggtacttgttctttatagttacttcatttagggctctatagtcgattaccattctctcacagccatcctttttcttgaccaggagcactggggctccccaaggggatgagctaggtcgcacataacctttactctccaattcttcgatttgtcttttaacttctgctaactcattagctgccattcggtagggtctttttgcaattggtgcggtgcctggtgccagttctatggcgaactcaatctctcggtctggtggcatacttgttaattcttctggaaatacgtcgggatattcacagactatgggcaccgactccaaggaggtgacttgtaaacaggttaggatagaccgactcgcggtaggggtgttagaggtaaagcggacttgctttcctccaggtccttgcaaggtgatggacttttcggcacaatctatctgccctttgtgcttagccaaccaatccatccctaggatgatgtccaagctttgcgagtctaggactatcggtttggctaggaagtcaacttcctcaattctaaggttaacttccgggcatatttgagttgcccttatattcctcccaggggaatgtactatcattggtacacgtaaattttgggttttcaaccatttcttttcacaaaagcttgtgatatgaaagaatgggaagcttctgaatcaaacagaactattgcgggtacggagttgacagagaacatacccatcacaacgtctggagcatcctgagcggtctcagcttgaatgtggttcacccggcctcgaccaaagttgttggaagcacgagagccttgtccacttgcctgagagctaggacgagactgagctgccgctggagtaggagttctggcagtgctgccattagcatgccctgagttggtgttggtaggattctgagggcactgtcgggcatagtgacccatctggttgcaccggaaacactgaactgctgacggtcctagcggtgacttgaaagaggtaacactgtttggtgcagtattgccactaggggcacgctgctgtggctgaggtgccggacggttcatctgaggacgaggggcgtagcctggctggcggttagcctgagtgaccgactggtggtattgcatgggttgaccatagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgagcaagcaactggagtctcattcctactgcgattcccttcaagaacttcctgatcttcttcttgtctgtgtccacttcctcaggggcgtaccgagccaacttgttgaacatacttaggtactcattgacactgttgttgccttgcttaagtctgttgaattcctctttcttcatatcaatggtgctttcaggcacatgagctgcacggaaagccgtagcaaactcatcccaagcaatgttagtgggttcagggtgtgcattgcagtaattctcccaccaatctgcagcaggtccttttagctggtgagaggcgtagagcgtcttctcaacaggagtacactgcactaagttgagttttctatcaacatctttcagccaatcgtcagcctcgacgggctcgacggtctgagagaactctggcggacgagacctcagaaagtctgttagattggatctattgttgcccatgtgagggtggccatttccatgcgcattgtgctgataaccggctacggctgcggctaatccttgcaagatttgtgtctgaactgccattaagtgttgcatgttgttttccacatgaggtggggaagggaggcgttcttctccagaattgtgactggcagtgcggtgagagcggtgagactgttccatctctgcattacgggaagctgtgtgatgcgagcggttgctgcggcggggttgctcaacttctgcgttgcgggaagtagtacggtgcgaacggttgctgtggtgagactgctcattagctgactcatgatttgcttctggctcaactctaccttcctcaaaaccaaagcgggctggtgcacgagcagcacggcgggggcggctagccatctaaactcccagatgagggcgaggtaagaatcagataagcacttaggagggcaaggagcaaagtaaatagcaactcagatagcacacactaggcataaactggatttttcaaatcataaaaacacctaatacaacgggtgtggacaagtcacagagctacgccgagcttgactgtgcgcacaccacctaggagaaccggactaccaaacaacacccacatcaaacacacgcacgcactacctcgccacgactccaaaagagttggcggcggaacaaaagggcctaacacacggacggctgctgaagactgcctcctctactcctcgtctgcctggctgcctcctgtagtcggctcctcagtcgaagaaacgtcgatcggctgacgcgaagggaccggcggaacctgtcgagggccgacagcagcacgggccgctggcggtgtgggagctgggtagtcgaaacggaacacggtggaagaaccaacaacacgcttccgcgcagtgcggataaagcgtgggccacggtgggaggaagcaactggggtgtgtccaggggtgtaggaggggctaactgggtgagggtagggggagtacactggtgagtacggcgcacgcgagctgggggagcgcaggccactgggagtgcgagcagagccgcgggagctgtgggaggacaggtggctggcgtggtagaggcgacctgagtcccaagagacagtgtcaactgaggtgacaccctcctcggccagacgggcctccagagcggcgtagcggcgggcaagggagcggtaagcctcaaggagtaggtcgtgctgagtggcctgagcctccgaaagctcaaccatgcgagtcagcactggctgaaactcactgtaaggacaagggtacctggcgtttgcgtggccagaaggaaggcgtggaagctgccggaaggcagagcccccgagacggtggctgtagtcgtaggccaagcgacgaagcgcagtccaggagaggtcctggcacgcgatctggagagtgggcctggccacagtgaagtggtgtgggcgaaggccagctccgtgtatacctccacgagggtaaaggtacacagagagctcacagcgagggggaacacggtccacggagtaccccgtgtactcgggacacgagaagccaaggaagcgggcgaggtctcgaagctgagcgacatggtgaccctcaccaaaaccgtgggaactgaagctggcgttcactgccatctacaattttgaaagagggagaaaagatcagtaaccattttagaaacaaactattgaaaataaggaaaccaaaaaaagccttagcttttcgcaagtagttttgaacttagtacccttagggtcgtcctaaacgtcgggtttcgccctaggggcaagcctgtgctctgataccatctcttgtcacgcccctaactagtcccgaccggaactagcccgtgacgctccaaattaacctgttaatctataccagtcctaggaaacagtgctggtatcacaggaagacagaatatcacagcaacagaggtctctttattatagagtagaggtacagtcatgttgggctgcggacagatcccgagctcacaactgcatttcaaaagggaagcggaagccaagactcggaccaaacaacacaggcgcgacttgggaactaggccgaaaccctaaaactcatcgtagcgggatccgcttcatcttcttcagcaactgggggggattatttatatagagcaagggtgagtacgggagtactcagcaagccataggaaataagtgtttaatgcaagcttcaaggaaaggctgttgtttttgcaattgattttatttgatctcttttctgaaaacaactaagtgagtgcttctcaaacgacacggatgagacagtgcgtctcgtccggtcggagtatgtgcaatgtatcagtcttttgaattgatcaagattggcacccggccaacaattttcaaacggccacccgggccaacaactttcaaacggcctcccgggcctagctgatcccatcagctgcagattttccaaacatcgatcccctttccacaacagcaatttcacaagcagtagtcaaacaaaactatgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccataccatactgtgccaggaagcccaggggtcctccccgacactaccccggcgaatccacatgtctctcggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcggttttggaaaattcatttagttcgcaagcaccgacccaggtgtcgggttttccaagtcttttgtaaaacccaagttttacccaagatgtttatcatattttaagtttgaaggcgaccgtcgatactcgtgcagagtgcacgatttccgaggcgcaactgggtggttacaagggaacatggtataacaattaacgaaggaaggatcaaatgcaacaaattaggtaggctgccattctgccttgcagacgggacaaacagattaagtgcgatcctattaatgcataatatttttcaagcaacataattaagttcaaatataggctcaagatgttcaaaggtggcttgccttgctcgagatcttgagcttgatcctcgaaatccttggactgcgggtcttcgggtgtataggaatcaggagatcaggaattctggaccgtatagaaatcgtacgacgtcgcccgttcccgagtgatcaaacgttcacgaaactccgcataaaactgaccaagtcgtatcgatcttccagggcgcgcggaaaacgaattaagcatgccagctgcgacgacgattcagatggaagcgtcgccggcagaccattggtctccccgtcatcgccggcggtgcggttgccatggtgtaaactggtgccgtgtcgtgagcactgccatcgtactcctgttcgttggcctcgctgtcggcgggttgttttacctcatagctgtgtccaccagggatctggtttactccgcctcgatcgacgccgtctccggcctcgatctcgaccacccgacgctggacccggtgttcaacctcacagtccgcctctcctcgcagaaccaggtgaccaactacccaaactgcatctggcctggtacaaccgtggaggtcacctaccgcggcgtccagctcgccatcgggtccgtggagcagctctgcgtcggggcgcgggagacgaaggagcagcacgtcgtcgcgtggggcgccggcgtgcgcttgccgggctccgcgctggacgcgctcgcggcggacgcgcggcgcggggcggaggcgttcgacgtcgcggtgaagatcccgaccgtcatccacagtggctaccacagctacgacccccgccacgtccacctggggacgcttgtgtcgtgcatgtcgaggcgggtcggggacgaccccgtcgccgcgctgaggactccgtgccatgcgtccagtacggacatcgctgcgtcatacccaaacaaggggaggacgcagcctgggggtgccagttaacgtgcgtgaatatgcaatccgcccgtcatgtggtagtgagcgagaccagtttctacgttactagaatataatagagttcagtttttttttgggtcaatatatattttgtggtgcatgaattatacatatatagccgaggaatcaataatagatcatgatataaaacaacagtccataatgtccattgctgtacactctattatgcaattttgttgctaatttcccgatccgttgagcatgccttcttgtacaaaagggagagacacaccagtcgtcacatcatcaccgtttcaggcacacgccaatccgcgagcctgacgctccgatcgagcacgaaacatatagtcgtacacaattaacgcagctagccaactaatgaaacgcataaaacttggggggaaaaatcatatggacgatccacgagggcgctcaaaatcgaccttcgtcgtccatctcacgctcgaccgccgcgtcctccaccgtgtcgccaatgtacaagtacgggttcttcgccaccggctggaagttgtagaaaacgaacaggtagaaggcgaggctggcggcctcgatggccacgttgacgccccactggtacttgtagctgagcaaggcgaggaacgccgacgcgatgatccgggtgaagtagaggtagccgacgacgacgaggtagaagcgcttgaacagcgtgagcttctggaggttgagcgccgccttgccatcggtcttggatgcctcgcgcatgctgcggatcgaccagatgatcgggaagaacacggcgcagcagcagatgacgtccaccagcaggaacacctggttccacacgacccagtcctgccccgtcggccccgtctccccgatcaccaccagcaacaggttctcgaccacttgcagcgggatcacgatcataagcatgttcttctccctctcctggaacgagtaattcgcaataattctgtaaaaatggaaaattctatagcctggaattctaggttcgttaatggcgagagagagtaattaagatcaatggtgatcacctggaggtagggcttgaggatggaccagccggtgccgatgaggatgatgacggtgaagagcaggacgcccttgaagaagccgaagacgtagaacgccacgtcccagccgtgcggcgtgccggtgcgctccacgtaccacgagtcctccgccgcgcacgccatcttgagcgccttgaacagcagcagcgcgcccatgacggcgtggatccgctccaccgtcgcgcggtgccgcacgcacacgcacgcccacagcgccaggaacgcgaagtacacctccgacacgaccgtgtagatggtcggcagcggccgcaggcccacgggtaggtagtccctgggcccgtcggagatgccgtcccgcacgttgtacatctcggtgtacacgtcgacgtgacctccacgccgtcctggcagttgctgaacacgacggcgtactggtctgggtcgtcgatgctcacggtggtggtgacgccgccgggcgggacgtcgccgagccggagcaccgggagggcgtactcgctcgtcagcacgcagtaactgcccccgccgtcgtcgccgttgtcccccgggtcggcggccgcgtacgcggacgcgttgttgatcttcgggaactgggttcccgagatgaggacgaaccccatgaggctggggtcaaccgcggtgcgccgtgacccccgccggagattccaaaacgagcggcgtatggagatggtcgccttcccgccacgctcgaagccaaactgctcgaacagaatgagaggccgagcgtccgacacgatgagcgtcgtcctgatctcggcatcggcgccccgcacgaggagcagcagcacgacggcggcggctgcgacggcgatggagagggaggtgtccatggaccttgccggcgatcgtacgtgcatgtcgtccaacgctgcggattagccgttctgcttgttgcatcgatcttaatctgcccttcccgatgcagaaatcgcaccatgcatcgatcttaatctaccgtgcaggaggaggaggaggaggaggaggggcggcaatggaaatggacaggcggttcgtcgatgaccatggcgtgttttagggatggccatgagaggagagcgaacggagaagggcgacgtgttgtttctctcccgtttttgcaatgccacggcggccatggtgggcacatttggtacggtgctcccgcgtgcatggtaaatgggcctcatgtgatttgggctgggcgcctgggcagtatatgggcttgatgggctgggtgtaatatttcttcagcgcacaccttctaatttcaattgccttattcaaaattttccacttatcgggaacacctttgcatattttctacttactccattattaaatcgctgtaacatatgcattattccccaccatccataggcacatcgtcgtttttaaacttctctgtacccatgacggggcatacgatctgtctgctttacgattctagcttctctttaagctaaattactttatatttacaactttcttttagagaatttttctatttactttcatgttccctagctggaatcctattttgtgctgttttccactgcattccgtcctactatatgtaaagcggaatatgtctgtctagagctctagggttcttttttatgtcttgggccaccaatgaattgtttacgcatatatgtatgtgtagattcttgagtacatccagaagagtgtagagatgctcagaaatgtaatggattccttttggctttggctctaagattgtagtaaaagagaatccattatattacatgcgggatagagattaattaactcgatcatcaacataggataaagaggcgcaaatataccgttttatattaaagccaaaacataacctaccaaaattttggtgacttaagtagtaaaataaaggaaaaactaaggagttatttagtatggaaatcctacaaggaaaaaaaaactagaaattgctactccctccgtactaaaatataagtgtttttggatggatgagatacatcatagtactacgaatctagatagtctcttgtccaaattcgtagtaatatgatgtgtcacatctactcaaaagccctttgtgtctcgaaattcctatgtttttcatatagtgctatcaaaaaacattttcacaatcttgtggatttactttctatagtatttaatgaggtgtggcatcctattttacaaatttgtgtatttactttccatattattcact

SEQ ID NO: 44164 - DNA, 8436 bp, Oryza sativa
cggctcggcagcgtggagacgcgactggcagcgggaggccggtgcggcatgtagaggcgcggccggcggcgtggaggctggcgacggcgcgtggttgtgcggccggcgatggcagaggccggtgcagcacgtggaagcgcggccggcggcatggatggctagccgagcttcgacgaccggtcccttggccgccttggctggttctagtcggtgcagcaggggaatgtgggcgacgataggttgagtcgagggttgaatgcttgtgagacgtcgtggactatcgtgtggccgtcgatgtggggggcttgtgtgggtaatgtgtagacgccggtgaaagccttgccgtgcctttggccggttcgatgacgacgacgccgttggcgccgtttcccttcttgaaggcgttgtcatggcgctctgccatttgccccacaaatctccaggtgaaaaccttgctccggcctcggacgagcggtgacgacgttacgcgtcgtgtccttcttgggggcatcgcttcgggaaagttccttacatcgatgactattgatggtcccttcggctcaaaagctttctttccttggcattcggcgaggcctaagcctcttgggtctgcttcgttctatgatggacgacacactcttcggttgcttctgcggatgaagttggagctgctcgctgttggggtgcggcgacgcttggcaacgatgacgtgttgtagtctcttccaaagagttggtgctggccatgtggaggaagtggctctttggtggcttggctgatgtccattgtggatgtcggagctgctttcgctttggcgacttttgtggcttcagtgtcgctgcagtggtgaagtcggcgctgctgggtcgcttgggcggctagctcggcaacgataatacctcttctgtgatgtcggagctgttgtgccgcttttgtgtttagcttggcaacgatgtcctgtatttgggctccgctgttgttgttagttgtgtgttaggtcccatgctttcttctgtccgttgggttttagccggttccccataattaaccgtgcagctgtatggttttcgggcctgatttcccttataaattgggtcgttgtctcttgtctgtacagtttctccctctcttaatataaaaccagcaatgctggcttaggtttcaaaaaaaaaaattgctctataagtaagaccggttcggaaaagctggttgttgcaacgctgctgagcagtatctacagtgctacagcagccagccaacagcggtcgtaggagcttttcagccagtacaaaacaactagctgcattcaaaatagtccagaccgctgcagccgaacggttaggatgtgcatcacagctgagattgacgtggaaacaggatactaaacatgccttaattcgaagttgttccatgttctaccaaacaaaatgtcttatcatccatcacattcatatatatgagcaaagttcttgatcatgtcctttgggacgaacagaaaagattttgcctacaactcaaggtcgtaggcaaagaactgtttctcatgcatcgtgacgcaagcatattagcactgtcttttcgctgggccggcttggagccctgcatgatgcatcaatatttttcttcctctgaaccagcagcagctcgcttgcagcacgggcaaatcatacgtacagatcacgttcagttcgccgaataataaccaaaactagaatactaatgagatcgacccttctagtagtagaaatgcaaagtgcaaaagcgccagggagaataccatccgaccagaaagacgcttgagaatcgacgtgccatcgcaagaaaacaaaagcagagaacatatataaaccgggcgatctcgatctcgatcatctgcaaatgcttaacaaataataacagtagtagcaatccaaagccaacgccctgcaattatatgtgcgcatatgtggatcgcccttccctttccggtcgctgggctttatccgccctcgcccatttaacaatccggcgcgcgggacacctgtcgccggctcgccgcgcgactagcgcgccgtggccgcgggcgacagcgacgccgcgcgtaaactaatcggccgcgggagcttgcccgaaatggcagccattgaacgccggaatagtttagtctccccgcgagcgcgcctcgccagaaagcaacgagccgtacgtcgacgtagcagcggacagcgcgcgcggatggtgggtgtgggtgtgggtcgtggcgtggtgtgcgacggcgaacgtcctggcagggccgtgtggcgtgtggcgagagagagggaccgaatgcgtgagccaggtgggcgcgcgggctggagcagcgcgtcgcatcgatcccactcgccgtgacagctacgccggagataaaataaaccggctgaatcgatcgcccggccgtggctaagctagccgtgtaggaccaagctacttacgggctaggctacagggctctacgtggaggcgagggggctctccggtcttgccggccagccggccaggacggcatcgtgaggctgtgacaaagatgccctttgctcggtccccggttaatttagtgaggtctaaagagaagagtaaaagaacatcccattgcaacattctggtgcctcgactgctctcccgccctgatgtgatttattgattaattatacggagtagtaagagtgctgagtctttttaatcagtgcaggaattaaattctactgcaaggttatatgcaacgtgttcccctgttgctcgtaaaagagatacgaccgacagggagaatgactgaatatgcaggaagtagagtgaaattggttctgcttgcctaccttgggctaactactcgtagtcgtagcaaaacgaacaccattacaccaatattcatgcaaaagttttcaaatcaacgcctatttgcagagatcaacacacgtgttaattaattcgttggtcttccactgcaaatctgcaagtcgacggctgtggtctctcctatgtcctatctaggctagttagctttcacgggtttccacaaaagcaatgtgtagccaagcgagttggcagttaacgaaacatctacttcgatctgatccctagtttaacaaactgttcaaacttcaaagcgtgtaaaaggattagatttgacaaaggtgcattaaccagtgatcagtataccattgtacatgctgcggcggcgccgtgcgtgatcacgctccgagatagcgttactggtttggcggcctgcaacgacgacacgtcaatatataccagtaaccgcgtttccccgcctgacaaaacggagttttatacaattctagtgcactaatcaaaggttagcgtgttcaagtgcaagatgttagcacgtaactatatagttttctatggcaggagagctttgctctggtccttctaaagtccagctaaagtgcccgtctttttatctcagctttttttcccatcttacaagctgatgagactaggggtctttctctgatctgccgagagattaggaagttccggtcggttctgagatgtcaactggtggattggcctttctttgctctgccccatcacgcatgctctttatcttcagatcaacagggtaaatgatgagtgctgaactgctgactgggaggatcgactgtgtatggctccgtagtataccatgaattaattcttttgttattttgaacgaaccgcaactgattgtgcaattcttttgttatgaattaattatgaatatactccctccattatatatttataagccgttacaaattatttttattaaatattatgtaaatatattttgataatatgtttgttttatgttaaaatatggctatattttttgaaaaaacttggttaaacttaaacgtgtttgactagataaatattaaaactacttataatataaaacggagtgagtagatattaggatgtgtgacacagcacaaacacgaatggaagtggttttcattttttactccaaatctttgtgtcatgataaagtgaacgcacgtcactactaagcgattagtttttgttctcttgaactagcgcaacttcattgttatatatccacttgcttctttatatattacattttccttggcaagaagtattgctaagttccggatgcaattatgcagaaaacgacttatcgccttaagttcacaactaaaacatggagcatatggccaacttaaatttcatgcacgaataatatagaataaatagcatgatattcttctacatgtgtggttactattacaacatatgtccacacatgttctcattcaggtaataataacctaacttaaaaggctgtaaaagttatactgttggacaaagcctgacaaccattcaaatgaaaaataacttaaaagaccactaatctacacgataagaatatattggtatacgcttgattgctagtagtgcttacctaagtggtgtgtttatttaagagtttgaacaattgaacagaaaacaagtatatgcagcatgtttttattgaaaattgcctgattttgcaccaaaaaaaaggcatagcctaacggcaaatctttaaggtcattaaatttctaactaaaacaaacccacatgcgtttactattagcgtgcaccaagatttaatctcaggtgagtgtagtcatacacttcaccatttccacataattcacattataaattagaaaaggacattactttattctttcgacgccacaaattactgtagctacggtgtaaagaaccatacagtttccatgctatactcccgtcaaagctagaaatactgttttaaacattgacaagttcttcaaaatacatttctgttgtaaaacattttaaaaacctaatgatattataatttcataaaatatttttaaaagcaaatgttctacacacatgatttttatacacccatctagtagtaattaaatattgggaaaattgcaaaaccaccccaaatatcactctaagtttgagataccctccctgtaagaaaatttgttgcaaattcccaccttctaatttaccttggttttgatttaggcaccttggtttggaatatatagtgagtttaccatgaaaaacacaatgaaatgaccatgataacacaacgaaatgatcgtcttatacagaacaaacaacataatctcttgctcccgccgagtgggactcggctgattttgccacaagattcttcatgaatcacgtacgtgtggagagaatgtgtctaaatcaaaccaaggtgaattaggaggtggggatttgcaacaaattttcttatggggaggcatctcaaactcagagtgacatttggggtggtttttgtaattttcccttaaatatttaaaaggatgcatgctaattaattagttttgtatagtttgacttaaacaaatttgaaatgatatgatatgtcgtatgtaaaaaagaaaatgatatgaaggaaacgctagtggttttgtgtggatacatgacttaatccactaccactagagtataaaattcttatacccataaaatattcgcatacgcacttgcgctatcaattcagtgatattagtgattttctgctagcctttatctgtttagcactttctccgttttataatgtaagattttttaacattgtctgtatgaatatagatattaatgaatctagacatataaacggaggaagtatgtattagagtacatatattttttatcggaaactagagtacatgcatcagcgtgtacgtgtgtgatggtggtgtacgtgcgcgcatctatctcccgtgtaatctaaaaacacaacacctgcatatgtcatatctgctacctacttttctcgcgaacgaaatcggacggcacgcactgtacgcaccacgtgcaacacgtaccaagtaccatgttctcaacctaataaaaatcagctaattacctgtgatgatcggtctttccacgcgataataccattgtcacgaacccatcatgcgcaactaacgaaccccgcgccgcgcgaggatgacggatcgctctcatgaaccctacctatccatgaatccatccatccatccagcgaaattcgcttccggcatcatgccatccacgatcccagcggcacaacgcgccacacaccacgggccgctcgtacaagtccgttgtgctgcgtgcagagtgcagcgtgctcctcgacaaggaatctctatctctctcgtcaattctcctctgctctcttttttttgttttttttgtcccatgttaatccctactagtactaagctaaagcgcgctctgatgggggtgatattatcacatcccgatcccgcgatatcatcagcgcccactcactcacgccgcgcacagccgcgcgcactcgcgagcacgcgcgctttacgctttttcttacggcctaaaccgtgtgagcgagcgcgcgggggtgagcgagcggtggattccacagtgtcgcgcgcgcttgaccccgagtcagcgtgcggtcccgactccgactccgcgggcgcggttgcgcgctgttggttggagtacgccgcggcgaacgacggggagagtggtggactggactggtagcgtgacggtggtggggttaggccccggggctcccgtgttgacgacgcggcgacccggccgaccgtataaagggagacgtactccctccgtactcgtaaagaaaatcatttagaacaatatttaagttaaatcttagaaatataaatcatgaataatcacaagttgttgagtttaaaaatacaaaaattatataaatagatttatcttaaaattaatttcataaaagtataaatatattatttttcaataaatatttttataaaaataagaagttaaaattgtgttttggagatcgtgccgtttaaaaaacgatatcctttacgagtacggagagagtataacacgagtacacgaggcgcggcgcgcgggcgcggagcggcaccggaggtgaattcgccaaaacgtggtgtggtcaaagagaccgccccggccttttggcggacggcgacgggtagctatattaatcgatcggatcaaggcgctgctacgctttttacgctgctaagcgcgtcgcggctggcgaagccttgaagcgaccgtgatgccccccgcgacggccaggtgtttaacgagttaggctagcgttgcgcgcggtcgccgtcaggttgtgcttgactgtccggtgaataccatggagaggtagccaaagggaaattaccagcaaggacccctgatcgttgccagtggtcggcctcacacacgtgccaatcgagaagagatgttgtgaccaagttgaagcctgtgctgctgtgcccaagtagcctgtccgtccatgtgttattgtgttgtactactaccatggtgtgtactgctactagttgggcacagtcagatacatcggaccaggagattcggagatcgcttcgagctggatggactgctagcatggtgtacaggaaaagcgacgtgaaggagcatgtccgtttgacttgagcagcagaaactatatatatatatgcgattcggcgaaggcctacaggctacaacttgacggaggcctacaggctacaacttgaccgacttgaatgcatggtaggccatgcgcacgtttcggcgcaagtcaactgcacatatggcaacgcacgagtacgacactcttaagacaggtcaactgtcctaggccagggcttgtcccaatgggcacctgagctggggccatatgtgtatcttgtatctcatcctaaaattttaagccatgtgacatcgaatgtttaaacacctgcataaaatattaaatatagtctaaaaaaataactaattgtacagattgcgactactttgcgagacgaatattttaagcctaaatgctccaatgtggtgctacggtaaacatgtgctaatgacaaattaattaggcttaataaattcgtcttgtggtttgctcatagatactttaattagttttttattagtgcccgaacactaggggtgggcattcggtctgactgaaaatttcggtctcggtcttcggtctttgaaaagtgaagaccgaatttcaacgcaaaaatgtcaggaccgaaaaattcggtctcggtctcggtctcggtcctgaccgaaattcaacaatattttcatacatgcaaagaaataatgaaaatttttaacacaaaaatcacaaaaaaaaattataagcacttatgagttaagactgttattaggttgcatgcctagaagaagtagggatgtaaaaattatagtttaatcctatttaatatagtggattgtaagttgcatttacacttttttgataaatcgatcttttcgatctattcggttaaccgaggagactaactaaattcaccgaacaaaattcggtctttcactgcctaggatcgacttgatgcccgaatttct

SEQ ID NO: 44165 - DNA, 6350 bp, Oryza sativa
  unsure (1)..(6350): unsure at all n locations
tactgtagtatggatccatatccttttccattactgcgcagtgcatagcagtaacaagctaacagcagctggcatgtgggtttatgatgtgtgaggtctacctgtcagctgtaactgttgtatagcaataaatgcgtacaattcatgtcatgctagtatactactctgttaaaaaaaacacattcatcccaacatgtttgtccagattaggattggtttttttttatggaggggtatgtgttttgcatggatgtaaatgcactgtattgttctaaaatctaaaatcttaagtgtacaaaaatattgcatacattcttagatagatagaaatattgcataccacttacatctcttgaaaggaagatatatattggttcaacctaaaaggccacgcatagatcgaacaatcatcacaacatagctatatttttaggaaattttattttgtgaaagttagaaataagtcataatcaacctgggactcaatccaccaattcttgtatgtggctcatattaatcacatactcaagcaagtatattcatgctaaagtttccacatattcacacttcatgttttagggaaaaaaataatcacctttcttttactaaaaaaaaatcacccataacctttgtcaagtcgatgtactagcacgtctacatatgccatattgtacttctcttccaacacatggacactcagctcaacaataggatttaacaagcatgttctcattttaattttgtttggtaaatcggccaagttaaaaaaaagggtaagttgaagtacctattggacctactgttgcagttaggggtgataatgggcctaatattattttctacgaaatttgagggttagatttgaagtggagtggactgaatttctatatattttctttactcaaaaatatattgagattgagttcttttcttctctttttcaactcacctctctcgttttccacgtgcacacttttcaaactactaaacggtgtattttttaaaaaaaaatatacgaaagttattttaaaaaattatattaattcattttcaagttattcttatctaatacttaattaatgatacattaataaaccaccacgtttttcatgcagggaggtccacctcacgaacacagcctgagtaggattgtgaaaggacccattacaaccctgtagtacatgccacaccgtttgacacctatttaccggaaacaacacatttgtagtgatatggatctaattaaccttaccatatttagtttcaaagtgcaaaccttaaaaattagagttatttaagtttcaaaattcatacccttaaataaaagtgattttaaggccttaaggaggaggcacctcatcttaattgtattatttatttattttgtaggagcactgctacacgtactaaatttcttactaaatttgtgtagtatatatttatacatcaacactagattagagaaataccgagagatgcaatactctgttcgtactaaaaagtgtggtaccccggtccatcctaccgtaagaaaaatttgtaactactatcacatatatacttggttgattgagtttttgagtgtgattaaaaggaatcattttgcaaattgtagcgatctggccctccaggagaaatagctgcctagctacaaagtaggaaacatggttggttttgtccttgtcgtggctactccaagcaacaccaaaaaaaacgcatgcagctaagctaggcagaggcagcgctttcggcaggaaatcctacggtaagtcggtaatccatcatcatatcagcggagacaaagtgcggaaaaaaggtttatcaaaattacccgcgacaccgatcgaatcaccgcgggggcatttccggcaaccccgtgctcctccgaaagcagtagtggcagtgggatgcccctgacagcgacatggcctgggccgtggtgatgagtgatgacccggagaatgagagaggcgactgtgcggatatatatgcagcgatagctcactcggttgttgcatcgatcgcttcatcactcgctagctcatcactgcgagcggagacagctcaggagggaggaagcaaaagaagagagagagagatcaagagatagacgaagagatttgtctgtgtaaatcaatggaagggcagcagttcgcttggggaagggaggagggagggtggaggaaagggccatggacagcgcaggaagacaagctgctggttgagtacgtgaggcagcacggcgaagggaggtggaattctgtcgccaagatcacaggtaggtgctatagctactgattgagtggtgttcttgcatgttcgtgaccatttcgatgttctctcgcacgttgtcccaaatcaagaagctcgatatatatagccttttaggaagaaattatagctagtagcatcagtttgcatttggtttgttaaattgcacgttggggcagtcaaacatgcaattagtacatgtttaaggttgcatatgtcgcccatgattgtcaagttgcatgatttgattccaattgcggcatttggtacgatcgtgttttcggagaataggcatttggtgcttgctctagcacatgcattaattaattaaaccgcgtatgaactgcatgcacgcgcgtgtaaattcgtcagaaccttttcctagctgtaaccgtggaaatccttttcctagctgagagttagcttcagatgattagcattaaccaagctttactttcttagttaagtacaaatgggagtggtaggtgtgtcatgtacatgttactttttctgcatatgtacgtcagctaattctgtctgatgctatgtatcttacagtactgagcctgtgtatgtcgtgctttgcaggtctgaagagaagtggcaagagctgcaggcttcgttgggtgaactacctgagacctgacctcaagcgaggcaagatcacgccacaggaggagagcgtcatactcgagcttcatgccttgtggggaaacaggtaacaacccatttgcaaatcctttcgtgatcgagctcgatcgcgtttaattttgccatgaatgtgtaactgattcgatcgatcgcattattctctgtggcggtgtaggtggtcgacgatcgcgcgtagcctgcctggcaggacggacaacgagatcaagaactactggaggacgcacttcaagaagggcaagccgtccaagaacatcgagcgcgcgagggctcggttcctgaagcagcgccgcgagatgcagcagcagagccagctgatgcaaaccggccagcagcagcagctcggccaagacgacgacgccaccagcgcggtggtggacgacaaccttgcggaggtcgcgccaccagccgccacctcgctgacccacgacggcgagctccagataatgcaggagatggcgccggacatggacgacctgctgtactaccacccgggagacatgtcgccctattcctacgacgacctcctcggcagcggcggcggcgagtgcggcgccgtggcggccagcgctggcgctgccgcctcgacgagcgagggctcaagcgaggagctcgacggcggcgccgccacgtggggcagcctgtggaacctcgacgacgtggtgcacgacatgatgatcgactgcgccgccggcgccggctgctgctggggtagcttccctccgctacaggataaaggcctcgctttctactagctatagcttaacgattactaaattgctagctagctatagctacaagcctacacactctacaagtagatgttccttttggtcttgtgcatcgatccaaactgatagcacacagcagcctgtgcgtgtggaggaggtcacacgtagtgactatgcaggtgagagcgagaggccattttgtgtacacgaagtgttggtggataaggatgcaacaccaactatactccactttgagtagctagctcgcctcgatggcatgtttggctcatttgagagcgctttttctaggagaaaaaggaagggaagagtttttttctttgttttgcttttggagaaagaatataggaggactgcaggggggaaaatcaggtgttaaaagtgcatctgagctcttgaaatttgacagttgtccattcgaggccatgtacttccaggcaaattattctatacatcatggtgagaattcattcatagagacgctagtaaggaccttcttatagtacttgtggtaataggatattactcttagggtttgctaaggggcgagcactcgttggcagcgaatgtattccaacaaactccacgtttgtcggggtgttcacgagagccacagacacggactctactacccaaaccccatcggatcagagtttcagggtgaggaacggggggagggggttcggaagtggatgatggctgacactggtgggatgggaaaggatggtggggaagatgggtgccaaccagttaagttgcacggagttgtggattgcggcaggaaagggcatggtgcgagggtttggtagtggtgttgtcgactaaaggaggtggtgaaggggtagaggttggcgcaaagaattgacatggtaaataggacaagctcaatagagggaaacctatcgtggggctcgttggcgtcgagtttcccggtgttaattttgctaagaagaggaaaaatggggcgggtgctagagggtgagggaggaaggtcgccttagtctcttgtgattggaggaggtcgtctcaaggaagaggataaggcgggggaggtttggggtaatcattgattctaagacaaaattaaaatatatttttatatttgtgaatgtacctttgatgttgtctagagggagtgaatagacacacttcctaaaattcactttgcaacaatcagtataggccgaaacttccagtgcgcgcatgaggacctacaaaacaagccaagcaaccttaccttaaaactttcggtttctataatagaacttatagtcaactagtccttggcaacaaagagcactcaatcgaaacttctagtctatatatgtactagaactttcgggaccaacaaaaagctagaacccagtgctcatgttgcgtaagatgactctcatctgtagatcaagcgatcgatttgagcacttgagtgacaattaaaccattctcgtgcatcctcttcatgtacagcatacctggaccctaattcaaaatcaaaattaaagttaacttaaatcgctttgacacatttacaaattctttctcttgtttttaagggtcaccattcgtcaatgaatttcttgaataaaactaatgtctacttatttgttaaatacaccaatccattaatcatttttgacatcaattagtcaaaatcctcttagaggacctagatgcacttcaaatttaaaccaacgtaatttccactattaattcatctatctatcatagcggcctccatcagtaccctcctaaccaccggtccatccccttgattttgcctaagtaagtgggataagtacttttattttttttctttatttaagaggacatccctcatatcttttcatgccatttaaatagttatatttcttaaaaaaaatgagagcatagataaatatgtgatatgattctataaacatacaagtttaaataaaaggaacaaattaaactctgcgtgtactattcacaatcacatttttttaacttgtatatgttgaatttaaacttgtatatgagtaaagtaatatatcacatattgatatatgatattaaaattattactattttgcatggttgacatgtacaacaacaaacgggaggcgacctcctcgagggaaataaaggttatctcctaactcgcgtacatttccatttttttagaaatcacctatgtacgaggagaagtgaaggaaaagcactaaagcagcatggtgttccaatgagtggtccttaaattaaaatcttcttttttaaaacgggcaaaagacttacacaccaatatattagtggaaaagagagagatttgacgactatgatctaccgacaggggcgggcccaaggggtagtccaggtaggcccaagactatcctaaaatttggtccagagacccctaggtattcatttttttggcccatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44166 - DNA, 2504 bp, Oryza sativa
  unsure (1)..(2504): unsure at all n locations
gatcccccagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactaatccagtttattttgaatattcgccttaacactaacttcgaggagccacaaccaccagcctcatgaggcccacaagtaatgcttccatcattattgactctccatgtagggaataaagatctaatgtcaatattttttatgtcccttcgttgtgggactgacttatcatttgcactttctgcagatggttccattcttgctcttttattcgaagtatctttacttctatctaccacacgaccttcagcatattctcctcttgcaacactggtcctagatcgccttatgtctcgacaacagtcaagacataagtcatacaaacaccttgggcagtgtcggtgataatcaaatactggcactttgcagaagtcactgcgaggataatttgaggtatcactacaagccaaagcatagaaataagaatcttcttgtgaaaaataagcaacagacagtaccagcacatttgctcatcaggattgaccttcgccctgattatatctgtcctaagtcctacacaaagaatatggtgcgctagtgttagaaatatgagattattcggatgaaaataacagaaaagaatgttaagaggggaactggaataccataagcttttgtatcaacaccaatttcgaaacattgatcagaataaatctgctttaatactggaaggacagatgccagaatgctatgaagatattccaacttatctacagcagatatctcctgaacccttgccttgtgatttaagagtgaaaataataaatttaagaaaaatcagtcagcataaaaataataaataaatatggcaacggagaagggaaaaactcttggtaaaggttaaatacctttattacattatctcctagtaagcaaactctgcagttacaaatgccacgacatgctggacaaacctttcgaacatcatcaattgggatatcagagtacctacagttcatggtaacattaaaaaagtgtaggacaacataatgcatgtaatgatccaaaagtatccagatggctagatatatgaaatctggccaaataatcacaaggatgtcctggtcaattttcaatagtttggcttcacacttccaacgaggacagtttttctgtgactggagggagtacttcatatgataggtctgtggtgtccggatagccattgcctttgcatttggtgattttgagtgagccgatggggaaaaattagcctttaaaagacaaggcgaagattgtacttctgaaattaataaggtaactagtaaaatatccatgtgctttggctgcatattggaatagaatgccctaaaacagttttttttttaaaaaaaaaaaacattgtatacacaagggttttctatgtgaacaataagatgatagtttgggaattaccattactaaccgcagtgtgatcacaaacattaattgtctagcaacaacttctgaggaataattctttcagtgtgatcatatactaatcataagctgcacacatagttgaagaagatgctagattctaataggtcggcaagggctctgcctagggcaaactcgaccagagaattccaagcaattagcaagcatattacataaaaatacacgatataacactaaagtagcagcagaatagcccccaaggcaggttagctgcataatccaccatctaatgcttaatcgcggtggctaccctgcacctagcagggacttttagaacacaaaaactgagtgctgaaaataaaattctctaataatagttacaaatggtcagtcctcaagcctgttctgaatctactcggaaatcatccttatggggaactaaaatttactctataacagcacaacatataccggagcataccatctcgagatgcagttggtgcagtacccccttctgtcgcagcttgtacaacaaatggtattagcgaccctccggcactgatggcaggttgcggccgctgccgcccccgccgccgagctgcaggcaaccagccccgccgagcccctcccgaccagctcctaccatcacaaggcacgacgaatcaatcagcaccaagcacaccgtggatttacccaaaactagaacgcgtcccggaacccaactcaccgccgcggtgcgcgcgccggcagcattgcccatgggcagcccgtggaccggctgcctcctccgtggc

SEQ ID NO: 44167 - DNA, 42847 bp, Oryza sativa
  unsure (1)..(42847): unsure at all n locations
ctgcttgccgtcggagcgcttgcaccgcagcgcctcgcggcacggcggccgccgccgccgccgcctccatccccgtccccccaccgcggcgtcacaccccgccgccggcgccgccgcggcggaggaggggggtttctagggtttggggagatcgcgcggggaggggaagggggaggaggggagaggaaaccaggaaggggtaaaagcgtgggtgggcgccgcgtgatcgaatgagagtcgcgggtgggggtcaagtctcgggtggtggttgggctcctcgactcttctcctcgttgcgttgcggaggcagccgcgcgcgcggacggtggtggtgggctgcggctgcggctgcggtgcaagtaggaggagtagtagtctccatctcctctccgcttgctggttgctgctgctgctggcgcctggtttttggtgcggggagtagtaactccttccttccttttttttcccctctcctcgtcccccgctttcctttccctgcgtcacacaacctgtgctgtgctgcgcactgtgggggagagagagacacacaggcgaggcgaggcgaggcgcggcgcggcgcagcagcacgcgcgttgcgttgaggcggaggagaggaggaggaggcagggaggagttttaccggattgcccctgcgagatcacgcgggtggagtgagggatttgggcttttttggggtacggtacgagacgagtttgcagaggggccagcgcggtttgcgacaaggaaagggacgacgagatcgcctggtgcgatgcgacgacttggcacggccgtgggggttgggctcgccaggcagtactgcaggacagtcaatgcatctacaagcggcgtcagattgaaaatcgacgctcgtgggttctgttcgaagctgatgattcgtacaacaagaaaagcattaacgccctatgaattactaaaatttaattattacaaatggatttatttgatagtttagagcagtttctatatagaaagttttcatacaaaacacaccgttttagcggttttgaaataagtaccgatgaaaaccgagatagaaactacatcttaaccaaaaagaacagtatcactatcatttcgctcattgtcttatattttcttcatatcacaatgaaataaggaaaggggtagggaatagtgccaagagcaacggcaactattgatgtggcctctccctacaggttaagagggtccgtctcatcttgttgattgtagcactcatgtaccttcaggttgaacgatggcccctgcaattcaactatctaagacgacatgtggtcgagagggtgagggacgggcgatgcctctaatttggagaaaatttgatacgtaagaagaaaacaatccggcaaaaaaaaagaaccttttgttttcgaccagaagcacagaccaccagtttttatttgactcatagcacttccatgacaaccataaatatggtggagtgtttagccgtgagtcagcacttatttttagatatactaattttcccctggtcatgtatgtctagcatagcaatcatggttaggctgatgttcgttccatcatacttaggttgtgttctttctcatgggttcccaacccatttccctcattttccacatacacacttttcaaactgctaaacggtacacgttttgcaaaaagtttatacaagaaagttgctttaaaaaatcatattaatcaatttttaaagttttctatggctaatacttaattaatcgtgtgttaatctatcgctccgttttttatgaagagaggaggggttaccaacccctccaaaagaacagagccgtaatgtcgcacaccacggaagagaaagggcaatggcggcggttgcttgtaaggcattccacgttgggcaaagggcgacggtggtcacgccgctgatgatggcagctagcagcttgtttgacgacgacaactggcagcttgcttaacgatagcggcagttggtggcttgctcacgacggtggattaaagggagctacctgctaggtaaaggcatgagtagaacttatctagaacatggaataagatagaacttgtcttgtgtccagaataggatttaacatatatttctttttttcaagcgataatgcttagtagaacgaggagatggggaacgagaaagaggagatgaggaacaggaaagagatgagtgtatgtggtgtggaaaacgaatggcaaatgagactgaggataattttctctaccccgatctaacgtcgccacctcaaaatacaacagaagtgctataggttaaagaaaaactggtagtctatgcttttggtcgaagaaaaattcttatagtaccaagttatttttggtgctatacatcgaatgttcttttaaatctttttctcctgtcatcaaactcataaatctttttctcggtaacaaaccaccactggatttggctaatttggctaatttcaaccgggtgacaagttctgtcttcaccggattcacccgggaacaagaaggatgatatgaaattaagtcaatgtgtgacagcaacatgaacatggtgagaccagcgagaaaagaaatgaaacgaacgtcaaaatggctaatgcagttgttagaatgatactaatgctttcatgcaaacgtttggatttatgtgtgaatttagatcgatcgaatatgaacaatcctatgggatttacgtttagatttatgttaccatgaacggtaggtactctgatatcctatgggatcgtgtgaattttctatatgattgtttcaaaaggtcttgtatgattttaattttaatggacatttttttcctaaacggacctttgaaataaaggactgcacgctattggatcatatgaaatccatataagatgcctcaatccatacatcatgttttcatgaaaagttttctttgagtctttttctctcctcaccatcctatatttttcctgcagtctaaccaagccatcattcctatatttttatgcattttgcaattctctattttaaacctatttgatttgtaggaaaacataggaaattaaagaattttaatcctatgggaatttctagggagaccttcaaacaaagaattgaacaatcctatagaaaatttctaggaagacgtttgagttctatttgtatcattataatactctgttctgcacatatatttttgtcaaaatcatgtattttatacaataccatagcatggaagataccactcgataatcctttcactattcaaattgtatttcaatcataaattttgaacctgatcgcacaatgcttgctttcgaattcaatggaaaaaagtacaccgaaggtccctcaacttgtcatcgagttacaaaatcgtcaccaaccgtaaaaccggatacaacgtatcccccaacttacaaaaccagtgcaaactaggtccctcggcggttttgactccggttttatccgacatggcagtggactcagcgtgggatccacgtgggccccacgcatcagcctcttcttcacctcccctccctacctctattcctctctcctctcttcttcacgggctccagcgggggaacagctgcgcgggggagcagctgcatggcggcaggctggcgcaggcggacgacgtcgtcaccttgatgtgtcccaaaccagccgccgcgagcgcggcgtggacgtctccatggccgggacgaggagctgcatgtcggcgctggagacctcgttgcccacgacgacgaaccggaataacaccgtcgggtaggcctggatgttctcgcggatccaggcggccgtggcggctgtcctgccgtgcgccagggcggggaggtcgtagttgggcgcaccgacgacgacgcagatgcctgtgctgccgagcgccacgagagcggcgctgtccggcgtgtagaggcggacgacggtgaagccgttctctcggagcatctcggtgactttgctcgccggcggcaggttgtcgccgctcatgccccagcacactccaaccgctgtcgttcctgtctcagattccatctcttcttcggcattcatctgcgccgtggggaaggggaaggtgggcatggctttctcctcactgtccgaacgggctcaccggcccctcccttgaccaagcccagcgagcggtggcggcggcaaagctcggccggggccgagctcgacggctacctctccgcccctacgtccctggatccccatccctcctcaccgctgcctccgtatcctcggattctcatccgtccttgccgctgcccccgcgtcgccggccgccgcgccgcgctgccacggcacatggctgctgccgggcagcccacgccgaaaccgccgcccaggattcgcacgactgcgctgacgcggccatccttcgccagacagcgccgttgcacggccgctctgcccccgcgccagggtcgtcgcaccgctgaacgagctgccgtcctacaccatgccgtcgtgccgcagagaagtgagtgagatatgaggaagggagagaagagggaaagagagaggatgctgacgtggccacactgacatgtggggcccatgtgggtcccacgctaactcagccgatatgtaggataaaatcgaggtcaaagccaccgaaggatctgctgtgaccggttttgattagttaagggacaccggatatctggttttgcggttaggggacgattttgtaacttgatgacaagttgagggaccttcggtgtactttttctaattcaatgtactgtgtaaagctgggaaaaggccagatccattcagagtttcagacagagcccaacaaaaaggaatcaagaggtaagcccagaaactgaaggtttacacgatcaaagaggcccacccgatgatcatcgggcgtcatcgccattgacttatgggccttcatataaaattcgcatctcgatcgatgggcctcatactgtgcaacttaaatgagtgaggaattcgattcatcctcgacatatgtcatattgtcatggatgtgtgtttaatttggtggtgaggcattggcaacgagaaacgcaagttcttttgtatagatgtacacactttctttttgacagaatatgttatatgtatatctaactatcgtgtatctaacaattaccccctgctaatttagttgggataaaaatatgattttttttgacaaaaatattatcactttgtaaataaattaaaagaaaagttatttgccaaaccgatcgagtacgtgaataattacactgagtgaggttatcatgaactcataagagtaaagtccatcaccggtccctaaacttataccgctgtgtcatcccggtccctaaacttgcaaatcgaccgttcaggtcctcaagcttgttcgcctgtatcatcccggtccctaaacttgtagatgactcgtttaggtcctccaacttgttcagttgtgtcaccctggtccctaaacaagacggtctaaaaactttatatcaaaaaataattcataacttttttatgtgaactctaatgaagacaaactttgtatcaaaattgtaaccctcgacgtgacctgcaactttgtagttgaaaagttttttaattaaaactgtttagggtcccaaaatattgttgcatatttatagattttgaaattttaattttaaaattacattttgggacaaaaaatgacttacaataaaaaaaattcaactacaaagttgtagatcgcgtcgagggctacaaatttgatataaagtttgccttcattagagttcacatgaaaaaaatatgaattatttttaaatataaagtttttataccgtcctatttgacccagatgatattcaaatccaagtttagggaccgggtgacataactgaataagttggaggacctaaacgagtgatctgcaagtttagggaccaggatgacacagtcaaacaagtttgaggacatgaatggtcgatttgcgagtttagagaccgggatgatacatcggtacaagtttagagaccagtgatggattttactcaactcatagtccacttgagcatgcaccatgtaatgagtaacacatatgaattattaacggtattgctaaaattatgacgccacattttttcatcatctctttcctatgtcgtctatatgtaagtatccttctatgtcctattttcagttgataataaattacttttaattctaattctatatacatggtatattagaaaaaatataatgtaaatattaaaccttacaatataattacaatgaaataggtgataatttacatgtaaaaacgattttactatttttcattcaaaaaaatagatgccataaatataagctacactcgttaattaattagtgctttaactacttcttgagctattttggactgataaaagtatgcacaaccaattaattggcaacttcaataatagtcaggattaaaagcaattttttttaccaaaaatgtgatggccaaacatttgatttcttaccctaccatattattgtaagaaaccaaaattgcccgtacttcctcctagatgttgcacagtgttttgccaatttctatgcactgcttcacaatagtattaatcatctgcctgcacgtacggagagaatcaagagtacacctccgtgattaactattgcagattgaacttcctcacccgtgacctataaagctgtactgactagtgactactgagatactccaaattactgtggtactactgtttatgttttaggacgaatgcaaaatcaatcattccatgttttctgttttcttcgtcttgatttgaatcttgatggaaccgctaggactctctcgttccaaaatataaatattttttagctataaatttgaataactgtgtgtccagatttatagctaaagacgaaggtaaagatggaaacggaaagaactctatctgtgatctgtctatagttggatccttttcgatacttcccagaggcaacagggttaagatttggtttatttggaattcagctacgtggccagtggccattcacgcatgcccgatcgtttttctgtgcgacgcgcggtcaccggtgaccgatcgatttgtcaccaattcctgacaaatattgtgttaataatttcaccggactttatatatctactccttcgcttcgtactataaaacattttaactttttttttccaagtcatttgactatcagttcatagaaaaacataacaatattttcaatattaaataaacatattatcaaaatatatttaatgaaattaattttgtgttttaagagttactatatttttctataaacttagttaaaagtttaacttataaaaaggcaaaacatcttttcatatgaaacaaagggactagttgcaaattgatcaaggcataatttcaggcttacagctgcaattgttttttcaatgcacatatacagaaacaaatttcatactgctatggaacaagggaaaaaaaatgtcattaaccgtgtcaagagtctgatatggctcatgttttgaacgatagaaggaacaaggggtggcagaggggagatctatcttctccctctactctccccccctctctctctctacgcacaaaagattctgttattgaaatttggtatgggccatgcatgctcaatcttacctacaactctacaactgactgctttttaagaatcatcgttaaaaagttgtactgtagtacgttttgatctaactggaatttgtactattttctataaaatgctccactagcatgccactctttttagaaggtccgtcctaccaatggcatacaactctctcctctctgcgcggctaccctccttctctcaaatccggatgggggaggggaggcggcggcggcgacaacagaggctgcggcgcgggatgggaggaggatgccggtgctggtgcgggatgggcggaggctagataggtacgagtccagatccgccctctcctctcccaaatccgccatctccccccagatctgtggtggcggagaccggggagggggctcggcggcggcggcacggggtaggggctcggcagtggcaaggggacggcgctcagcggtgacgacgctcggcggcagcggatggcgcgtggtgggtctcggtggtgacgacgcgtgctggcagcggtgacggcgcgcggctctctcctctctgtgcctccaacctcccacctcccttcgcctttctccggctctccggctcgacagcgaccgcagcgacaggacggcgaccgcctctctccagatcgatttgcttcctgtaaaggatttgttgatgcatgctgactgctgtgaaatcgatttgcttcctgtgaaggatttgtttatgttaatttttttatgtgagtctgctgatttgttgaatatgttgatgtgaatctgctgatctatcgatgaatctgttgatgttgatgtgtttttttgttttgaaaatgatgttgaggtgtttttgttttgaaaatcatgatgaatatgtggatttaattcttttttgggaaaaatctcttcactggcagttgacctaatggtgccactagcgaaaatggtcatttttgctagcggctagcttaagacagctgccagcaaagatattttttcgctagctggcgtcactggcctttgctttgtggcggcttcaaattccaccagcaaaaacttaaaataaccgccacaaaagatggttttcgtagtagtgtcatctattccaaaagaggctataaatcgttagattattatgaactgtaaattattatgaaatggaagttacatgattatatctttcgtaacgtacttcggtactatatactagtatatatttaagatttcaaaacattatttatgagaaaatagtagttaaatcttaaatataaataatgcccggtagcaataatacagtaaaacatagataatctgcagcttgtttcttattgatgtgtcagggaaaggggaaggttaggcctcctcccatcacgccgccgcaacctttgccgcgccaccgcgtctgcatcacctctgctgtgtggggagagaagggaggagctcgggaggggagagaagggagtggagctcgcgagcagagaagaagagaatgggtaaagtggagaagaagagaatggcaaagtggagaagattaaataaggcgtatatttatttacaagcggtacatttagcctccgccagtgaaaatccaatttttgctggcgattgcttaagaggcccgcctcgaaaaattgagttgttttttatggcggatctcttagtgtgaccgccagtaaaaattgtttttcgatggtggtccgtagcccccccacccctcattatgttttcgctggctgtttcgtatttttctaccagcaaaaattatagggcaacgtcatgaaaaatcgttttttaatagtgtgatactccgtatgaggacattcctaacccaatgaataggatggtatccataacattaaataagctgccacataagatgaaaaatgatgtggcaagtgaataaatgaggaaagagaaggaaactatgtcttgcatgaaatatgttttctacacaacatctgagatatcatgtgagataagtagcattaaatttaagtatagaatagttgtgcttatattgaagagtagtgtctagtattggtttcttgataatgtggagtttatagaaactatgtctagtgtcttgggttgggaatggcctgataggcaaatttaggttatacgttttggggattgggttccccggcatataaatggagctgcagattagcgtattaattaagtactattaaaaatcaatataatatttaaagcaatattccaatatatatatttttaaaaaaggtttttttaagtagattaggaagcatgcgcagtgaaagctgggaaagtgtactcctgaacacactcttagagaataacaaaagggagaaggttcatatgaatctttttggatcacagatctggcgcgcaactacaattaaattctgttgaaatttacatggaatggagtagggggaggggttaaaaatggtgactgaaattgctaatcgaccatggtttcagtaaaagtggtacgtttccgattccagccatacaaaaaattatatttttctaaatcttttaagcattatattgcaaaccgacactaaatagttaaataaattgataaatatggctgattcttgaccaaccgagaaccgttcccgtagaggctaccattttctgaatgttttcatccccaattaatggctattttataaccctagctaggaaatttgaagggaaatcacaaaataaagccgattaccatttggtacgtactactccattaaaaaaaaagcaaatcctactttgtagttaggattgaattctttttgagaccgaggggtacaccttcacggtcccagtagtagtagtaagggtatctataatcagggacactctatggatgccctcactaactgagggcactctccgaggaactcatctcacaattgaggacgctctagatgtgctccctaaaatatgagctaactggatgaagatactcaagctcacaatgagtgtcctggcccctgtagcctcaactgaaaaaatccgaaaatacccctccctacagccgctcctatctctttctctactcttctccaccgatttttcctccgctctctcccccgccgctccgtttcctccgccctccccttctacctcgccggcgccggatcccctctctctctctctctctctctcgtcgccgcctctctctccctctctcgtcgttgcctctctctcccttgcggtggccgatggcaagcggcgccggcggggtcgtctccatcgcgcggtcgtcgctgggtcgggttcacgacctaggccgacgccgtcgccggccggaggcggcaaaacccccgctcgtcgccgcctcaccccggcaccgtcgccgacctcggttccggcgccgccggcagccggagacggcagatccggcgccgtcgtgcgtggatctggccccctcgtggccagatcgggatggagcggcttcggccgcgtcgcatcgaggaggaggccgcgacgccggcggaggaggttgcgtaggtcgtcgctggcatcgtctccgccgctcgtctccctctccttctcgccgccgactcacacctctctccctcgccgctgccgctggcctctctctctccccctctctctcccgtcgccggcggccacgaggagtggaaggggaaatttttcggtaggaaaggtgtccacaggccacgctcgtgcccaacgcgcccccctcggctgtgttcccctgccaaaagcgagcgagggacacgtccccccaacagagggacgcgttccatcatgggagatgatgccaacgataaagcaatcggcgacggacggagggggatagggggatgacctggggttacgcattggtgatggcctaatacagtgtagcaataattcatgcccggccgacccggtcccccccttatctgatggccttccgcttgtcagcgtcctctgtctgaaaaaacaaaaaaaaaaaacgcgcatgcatgcgatgatacagtcagtgggtcgagaaaacgaagatgatatgtccaggcgtacggacccatccatcgagcgcatgatgatataatgtattagttgcagcaattctagcgcggtggaatgaccgcggctgctgccgctggtcgctggccgctgaattgcttgattccttggggccaaaataagggcatgtttaattcgcgaaaagccgaaaataaaatttttgagtgtcacatcggatatttgaccggatattgaaagaggttttcggacacgaatgaaaaactaatttcataactcgcctggaaaccgcgagacgaatcttttgagcctaattaagccgtcattagcatatgtgaattaatgtagcacttatggctaattatagactaattagactaaaaagattcgtctcacgatttcctccctaactgtgcaattagtttttttaatctatatttaatgttctatgtatgtgtttaaatattcgatgtgatgttttttgaaaaaattttgggaaccaaacaggcctaatccgccccatcgatgtccacggagagaaaagctatagtgaacctgatgccgtcaaatatcatcacagaatatgtcccaagtctagctatagctcgagtatagccgggtcctctgcctcaattggtgtggactgtggagtggtggccctgtatgaccgtaggcgccgttgatcgagctggctgggctaactataagctagctacacgtgaatcgatcaaattaatggaaggatataccaatcaggaattcaggatgattggcatggttggtgcagtgggaaggtgatcagggaggggaggagggccagtggatgtgtataccgatgggtagttgggtacacatacatcctttccaagctgagcgatgcatgcattcctcttaccaactcacagcagctctacattcttttttccttttttttttttgggaaaactgcactggtagagaaaccatctttggtcggttgcccaaaatccataataattccggtttaaataaaaaccgggactaaaaatgatctttagtcccggttgaaaaagctgacgtcactttttgatctttagtcccggttggtaacactaaccgggactaaagatcatttttagtcccggttcgaaagaaggcaagatgtgttagacccctctatgatctttagtcccggttggtagatccaattttaatcccggttgcttataacaaccgagacaaaagaaaaacgaaaaaaaaatcgcgccgcgcctcctcgagaggaccaacagccttatcctctcatccactcatctctcctcctctcccttatcttctcccatcttctcctcccttctcatcttctcatctccttcttgtcttcttccctcttcctccccttcccctctcctccccctcccctgcggccgtggcagatccctccccgacgcaggcccggccgcgcgcggcgagcggcggatgcagccgcggcggcgcttctgccgcccggcggagggcggcggcggtgcaggcggcgcgtgtggcagaagcggccgcggcggcggccgtgtggcctggcggagggcggcggccaagtgacagcggtgaagcgatgaatttgcttttgagaatttgtggtgtatttgatctgtgcgatgtaaatatgtgatgtatttgtgatgtttctttttagaatttgtgatgtatttgttttgattatttgtgatgtatttggatatggtggatttgtagacgatcgatttgggatttggagatgatcttttgttctgtgattttagggatgatttggggatatggtgaaatcaatattcaaagtaaaaaacaataaaagaaaaaagaaaatactaaccggatctggctttatttttagtcccggttggtaataccaaccggggttaaaaatggctccatctttagtcccggttggtgttggtgttaccaaccgggactaaagatcgatttttagtcccgggtatttgaaccgggactaaagatagcgatctttagtcccagattcgtagtcccggttagaaaaccgggactatagggggttgcaaaccgggagtaaaaaaacgtttctccaccagtgctggtaaaatcttaccttctacacgaatggggccatgttgagttttggaggtgactgggctacgtcgcccgtcaaggaaaatggttttacccctacgattgattaccgccagcaaaagggacgtatttttatggggcaattgcaaatttaccactactttgaatcgttattgcaaaactgccactagaaaattgcaaaaatgtcattagaactgtcattcgagtggcatcccnttgcaantattaaaaaccggntggtaaatttgcaattgcccctattttcattgggcacaggtcgcttggcgccacctttagccgtcggagaaaactcgatgtggccattagtagtgatggtctatcgatactttgcaatgagactgtcaccaaaaaatcatcggtagaaattgaaaaacattttcgctggcgcacatcattagctggacacgcgtgaagaatattttcgcaggtgactgggctatatttgtccagcaacgaaaacggtttcacccctgcggtcgattaccgccagcaaaacaaacgtattttcagtagacattggtcgcttggcgccacctttggcctcagagaaacctcgatgcggtcattagagcaagtttaataagtttaatagtatagccaactactaactccaaatcatctatagccaatctaatagctcattcatacaatagttattacctactacctccgtcccatattacttgtctttttgagtttttggttggcaatggttgatcattcgtcttatttaaaaaaatttggaattattatttattttggttatcatttgctttattattaaaagtactttacatatgacttatctttttttatatttgcactaattttttaaaaaaacgaatggtcaaacgttacaaataaaaagtcaaaaacgtcatctattatgggacagaaggagtataagtatatatatactacaacattgatatatatccaacctctcatacacacataatgtccgtgctgcattccttctctcttgttttccggtattgtactcgctattagtggtgatggttctatcgatattttgcaatgagactgtcataaaaatcatcatcagaggaagctgttgaagaacaaataatacaaccaccaccgccatgcatggcgcgccattgatgcgttcctctggactcctccgatcccctctgtttatccagctcaccccgtccgtaggaccccccccccccccccacattgaattgacgggtcgccctccccgcacatgcatattccgttatctgtattatcctctcccggtgtccacgcgtgccattgcattgcatttcattcataattcatccattcattcggtcaaccggtcacacggtcccagaccctacctgcctgctgccgtgccactgaacctagctatgctttactgcagtcgcagccggcgatcgacagcagcgtcatcgtggtggtggtggtggcctatataaaccaaccacccccaccccagcaacgttatagcagtaaacaacatctctcacgaaaacatcgaaaaaaaccgtgtgagttggatggcggggacgggggtgtgggtgttcaagagggacggggtgatgcagctggaggcggacgtggaggggggggacggggaggaggcagaggaggctggtgtacgtgccggcgaacgagacgatggggtcgctgcaggcgctggagcggaggctggcggggctcgggtgggagcgctactacgaggaccgcgccgtggtgcagctccaccgccgcgacggcggcgccgacctcatctccctcccccgcgacttcgcccgcttccgctccacccacatgtacgacgtcgtcctcaagaaccgcgaccacttcaaggtccttgataactagctagctaatttaacatctgtcgtccatgatcactagtatgaattatgatgatccatagctatcagctgccagctgcgtaccacttctactcatcgatcgggcacgtacgactgatttttagcatatataaagcgtgtgtgtacagtactgtatggctgtattatgcatgcacaagcaaaaaggttaatttgcttgattatattgatgagcttgcagttaacttaattaatatagtttggcttggttaagtttcttgtgtgacgcgtggagaacgaacacacacacacacacacacacacacacacatatatcagcatgcattattgtgtgctgtgtgtacgtgttcatgtacggccggactagtccggattaaattaatggccggggcattattaatgattgtgtggccgtgtaaccgtgttgtacactgttgttgcattagtgtgtctcaaaccctgctcaatgtgcgcctgcaaaggtgatgtaacacgaatatatatgtatacacacatttggccgatcgatttggcttaatttgctacactaattattactacaagtttttttgtgtttgcgagatattgtcagttgtcagctttaatttatatgtaaggatcgatgtcgcaaaaggttaagagagatcatactaataaagtataggccatgagctgctcaaaatatgcatggtatttacgcttggcacattactagctagctagccagtagctgatcgaggttctggactacatcgaacgatgtttaatcaagctgcataataataataataataataataataataataataataataataataataataataataataataataataataataataataataataataataaaatctcctctacgtaccctcgaaagaaaaaggaagttgcccccacaatatgttcaacatttaattccacagtttgcacgttctctgatgaattttgtatgcattgcccattgatacgttcaatcagctagcacaggtcggggatattaattaagggcaaaaagaaaaaggacagcctagaattaataaattttatatcgcacataataaatggttcacaatcgtgcgtattagctaggtactccatttatatattaagaaaggtgaatatatatgggttattaattattgggacaattgcttatatgatcccgttttgaaccctaactgctaatttgtctatatttttttaagtttgcttatttgaccctccttttccaaaatgaagcttccgtctgaccctgcttccactaacccgttaaattttgatttaaaatacaaaaagaatgtaactaatattcataatacccataataccccttaggaaacctatccatccactgaaccctatccacacatctctctctcgttcttgcgctagttgcggcggcggagtgtgtgtgcaccttttcttttcctttcatacacacgtcccagccaaaaaagaagactcattgattttctctttatacccggcccaaaaagggattgggattcggtgacattgctctggtgacataccctgtgacaatgagtcactgacgtgtgggacccatgtgggcccagcacatgtgggttccacatgtcagtgactcaaaatgtcacgggggaatgtcactgaatctgcgtcccccaaaaagaacatcctggcaataaaaaaagattgtttgttctctatccatttatttttcagggatggggtatggtaggcataaaatttggatagggagattatatagaagtataactttcttttgaaaatacgtaaatattttgtccgagacgtggaaagtttttttttttaaatataataaatgaactttcattcgtattagcttaaaacttccaaaacatttttgaaatgcaaacaatttttcaaatattcccggcctgctattcacaatgaaagtgcacaaaatttggcgcaaaaaagccatctttataggctttatttttttatttccctttggaattcaatcaattttatgaaaaaaaggctgagaaattatacttttctcatacgtcataaaaactatatttttatccatttgactagatttgcacacgctggcactattttaaaattgaaaaaaaaaatagttgccaatcaacaaacatgaggagtaaaacctcgtgcttagactcgtacttgtctgcagtatagaaagcaactgtttacaataggtttgcacaaagctgacgttgtaaaataaaaatatgctctattcgagtaatcaacaaacattcttgacttatatattttactaaatttaactagaattaaacaatacatgaaccatgaggtccaaaacatgtacagacttgaaaacatatgtccctttaataagaaaaaacctgggaaggaaaatgacttctattatataataagtctttgtccgccccctgtttgtacaaagaaaatggcatcatacattgctaagaaaaatgctttttatctataatcactgagctaccaatccctgagaaattgaaaacacagatgtaagacataaaattaggttaaaaaaatattgcctagctagaagcaaaactgacattttttttcatgatacctatggccgccgctattgtcgtgcttgcccctccccgccacgccagatgaggcaccactaccaccacctagtcatcaacggcgaatccgcccattatggcactggcactcactggtgcccatcagcaacgctctcctcccgcaggcctccaatggtggactgcccctcgcgttgccgcctgctggtcgctcccatcgtcggtcgtcaaggagagtcgatggatgagaggagagaaaatgggggagagggctatggagtagagaggagaggaaaagacttaacaggagaaagaaaagagatggagccggtcgggtgcaaatattcacaggcatgcctcttaagacgtccacctgtgaaaatggatttttataaacgggtctatattgggagtttttcgaatccttttacatatgggctttcttttagtccgcctaaaaaaggtgatgttttcacagaaatcgtttttcaatattgagttggtgaaaaggtaacacataacatgtttcgtcatgaaatataacaatctaatataaaattaaacaaatcttattatttgaaatctagacatataaacactaatgtactacacgcatgtagacatgatgtaaccaacaggaggcgaagacatcgatcatgtgaggtcacatcaacatatatagtgtaacaaattaacaatctacttccaaattcggtgtgaaaataaaaccctttatttcatcaagaagagggttatgcttgacacgagtgaacggatggccccccggcaagggcttgttgcacccggacgcggagatatgctgttgcctcaggcccaaacgcggaagaggcccccggctccaagctccacctaagttacagcccgacccagcaacagagtgcaggaaaaagtatacctgaggtcccttaccttgttaccgtcttaccgagttacaaaatcgtccctgaaccaaaaaaatcagataaaacgtatcctccaatttctaaaaccactgcaaacgagatcccttacctaagttacagcccgacccagcaacaagtgcaggcaaaagtatacctgaggtcccttaccttgttaccgagttacaaaatcgtccctgaatcaaaaaaaatcaaataaaacgtatcctccaatttctaaaaccactgcaaacgaggtctctcggtgttattgtcctcggttttgactgacgtggcgtttacgtggctcctttgactaggtcttcgttccacgtgacatatacatgacgcttacgtgacagtttgatccgaaaaagtaataaaataataaaaagttgggcccacggcttagatccccatcttcttccttttctctcttcttcctctctttcttgcaccatgtagggaggaagcgcagaggagagggcgtggctccgtcggctgtcggcgacctcgacggcggcgggaggtggccccggctgcggtggcgctaaggatcggagtggcagccggtggtaggtggctccaaggaacgtcgacggcctagcggcaacgggaagagtttgagggaagagagagagtggaggaagctctgtgccggtctccagcatcaccgctgccaacgaatcaatccctccaccgctttttggccgcacgactctccatctcgttggctcgctccatgggcgtcgccattgctgtgccgtcctccgccacctcggtaccttgctcgatgctatcaccacgctcgtgctccgccggtgccgctgctgcctagctcctctgcgccgcccttctccctgctagccactgcccgttgtcagggggcgcaggagcgacgcggggtaggaatggctgtcgaggccacagcgttggtcggcggagggagacgtggtagcggaggaggagcgataggagcggaggtccctggacctccccacagcattcgagctcggtgccgccgcccaccacctctccgccgatcgtcgcccttctcctagcggaggaagaggaagccatcgaggagagaggtggtggtggatgaactggtggcattacagcgaccgaagatgcagcgggagaggaagcccaggccagcgacaaggtcagcgaaggcgccgatgttcttaggcttgaggtcgtcaatgattgagaggctcttataggcatcaaggcccgagaggctgtcgatgtagctgtggaagggcttcttgggtccatagtagttgcggtgcttggtgtcgacgggagcgtgaagagcggccgaacggcattgtcaaataggctagcgcgaatctccgaagtgaactgcgggtagtgcgcatcgaaccaacagtgggttgtgagcgcatccatcacctgggcacgcacctccgctcaccgccttgtcctcggtgccgccgggtccacgccacgtcggagaagtcgatcctagttatgaagagaggattgagggacatgctgacatatggggcctacgtgtgtcccacgctgactcagccacgacgtcagacaagaccgggatcaatactacctaaggacccagagtaacccggttttgtatgtcgagggatttcatatatctagttttatgattgagggattattttgtaattggataacaagatgagggatctcatatatactttttccacattgccctcatatatactttttccacattgcgcatcctcgttttactagctaggccggcgcgcgggtgtttctagctggtgagaagatgggcttggatttacggcagacaaagatgggcttggattacgggaacgcgatattccgcggcccaacgaaacaacctagctggtgacaagcctcagctgagctccatcgtcgagccagcccacacgttgtggtatgtactgtaagatccatgttctagatcgaatcgcacgcgaaaaaaaaaacaaaacaaaacaaaaaaaaatctgatctttcgccacacacaccacgagatgccgcggtggtaactgggtatacgctcaaggatgcacagtaatttggcatttcgctcaccgatcgatcgagtcacctcaccccgtctctcttccttccacgcatggcaatgcaaacgccaatcgccggcgatgcgtctcgcctcgcgcggcggccgctccggcgcacgagcggacgcatcggcgcgtcgtaattctccacgtacgccgcgcgcgcgcgcggcgtcgcggttaattttgcacacgaggttaggttgcaccagcgaatcacgtacgtgttaggtcgacaacccatcggttcgagttaggtgtgttaggcgcgcgcgcgcgcacatgcttcggtcggatcgtcgatcgcctgcgtgcgtgcgtgctaccgtgcacaagcacacgtacgcccactggcaggagatgataattttttttataaacacggtgcaaacgcagatgtccacaatacgtgcatacttatcccctgtgaacacacacgcacacccttatgaagtaaatgtgagcatcctgtgaacacacatgcaaacccttctgaagtaaatgcgagcatccgtgtgtaaaatctaaaatttgaatctgggtggactgtctccaacacaaggaatctaatcggttgagctacgctcactttgcaatacgatgatgatttaatgttaaattcagtccctatttgccatagctccagattcataatggatttgaagtttgtatgctaaattgcatttaaaattttatatttcatctaaactaagaacaaaatgattcttgcaattattattaacgtaattgtaggtctatatctatatctatagatttgtggagccaggagtatctaactcaatgaaagcttggatatagagctatgccaaataaagccttattagtatttagtttagtcacctggagctcagatcagctaggcgagatgctcacaaacgatggttaattagattccaaacagaccaagtcctgcgatttcaattaatcatacacattagcttcaaaattgttcttcaaggcataaacgttgcgattaatcaaagcaccgagttgcttgcaggagctagctgcagcatatatactgtatgatgagagtgagagcgcccaaatgtccaatacgtcacagcacttttggaacccacggacagccatcaacggttgcaattggaatcattctctctgcatttcttttcccacgatcgaattaacattgacaaagactctccgacatgacacatccgctatctggacgaagaaaaaaaaacaaaaaaacagccgtgttaactaagacagcgctgttagctacaccatcagctcacctgatcagtcaccagctactttactcctagccatatagcccagattatatattggattattactcaacacctgacgtagctacagtgcaaggacgagtaccactgaattaatcaacctgatctcctcctcacatcgttaacactttgtttttctttcttgtcaaacccaaggataggcatgccattatttatgtatgctgcatgcgccaacaattacttatcctaaacaggtgatgagacccataagatacatgtgtttcgaaagcagacggcagagacgaatggggaggccaaatcctgatctcagtcaactgggacaccttttcgccaaactttcagaaaaaaaataaagaagtggcttgaaagggtcattacaatgtgctcaattaaaccagaaacagaaaagatgaaaccacccaaacgttgccaataatccaaccagtagtatacatctgtatgaccagcaggtgatcaacctgatcaattgatttttaaggatctgaccttcacacagtgacattaacaaaaggagtagtataaagttcagatgaagttctgttttcttctatgccccctgctgcaacttctaaccatccaatttaatttcccgtattgatgatcaggagaactacatatatcagctacatattgtcccgtatcgcaacggaattaacgcgcgtaatgatgattgatgagcaagtgagcaacgcaagcagtggctgcaagaaagaagcaaagcaaagcagccatagacttttttttttggccaaattcgtggcgagcaatgcaatcttctccttttctatctgcggctagcggttcagtttgtttctctgacgtagccatggaagcccaaacaatttcgcagtcgtttcagtctttcactaatgtcatacatgtaattcatatgtttgtctccacttcttaatttctttcagattacatctaggtttaggctactaggtctgctatattgctggcatcgttgcacacgttgcatgcaccgatatatgtgctgccaatttagttccgtgcctgatcaggaatgcttcatcattgataacatataataggctattatttcattcaaaagcttaaaacgataagaaaagacggataattcgctttcggagctatcagctcttccgaacctcagatgtgcagatcacagtggctgtaactttaggccacagtgtgtaaatcaatctagctttaacattacattacacacgccgtgtgtggtctattctgaatctcgatgacaacgaaaaaataaaagtatttttggggttgtgttgcactgcgcatcggggaaagcaaagtcatcgtccgattcagcgaggggatgggggggagttggagttaactggtgagcggaggaaatccagacgtcgcccatgccgctgcatgtgtgtgctgactgcggccgctgctggacaggcatggcgatgatgcggcttgcggcgtcgacatggatggccttggccgctactctactcgcggaagctgtttggtttttttgttgttttagcgtgagatcatacgagatagaggacacgtacgtacgcgcatacaacaaatctctctcgcgcgatcgagcggcggcaacggaatttgtccgatgcatgtgtcatatgggtcgttacggactaggagtattatatgggatgaggaggatgcagatgaacgtacatgggtttttgtgcatgtgtcgtgtgctaagctttgagcctttgacgtctttggttttttttttttgaaatcacgtctttggtttggagtaacgatcaatgaaaacaatgagccaaaacaaccagctgtatggttcgtaaggttttcaacgttaaatttcttcgtgtttagacaaactaataaagttaattggatccatatcattataaatgtgtcattttaaaaaaataattactacttatttattactaacgattccatctgccttctttcctcttttgctggccggccaccccacatctctagcccccctctctctctctcccaccatagagcatatgacggtggcgcctagcaacgatagtggtggcgggtgcttcatacacgtagctctggctgcacaactccgatggcaatcccgagaaaccggcggctaaatcacccgtcgtacgtgcgccactaaatctcaggcattaagtttggggctccatatccttctgtcggcagccacaaagaaaatgacgcaatgaggatggcggagcttgtggtgacagggagagcatcaacctagatctagcgagaacagtcttcttcattgtcgggaggagctcggggcaagtggcagcaagctcaagcggggtgacgctaaattccctccatccttcgcaggccaacgggtgaacgggagctagtggttcgctgttgcctccccatttgcctctctctcgtcggcaccctcctcacaacccgatgttttcggctcaacaaggtgtagagagatggagaaggaaaaagagtaaaggaaggaggaagaagatggaatgtaggtcccacgtccatgggtgttttagtctatatgatgacataaaacgtgatgcgactgacatggttttagttatatgcatgttcgtataatatggatacatataaatgaataataatgttattttttaaaaacataatatatttgtaatgatttggatccaactaatctaattagagctttgtttctgtccagcgaaatgtaccgggtggtaccagatgaaatctagccgttgattacacggaggttacgatgggaatcggattatgttagcgagagagaaaagcttgtcgccctcatctgccgtcactagggagccactccaccgccgccagcgactccaccatcaccgttgcagcctccgccgtcgggaacgactccgtcgccaccggaaaacgaaattgatgcccaccaccttggccgcatcaccgtcgctgcggggggaacgactcggccatcagggagccactctgccgtcgccatcgactttgccaccgccgccgaagtcgggaaccctccaggaaacgacatcgaatcctattctagggttttctgcatgcctcttccgaccatggcacgcgaaaatacaatcttacccctccacccttctccaccgtgcggtacaaaatcaagggctgagttagtaccggtcagtcccgactaatatcagccgttagatcggccaggatcgaacggccagcaaacggtaccgtaacggtaccacacctagttgctggacggtaaaaatcctcatctaattaataacatcagggggactttgtatagactgtagaaggtctctctactaccatttctgtttcaattcaaagctgacggctgacggacaggccagggcccaggatgccaggaggagtctaccgtcacgtgaaagcagaaatgcatgagtttagcgcggagcacacgcacatactacacgcatatgctacgaactgcagctgattaatcagtcaaaatccggtcgcgctgaatttcgccgtggcttgcatgcatcgcgtctgggatgacgtccttgcttggatgatgagctgatgacccttggcaccgcaaggaggaggagttggtggagcagggcatgtttggtacagctacaacttctaaatttaacttcaggagttgagtctagagtgaagttctggagctgtctaaatccagtttcataactctagtacattttgtgagagagctctatccaattccactctcagttttagtggagctaaaactgcttggctaagtttcagctccagaagaggtggagttagagcctgagatgtgccaaacagacccgtaggaggactcgcttgggacgggggtcacggcctcacgggtccgcgcgcgtacggtccttgtggcgactccgatccgcaacgtggaaggtgcgtgccgcatgcggcgctctgtacacgggggccaggtgcgtgcatgcggacaaccagtcaaccagatcgatcgagatcaaactgcatccaggtgcatccggctgtgcgcctcctcctgatctgacactctctaggagcaactatagccaactacttcatcagtcctataaaaaaatcaacctagtacaggaggtgacacatactacaaatctagacgtatctctgtccatattcgttgtactaaaatatgtcacatccagtcctaaaattgttttttcaggatggatggactactcactccaaattatctataaccaatttatagattaattacttacaaacatatactacataattaatatctgatttctcacctatcatacacacatgtatcttgaaggagtccgtgctacaactggctactaaaatttgtatcccattactcttctctatactcttttatctcctcgaaatgtgttatagctaatttatagtctgttattgtacctactctaaggctgtggtcggaagctcttcttactcgtttttcacgtgcacgttttctaaactactgaatgtgtgatttttacaaaactctttttatacgaaagaagttttagaaaataatattaatatatttttttaaaaaaattaatacctaattaatcatgcgctaatgaattgctctgttttacgtgtgtaagatattagttttcaactcaaactaccgagcacaacgtctctattcctctacttgcttttaccccgcaagttagatttgtaagctacggtaggaaagagcttattagctcgcacgtaaaaaaaacgattaatatataattaataaagtattaattattaaaacttaagacaaatagatttttattttcaagtaacttctgtataaaatgttttcgtactaaatataatgtttagcaatttaaacgtgttaagaccttttcatcacacgagagactgcacggacagaccagtatagctgtgccctttaatactgtctctcctatctagaggatggtaatgatttgtatttaaaattgctgtcgaattgtgagcaccaggatttatgacaccaccaatatacactttgtctaataatgttcggtttatttatcgccatgagcccatgatactctacagtctgttggcccagttcaaacttgctacgtagattgtttatagtatgaaaggtcaaaaggaaaatggaaatggtacacacacatcttttcccgattgttcaatacttccatctttcggggatgactgcattctagtttgaattaattaaacctacattagcatcccctttaattggtgcgaaaaacatagtatatatatttggaggatttaatcctataaaaaagtttctaaaaaggtcttgaatataaaggattgaatcatataatttcctttagtatttgtatgaaatgaacataatatagagattttggagaaaagttagcaagatcttgaaaaattctattttagtatctctcttgttatttttctgtttcacatagcctaagcaaacgataattcctgtattttcgtatgttttcgtatgttttgcacctacattcttattaaaataacgtatttttatatgcctctgtttttttaatcacgagttttgagggaaccataatagaatcgctagtaaaacatgtacggtttgtttcttttttgggtttaacatcttagtttgaaacatactgtttttttatatgcctccgtttttctaatcatgtgtttcgaaggaactataaaagaaccgttagtaaaccatgtacgattgttccatttttggggttgacatcctagttttaatttgaaacatactactccctttatccaaaaaaaatactttccataatgtatatatctcactttataagaataattattgttttaaggttatcttttttatacattgtggttgccctgaaccatgtctaaaatagttgcaccaaacaaagttattagagacgaatgtgttcttatcctagttttcatactcgattgtaatttttaccccacaccccaaacttttataaatttaggattttttcccctttttttatctaaagtttgtattcgttccaaagacttactcctacttttcatatatgtccttacatatttactcctacttttcaaagacttaatgatttcgcacatgttttgacatgaagcattcaggcataaatttcgaccctgttttaatatgaattgttgcttattcagataaaaaagggggcaggtataagcttgacatgaatttcaacaccataaaaaaacccccttaacgaagcgggataagcataagctttaatttttgttctttaaaaaataaatatatctttgttggcattctaaccacaacaaaacacaccttatatcacagagggtgtacaattaactaaacaaataatccatcgctcagttttctctacctatggcctttattatcgctagcagttaaccctcgagaacaagcaacatattatcctatgcatacaggtcctcatgtgtacatacgtgcatactaactaaaaaatatcaccaaaatatctagaaaaaatcatacacatactttcaattgtataacgtcaaattcattatattttagctgtaacaaaaaaaacaaaaaatctgaccagttttaaggttgcaattttgtcagaattttatctttttttgttattctctatgtagaatgaatttgaagatgcgactttgcacgtagatgtaatactattgaaagtacatgtatgaattttcctagaattttttatgataatttttagttggtgtacatggtgtgaacacgcgagagcctgtgtgtataggatacgctccccgagaacaagcttcaattattagcctcttggtgcactgtgtggcctgaaaagttaaatggtctaaccctttaaagtgggatcttttaatttgatcttcttagggtacccacaatggttatctataggctctctataagagatccatgtcagcatattttcctacttggaagagattaaatgaagagagagagcaaagctatctactaacctgtagatagtctatagagaaaaacgaggcaatgtattagagagctatagatacccatgtagacatactattgagatggtttactattaatctagtctattgctgagatgtacatgttttatagatagcaccttactttaccattgcgggtgctcttaggctgcgttctttccacaagtttcccaacccctttctctcgttttccgcgtgcacgctttttaaactgctaaatggtgtgtttttttcaaaaagtttctatacgaaagttgctttaaaaaaacaaattaatccatttttttaaaaaaattaactaatacttaattattcacacgctaatggaccgctccgttttccgtgcggtggagttgggttcccaaccccaagtatcaaacacagccttagtagcttggaacacgtctcttccctcccctctggaagtggcgatcgggttttagaggagcagaaaaaggcagaatcatcagaggctttcggcacatagaaatgtggcaacgtacgttaacagtagcggcccaatggcaagtgacaactggagttctttactaattaaaataaagactttatcataacttttattaacatattttttaaactgctaaaagatatattttgtgaaaaactttgtatataaaagttattttaaaatatcagataaatttacttttaaagtttatactaatcaaaactcaattaatcatacagcgattgttctcttgtttttttttaactctagtatcgttatatttttatcacataatatcatagatttttatattcttatatatttattattaagatatattaaaatggtaaaataattttaatttttttttactaacttgagcaatttaatcaatgtgattattttcaatcctatcattgattgtttgcctcggcggatcctagtaggtttcaccctttctcttagaggagatcagtgcatggcaatttgattgatcccctcttgcaaagtccaatcctggttgattattagtaaggttattcatactgtatgtattcttttaaaattttatttatttttatccaagttttcaaaaatttaaaattgtatttctagactctattttaaattatatttcttgttggactttccacattatttctcttttttttcctatttttcttgtccgtgttcactttttttttcggtttacaccacactcaatcatagtacccttcttttttttcttgttatttttccgtttacacaaaacccaatcctaatacccttctatctttcattcttcctcttctttcgcttaatgtgaaacttcctaggtcgtgagacggtgagagtaaacgcgagggattttttttagttattaagttactccctccgtttctaaatatttaacaccgttggttttttagcacatgttttataccatttatcttattaaaattttttgtgaaatgtgcaaaactatatgtatacatataagtatatttaacaatgaatcaaatgataggaaaagaatcaataaatacttaaattttttgaacaaaataaacggacaaacatatttaaaagataaacggtaataaatatttagaaatggagagagtaatagattagacctctcgcgacggcggcaggcaacctagatccatcagcccccggcggcttgtttaccccgaaccgatttctattttctccgctccgcggcggtaaatcaacgcgacgaaatgaaccacacacgcccctccatgcgtcgagatattgtcgacgctcactcgcctcctgcatgcgaccacgcgcgcccacgcacggcacatgcctcccccggtcatgcatgtggccccaatcggttaaaaaaatatgtttaattattgttttacattagagcgggtacaatatcaggctataagccagctataaacatattttaggggtgtttgggagagagggaattatgcttttgtgagagggactaaactttagtccctccttcccaaacaccacctttaaagagataaaagaagagagagaagagcagcgggctacagatctgtagccagctgcaacacggactgcaagacgtaatgtgtgtatgacaggtgggaccatatattaatagtatagtaagcaactattgtatgaattggctattatattggctatagatgatttggagttagtagtgggctatactattaaacttgctcttagggcacccgcaatagttatctataggctctctataagagatccatgtcagcatattttcttacttggaagagattaaatgaagagagagagcaaaggtatctactaacctggagatagtttatagagaaaaacgagacaatgtattagagagctatagatacccatatagatatactattaacatgatttactattaatctagtctattgctagatgtacatgtattatagatatcatcttactttattattgcgggtgctcttagatgttatatccgatcgaatttctgaagctttttactgtcaatgatgaaacttgaattaacctagacacttttaatttgaccaccacctgatttacccgatgtatacacgtactggtcctgcatgctgtcccgtgtgctagctagctgctcgatcggtcgtagtacgtgtacactcctcctcgactgtaaccaacaaattaaacacccctttaatttctatacggttgcattgtatacgtacgacgacacgcatgtcacgatccaggtccagtacttggtggtacacccttcataaattcagacccacacacacgaaaaataaaaactgaaacagagggagaggcgtgccgttctctctcgcccggccgctacagagagaaaactaaacaaaactccaatatgtaaatatatttcgatatttacgtataaatactaatacgtgctaatcatagtcgcaaccaagccaattagctgccgtctccgtcgacgctgaaagcgatcaggaaaaaagcgcaagttgaatgcgagaacggatgcatcagctaattaagctcggatatatatatatatagctgagagctgacgatgagtgtgtgacactcctaccataccacggctaaaccacaactaatgaacaccttgtactatattagtatctcggtctgcattattatgctgaccccattgttctgatcgaatcatgcagtgcagggcgcgcgtttgctccgcaaacataaacgaagacggaatcatcaacagacgacgatgaaacggacagtttatccgatcaaattcatcaagataatgcttcatattcgcagctgatttgcgactgctagaacaaattaaaccccagattttgtttgaagagcttctagcaactacaattttcttaataataaaaaagaaactagatctcttaactggtgtacctttttcatttagattttaagaaaacataactgtagaatctagaaaataaactgaaaacgttttctagctttttcggattttcaaaattggctgcttatcagaatttagggctcactgaacatgcccctgttctgcttctgctccaatgctgatcgctcgttctctcgctcgatgaggggggcaagcagaatgcaagttgagcaaactgcgtgtctctctgtgccaagaactcgaaaacgccatccgggtcaaggctgaccacggaaaccgggtctctcacgtacagccacgggtggcgcagctgcgcatgcaaaatttcgatagatttcagctttagctatagctattagctgacgaatgtgacggcaatggccagcagaaaggggcaaaaggacgcctatcaagttctcgattatgcatatccagcatctatccatatcttgcactggcaagtaacagcgcctgcgtactatagtacagagacggtgtacagtgtagtagagtcgtcggtagctagagccttatcgacatctcaggacccaagagaaaaagggagttatagtagctaggaggagtagaggaagaacaagaaaaagaaaagaaaaaaggaaaagaaaactatggctgttcttttctccttaatttttttttgagaaacacagtaaaaacgcagacgctcacaacgtgtgtacactcacccctatgaacgcacacatgcacaccctacccctatgatcacctgcggaagactgggccggcatgtcttgagattgacgaagtcaccataggcgcctcgctgtcgaggggtacgtcgcttactactgaaagaataattagccgtaaatacgagcatccgtgtcaaatctaggatttgaacccgggtgggctggttccaccacaaggaacctaaccagttgagctattctcacttcgcttttctccttaatggatgaatggatgaatacgttttttttaagataataaaatataacatcgcagcctttgcttaacgagttacagccaattatatatatgaatatgtatgcttcctaaactccattttgtaataactcttttatatatgactttcttacaatctattataaatccattttaaactttataataagttaattcatttacatgtacacttgaatactatctccctgcataatataaggtattgttttagtttttagagaggttaaggataaagagaaagaaaaactaagatgccctatttaatcagaattggttaagtgaagataatagaaagaaatccgaattgaagttgattaatgtgacaaccagcgcactaaaattacttatattgcgagacaagttacaacagataaaatcaattatattatattatagaacggatgtactagtgattagcatcaatcattcatcaattctgtcatttagccatttaacaaaaaaacaataattagtagtaatacgttgtagtgggagatgagatggatgatccattggggtggtgcagtccaccgtgtcatcatacaacgatccatcgtgcaggacaggaggggtcgccatttcgtgcgatgctcatgtcatcgagatcagacgaacgtggaccgtgggcccacccggcccatctggtgggccctcgagatatggtccctacgtcccagagctgatgtaaatcaacctagcagctgtattggctagtggaatgtgggtccctatattctttctccttttttttttctgattttcttatgtggggggtaagatgtgtctattacaaattaatctgtggctgtaatttttttttcgtaaatcataagtgttactacttaattgacttgcaaattgctccaatcattcagaatccaatcacaaggcatgccacggacactaatcatgccaagtcagccacactagttgcttatgcaagggtttattggttgtcaaactagttgcgttcggttggaatgttagagcatctccaacagcttcttcaaatctaactctccaaacatctgtatagccaactctctatttgatttggctagtcaaactaagctgttcactccaacagcctctctatctaccctctctactttgattctacgacaccgggacccatatgtcagcctctcccttcttctttttccccttccttcccctctttctcttttttctcgtgttggctggaagcaggcggcgccgacaagctgggagcgagcggaggcggcgggcgcggtgcgtgacggacggcggcagcggccgcgacgagtgggggacgacggccgcggcgagctgatgcggcgggcgcagcgcgtggcgcgcggggccagcggccgcggcgagcgggggacggcggccgcggcgagcggaggcagcgggccgcgccgtgcgggggcgggcggccacggcgagcggaggccggtggccgcaccgtgtgcgagggacggcggccgcgccgcgcgggggctggcagcggcgacagcgagcggagcggcggtcgtggcgagcgcctcctcctcgtgcttcttccgtgcggttgtcgtgtggggaattggggatggagaagatgggttgtgtggggcccaccattggccagccaaatagagtggccaaatttggctagtggaggaagggttttggccagggttggagaggctgttggagatgctcttaggctgagattatcagcggcatgtgaatcgaaacaagttcaaagcttgattagttaagtattaaaaattttaaaatttaaaaatagatttatttgatttctaaagtgcataagtatatgaaaaagttttttataaaatatgtttctatttagctgtttggaaacatgtttgtggaaaacgaagagttagctcagccaattagccaaacggaacatgacctgtaacatctttggttgcctaaggtcttgtttctgtttcttttagcttgagattattataatccagattattgggagtaagctaaaagaaacagacaacttattgaagtagcttattataatctgataagctcatttaggtgagttttttttccagattattgggtgaaaaattacccaccatgccaccccactctctctttagacttgcaaacccaataatttaggctctaataatctaggaaagaaacaactaaccgcttattctactacagattataacaatctagcttatagtaatctgactcaataatctagattataataatctcaagctgaaagaaacagagcctaaattttacttcctccgtcagtccatcataaagcaattataaggggttttgggtttaatttatttttttcataaatataagaggttgtacctctcatttgatttttatctagttttgtctcaaaccatcctcccactcccaaattatctcccatttaagaagcgtcattttaatattttttcatccttaatctctctaatgaatctagaatcctttatattaattcatggacagagaacatagttgatcttctctagtttaccctcatatatatatatatatatatatatatatatatatatatatatgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgttactttcttcgtttcaccatgtgagtcactctaacatttttcatatatatattgatgtcaatgaatctacacatatatatctatctaaattcatcaacatctatatatatatacaacacgaaggcagagtttgtaaatggaaggcaatatgtgcgtgaagcccaaaagatagatagtgggggtgctatgtagtagggaaacaaattggtagggggggtgctatgtattaggtataacctaactctaggttctagttcatttcgaatttgctatatatttgtcgacaaattttcctccaaaaatttgtcagatgtaattacagtacaatcatagtgtaattacactgtaactgcatgggaggacactgtgactacaatgaaactggacgtcgctgccgctggacttcgagatacagcttatcgaagccaaatagcgggcgtgggaacaaatccttttacatatgtgtgtgctgagatttttttcttcttcaccaaaacaaattttgtaatagatctaacgattcaaaattacgtaaaacttaaatacaagttacaccttagttacatgcaagttacagtgtaattacatacaagttacagtgtaattacactatgattgtattataattatatatgtcaaatttttagtagaaaatttgtcgacaaatgtataggtagtcccgttcatttttagatacactccaattaatccattccattccaccgtttctcggatcaacgagaatttagcttgactccccaattcttaaaatcgaagagaatacaagagtcgagagcctaccaaacttctcgtggtatcaatatgacaaatggcgggggaggaggaagatataccatcaacttcagttaatagtgttgaaaaattatgagaccagatcgaggaagataagtccgtgagcacaatcttatcaagtgaatatatgtggaagatgaataccagatgcatgtcaaaccccctatctctgtccgcgtttctcctagaactcgtcttcgatgaaactaccacacattttcgtatacatggtaacaaaaatatccatgacctaaggctctgcttgacaaagctatcaaatttcatgcgtcttttcacgtcacatggaacatttccatgtgtgttttcccctaaagaaaaacagtaataatattaatattagtatcacacggaaaactcaattcaactcttaaggggatatccccttattttcatgtcacttaaaaagttacaaattttttttaaaaaaattagtagaatagactaatataagatatgtcacttcacaaacataaacatgtaaattcaaattcaacttatacaagtagaaacaaaaataacaaatttgactaaacgcgtaattcacggtcaaatttgctatttttgtttcgaacagtataagtctaattttaactcgcatgtttgcgaaaagatatatcatatattgatctatcttaatagttttttttataactttttaaacgagatgtacaaaacaagggagaaaaaaaatccacttccgtatcacactgttactgtcacagtgctccgcggtagactattcccccacacgcagccgccacagtctcccccgtccttaacaaccaccgccgctacagttgcaaaagaggagaagggcgggcgggggctgggccccacgtgtcagcgacacacgcagccgcaccgccaccgagtataagtacgagccccaccccgacgcggcctctccctccctccccccaacgccaccgaagaaaggctctcaccaatccaacggtgctcgatccatccatccatccaatccgcctcgctccatccatggcgtctgcggatgcggtctcgccggcgccggcgacgtccgccgcggcgcagcagcaggtgagcgtgcgacgccggccgatgtggatggttggagttggggttttgtaggtgttcgtccggtgctgacatggtggttgggtgattttgcagctgcggaccgtggtgctgagggtgtccatccactgcctcggatgcaagaagaaggtcaggaaggtgctcaggagcatcgaaggtacgtggcgcgcgtgcgtgcgtgcggcggcgcttcgccggcgacggcggcgggcattcggattcggggatgctgagatgatctttgttttttttttttttatgtttggtttcaggcgtgaaggatgtgaaggtggacgccgcgatgcacaaggtgacggtgaccggcacggtggacggcgacacgctcgtcaagaggctgtacaagtccgggaagcaggccgtgccgtggcagcacccgcacgtggcgccggcgccggaggcggtcaaggcgatagaggccgcgccgcagcagcctgaggctgcgccggccggggacgacgacggcggcaagggtagtgatgctgcggctgcggcggcgaaggaggccgcggcgcaggcagagagctcggaggagaagaagacggaggagaagcccgaggcggagaaggaagcagagaagaaagaggaggagcaggaggcgaagccaagcgacgaggcgaagaaggacgccggcggcgagagcgaggcggcgccggaggcgaaggcgaagggcgacgacgttggcgccgaacccgccaaagaagccgttcccgcggcggcggtgaaggaggctagcaatgacgacgaaggagcaaaggacgagaagagcaagcccaaggacgccggcgacgccgcgccacccgccgccgccacaacgacggagaggtccctgcacttctcgccgacgccggcggcgcacaagcagcacgaggagcactacccctacccgtactacggcgcgccgcagccggtgatgagctaccacatggcgcagccgacgacgagcgtctcctactacgcgccgcggccggagccggcgtactccatgcagcagcacccaccgccgccggcgtactccgcgccgccgccgcagcagcagcaatacccgccgccgtcgccgtcgccgcagccgcaggcaatgcagcagcagtggtcgccgtcgtacctgtacatgccgtacccgcactcgtcgccggacacctactaccgcgactactacagcccgccggggacggcgcacgcgccgccgctgcaggacgagtaccgcatgttcgacgacgagaaccccaacgcctgcagcgtcatgtgaacgccacgcgccgccgccgccgccgccggctagcaggccaggccggccgggagaagtagtagttgaggagaggtagagtagcttgtttacactctcctccattggagaggtcaaagctctccttcaccgagcattttcttttttttttctttttccttttttttttcttcacttcctctcttactgttctaattaactagagcatgtaattgtaatgagacacgccaaattatatatgtttttctcttatcattttgtataaggcaaagacatatacatatatataacagattacataactactataagtactaattatttttctatggatagagaaggttctatcttttgtagagaatattcttgctacatctcttcgttttgtgagaagctatgaggattgaggatggctctctcatcatgctgcatctttctctaggacggcggactagggtgttagtttttataagcataacaacttacgtagattctataaggaacaattgaaattttaatgttttaaaacgatggatacgaatatactatatttttttctagtttaaagtttagtaactggctatattccactaagtgttaaggcattaatggttactataattttacaatagaaattgtgatgccttatgtgtctaaaatcggaatgcgtaaacacggacatagaaaaagactacgagctaattttcgcgcactaatagtgtttatttcccatttcttgtattggcttgtgctcccgtgctttaatttggttatcttattgttttattttgctccctttaaagagatgcgaaaagaaaaatcttatgttcacaaatgcatttttaaatataaaactagaatttaaaaggaccaatataagatctaagttttaagaaacactacatgcattccagaaatgctgaaaactgttactttcaagtctttaggccctaaggctttttacaggggaccatacccatagatttactttatccatacataatcttatgtattagtttaatcgttatgggttagtcatcttttttctcttctctgatgatgtttgcccgataatgatcattaataatcttaatgtgatagctcagcttatgaacttttagctggagtttagggtcaggccaagctggccggtttgtttgaaggcttttgaatataaagagttggccttgtccacatgtcaatgatttatgccggcatgctctgctcagctcagcttaggtgatggcaagattaaatacatgtaatttgttcactaatctaatcttgatttatatattgtggctgatggggacataatgggggagtggtggacatatcagtaggggcaacttagctaatggatcttcaactgtaggagatttatttatagtaattagttcttaaaccaatgctttggctagttgttaattagccattggtgattaggacaattggatggaagtagggcatcctccactctaaggaatgtgcttaggtagatcagatcagagaaggcaattttgttttttggttcatatgtgtcagtgactcaaaagcattgccggcttgtgtgcatgcttggcatgtactaactactattctctcacattgacaactctgtgagtagagtgctactactattcaactcaacacaaggaaaccggtggttgtttgttctaaccggtaggtgtttgaataccttttcctcaagagcatcattttgagcacatatttgtagggatccaggatttcaggctcattggtgagcattctgatgtgtaatagtgctactgattaagaacaggtcacgtcactaactgtgcctgacaagtgaaatcttttctcttccctttcagtgcacaacaaatcctgcacatggcatgccagtcttagaacacacaagggggttcccccagattctcttgttaattgtgcatgaattgtctttggggatagaaacagaaaagaaatgccaaatggttatttcggacaaaactaggaaggtagcctgcacattcacgtgggtatgcgtcgtacgctaagtttgagataagtataaaagtgaaatattaaacggagaacatctgccgtgatttgtccataaattgttttcatcagcattaattgcttaataagtttctaacatgttagtaacatcatatttaagcaatatctataagcaattatttataatcttcttttatcatttgaaaataaagtagactttttgtttagaaaacatgttaatgaaagtaaagtaaagtgttttttaattgcatatctattataatagttcattaaataataaattggatgggacatgaatctccactaaatgtatgggtttatataggctaatacgattgatgtagtttgagaggtgatccatctataaacatttcatgtagggtgggtgagaggctccatgcaacctaatatgaatacgataatgacgaaatataattgcacaataatattttggaaatgtcatgtaccagtaccatgaatacatgcttaacttttatataagatagatctaacggttgtaagtaatagttcaccgatttaaaaggcatataagtattccagtaatgtaacttaaaaattatgattgttttaatatccaatgctattgcgaagtgagcgcggctcaattggttagatttcttgtggtggaacttgcccacctggttcaagtcctagacttgacacgggtgctcgcagttacggctaattattctttcaatggtaggtgacatacccgtcgacagcgagacgcccgcggtgacatcgtcaatctcaaaatgtgtcggctcagtcttttggaggtactcaaaagggtagggtgtgcgcgtgctgcgtttctaaaaaaaatccaatattattgattgtttctattttactttagtagctaagaaatagcaaggagacaacaaaacgtatttgatttttttcttaaaaatgtatagattagtgaataatagcttatccttagaatatatatgatccaaagtaatggattttttaataacgtagttaacttgatttttaatattaaattttatagtaaataatctaatttatctcctacttaggctacattctatctcatttgttagcttatgtagggcatgaaaaacgatgtaggtcatttacgtcatattaattaa

SEQ ID NO: 44168 - DNA, 33078 bp, Oryza sativa
tgtttcattatttgtgtttctgacaatatgtcccgagtaatattttaattactcattatttcatcttgaactatcaatgtaggcccattgatgcaaataaaatctatctaaactcaacaattgtagtatgaaatgatacgttttttatatttatattatattatagatctatttttgggtgtgtatgtgttatatgaagtaatatatttttcttatactaccaccttcactaaatatttgtcgttgatcatcataaagaaaacaaaaatatccagaggaagtataatagaaaaatctagtttaaaattgttgttttcttttggtagtttcaccaaatatttaacgttggccttcatggaaaaaatacacaggaagtgaaaatccagtttaaaaggcaatgttttttttaactcgtaccatcgtacgtatatgccttcttggcctattccggccattatttttaggaaagtattatatgataaattaggagaaatatattactatttataatgaatctaatctgacggtgtaaattaatgggtccaccaacttaaatgaaaatcgaggctagattttttttctttttctcaaaatttctaatattttctctattttattaaagcgccatgtggcagcttgagagcgtttttagagcgccatgtggcggcatgagagcgtttatagaaagtttaatagacttttagtatataatagatagatagatagatagatagatgtcaagaacaacagggactcctctgctagcatgatgggagccatctaattgtgccaatgcttggaaccggtggttccttacatgcatagatacaaacatagtgcaaatctaatgattcatagtgcaaatctaattattcacctgccagctagttcatccgggcactcgagagttcctcgaataatggtgctacatatcatgttagggctccttttaaacgtagcgaaaatagaatacagaaacaacaaaaacataagattttaatataaatatattataaagacacaataaaaataaatagatagccatttgagtagactgcaaggaaaagaacaagaaattgagtagagatagatgtagactcgttaaaaccccatgagttcttacggtaacttttctctaaaatccccatatttcgagtcgttcgaaagaaattttatagaattctaaaaacctgaaccttgttctttgttccaaaggatcgaataggattcaaatcatgcaaaaactcatctacaaaattctttgttccaaaaggaggcctaagtgtatagctagcttatcacaactttagtttggtaatggcattgtacattttttgccaatttttcctcgaaaacaagacgtttgattcaattggatgatttagcacacatcgcgctcgcatcaccgcttcactaccaacagcgacagcattttcggtgtcactcgctcacttatcactagtgcttgatgaattgaaacctaattttggacgcagagtaagtggggcgccagagatacagatagagagagagagaggaagaaaaaaaaaaggataagatatggttggtgcaatagctctctgcacgatggatgttggatgcaattatttatcacgcatgttcctggtttttctttatctgatttacttgtttcacaaatttgtttctttctatataatttttgttccatcttttaattcttctctccccctttttttttggcacattttctttcacaggatcgagtagccatggaccaccgacatggaagcatcggctaagattttctctctagcagcatcagcaaatggcacacactctcacacagtcacacacttggtcgctttcattggtggacacaggattatatgtcaccaattcagattccttgtgaagaacagagctgcccatgaagctccaaaccatgcaagcccaaaagaaaaagaaaaatctttgtgtttatatggctttagtttggaagatcctaattaattgtcatcagccatggacagatgccggttcaggcgacctggtcttaattttcagttctgattttattttggaggagcatttggtgaactaatcactatcatatgacaattaagctaaaggaatggcagggatactcttgaggttctccacaagaaatggctttccttttttttccttgtcttaattaggttggtttcatgcatgatttggagatgcttagctggtggtgaccatcacatgctgcatctgcaaagtgaacttttgagtcattactcctttgctctcctctcatatgctgctgcatctttggtttaggttagcgtgatggagaggaatatgaagaatatgcaatgccggcctgcctgtctacctttagctagcttacaatcatcaaggttttagcagtttggcatggtctaactgctttggttccctgtataactaccttagatggctcatgccttttctgcatatccgtggctgtccagtcagaaaaaatttttagatttttgttttcaaatataagttaggtagcgtcgacctataagttaaacttatagttgtagtgaggcaaaaagctagatacctcattaattttgttgatcacctttttttttctgaaaaagctttgtgagaatctagctaggtatattgagtcatatagtagtaacacctagatcgaaaggtggtagcaagagtaacaatctttaaaaaaaaaatcctggctttcattgttttaaggtagcgtcaatttagaaacttataatttgtagcgaggcacactaaaaattaacaaagacctcattttgtcaaccacaattttggtttatgaaaaagttatttttgtgaatctagatacgtacaacgaatcatatagtaacacctagataaaacagtagtaacaacagtaatcgtcttagaaaaatgttacctttcgttgtttcatactccctccgttttaaaatgtaaattttttagctgttaaactagacatgcttatattttaggacgtaggtagtaggtagcatcaatatagaaacttgtagcgagaactaataagcacctcatttttatcaaccacgaatctagtttctggagaagttcttcatgaatgtcacaaatttagttttatttttgataaacagagtagatcaaaaggtagcagcaagagtaacagtcttaaaaaaaaaaatccgcatttcgatcttttatagatagagctgtcttacaccctgttgaactgaaaaaacactcaaaatatgactagaagaaaacgagtacatcggatgaaaagctacatctgaccaaacttgaaaataacttggattttggatcatgttggtctggtactagctgtcatggaagagaagaacaggatcaacaaggacggtattagtgcgtagggacgacatttgccagactgatttgccaaatacttcacctcttggcccctaccagtgtacatatgtacctgtctgcaagagctttagtagtactccctccatattattttaatatatgacgccgttgactttttttaatgtttgaccattcgtcttattcaaaaaatttatataactttattttattgtgacttgattcatcatcaaatattctttaagcatgacataaatattttcatattcgcacaaaaattttaaataaaacgaatggtcaagcgttggtcgaaaagtcaacgacgtcattaattaaaatatggagggagtactacttactaaagcgattttgcaaattctgcaaaatcgtgtcatccctttcttgtagaactcaatttgttctgtgtcttttgcatgtggagaataattttgtggcaatcggccaagggtgtagttttacgtagctttgctttctgaaatcgttcttgatgttgagaacacgtaccagtaggtaatatagtgcacttaaatttgccgacttgggaagtttatttcgttgagggaagaaacttgtgctgaagaggaagccaggagcttcttttaaaattttgcagaaaatggttgatgtgctgaattttctctggtcacctgatggtttgaagtttttgctagataggagtatttactgcaccgagtggccttcgaagaaatttagactggtgggtgactaaatttgagaatattagaggtgctgacgtggtgatcgatgtaccaaagttcaaagtcccactagctcctaaacaatgaaattttcggaaaataaaaactgttttaaattctcaactttctagtagtttatttatttgtttacatcctcaactagtgattaaaaaaatcattcagctatttaaaatagaaaacatttatgatatactatagctgcagtatatattgtaaaggttggtttgtccttccccctcatccttcaccgtggcgaggggctgccaaccactatgagtctacacatgcaacaccgcctctagccaccgcaagcatgccgtagtgccacctgtcaccacgagcacacgacacaccatgagtatgccgcgtcatcaaaaaccatggccagctgccatgacattgccgaagggagtggccgactcactcgggacgatgacaggacgattcgatgagtggctagggactaaagtacgaaattgctaaaaatgtcattttcaattttgtgacaaaattttaaagcatccttgttcgtactggaaatatatactgccagtaaattgtaccgtaaaagtcacaaccatcgtttaacgaggatgtctgaaactgtgaaaattcttggaggggagctgcaattaaagccagtaatagtattgacatttctattgcaagttgtgttctgaatcttctgatcgatgagcctctgtctacatctccacatctgggggctttcattgaactattcctactggaagatactgtcccctgttcgaaaccgattcttttgtttcaactgacgaaaatttttccaaggaaattaaagttccatgcatgccattggtttcagaaagaagtggccaatcaatctgaccaaccaaccaaagttgagagccagtagcaggtagcagcagatcatttgctgaattaaaaaaagaaagaaagttagtttgtgctgaaacagcacaggctgtaacctgttacctgtacctgtacccccctttggtaggagaagagaccgatcaggagatcctttcagagctgaatcggatcggatgggtgcttgtgccacattccgtaacaagaagtggtaggtgatgactttacactcgaaagatccacgaggctgacatggagctgcgtcggcagcgatggcaatcagcagcagcggaaggacgaactggttgacagtctgacaagcagccacgcaagcacattttcttgttttttcctttaattttcaccgccttttagctcatcttttgaatcatgtaaaccttaaaaacagtccgtaaaaggagcctttttggaaaggtgagatcttgcctggccattcttcagaagttcagtttttttttcaaaacgtttttttttctgagagctccatcgatcttgcattcttgccttttcccaggagtcttaaaccataagcaaagatcagggacgaaaagaggaagaacacgctgtgatcagtccaacctaatgatcatttcatccactgcaaaaaatgaaatatctaacgctgtgtttagttcacccccaactatccttaacttccaactttccatcacatcacatcacatccaaaactttcctacagatataaacttttaacttttttttctaaacttctaacttttttcaggaactaaacgcatcctgaatatcatatatccaccttaaccctatctagactctctgctgcactgcaagatacagcttttgatcagctgatcgtttactgattttttttgtcagctgatcgtgtgtttgtaagaaatagaggggacacttagttgcgtacacggctcgttgcaaactcgcacgcccattctgctgatgctgggatgcgtcagagtcagcggagatcaaagaagcagaagcctccaggatggccaaaaaccggcgacgattccagcagtaattaaaccgtacgtcgcagcagccggctgctgctgctgcggcggcggcgacatcgtcgttggcgtcaaagtctactactatgtcccagcgatgatatgcatggcagcaacagctaaattatcttaatggcttagtgtcagcaagtcggcacatgagataacgtagttaacacaggagttcgccaatggcgatgaggtttctttggggcaggattagtaggcgggccattaggttaaaaactccatgtgctttctctgcaagcctaattaagaccggacagcaacatctcgtactatgtactatactatactagtagtaagtactagtatagagtactctgcacatctcgctggatgaacaggtgatagattcaacttgggaatcagctgcatttagcttagcttagcagctttagcctagtggattaggacttgggaagagggggggaattagtagtgggggttaggatttgatcctggaaaatcaagtggagaaagtgatgcttgcacttgttgacactgagattatggcatgattttttttattttttattttttttaaaaaaagatgaaagaaaagacatgctttttgcagttgcatgtgtgtatcactactgtatcgtcagacagcagcaggttatgggcagtgcacaagtatgtggactgtagcactagtgttttggccctgatcttgtacaaaggacgtgcattgcttttggccctttgcttgcctacttaactttgtagtacattgatgatgctttgttgtcatcgtgtcatgtctgtactgaaatgagcttttgcttgtgaagtgaattatcatgtgttcaaatgtggagcagtaacttactaaaagcagatgtcctgaatctttatatgtgtttttcttactgttaaatcaaacgggttactgttaaaatcgtgtctctctgctattcatccattttcttaatcctggtttcaaataattcatgcagtgccgttgactgttggatcgacggcaacacaagagagacagttagtgcacttccactagacgcacaaaagttgccagctgaattagtgcgcatacatactgctcaaatggatgactagtacagcagaggtagtattaacgaaaaataagatcatcttgaattcttgactgaatattatacgtagtgcttgtcaagactgaaaaattgtgaaaatggtttcggagattcgtcagagccctgaaaaattgtcaaatggttttggattggagccgtcgttctcgccgcatttcctccccccatctccaataattcaacgttgccttcgcttgcaggaccatggcggcggcgcaggcgcaatccatcgatcgatcggcgtcgctgaaacttgaaacctgcaattttctcgcgtttttttcttcagacgaacgggggaggcacacgtcgatcgatcgaaatgtctgcctttgtttgatggacttggctgcttgttgttgtacgttgaaaaataaatgcatttcgctgtgaagtattaagtatcggtctcattttttatggctggcatgcttgtatcatacttttcaatgatttttttgctgtcgcttttgtgccgattaatactagctactgctactatactctctgtccggttacaaaggtatatgtcattctgacgtcaaaataatggtctccaaaatgcaagttcggtcacctagtagctattttctgctgaagtatgtttcttttattaaaaataaaaaataaaacatagtaaacatatggttctggctggatcagacgaccagtgctcattgagaaaggcccaataggtcaggatagtaacaagcgatccaaccaacttaaggctaaacgaaacaaaaggaaaataagtctatatttcctctcataactcttgctcttggttgaatcgcatccctcaactataaaacccagtataatgtctcctctatctatcaaaaccggtgcaaatcgcctcctttagtggtttggaggcggtttcgtccggcgtggcagctgactggctgaatcattcggtcggacccacttgtcaatggcttccatctcatcccatcttctccctcacctatcccttctctctttcatctcattctcctctctcacggtctcacctcccataagcaacagcgcccaggtggcggcaggcgcaagggaggatctcgttggaaggtcgcgcgtgggggaggagctcgctggccggctacccgcgtgctggggagggaactcgtcgaccagccgtgcgcgggggaggatctcgccgggaggccacgtgctaggagtcatcggtcggccgcacgcaaggggaggatcccaccgggaggccgcgcactagaaggaatcatcggccggccgcgtgcaaggggaggatcccgccgggaggccgcgcgctaggaggagtcatcggtcggccacatgcgggggaggagctcgccaagaggccacgcacagggggaggatctcatcgggaggccacgtgctagaagaaggagttggtcggcctcacgtggtagaggaactcactggccagccacgtgctggggagggagctcgccggccggccacgcacagagggaggagctcccggtgggccatgaccagtgaaatgagtcactagccagatgcacgcggggggaggagctcgtcgtccagccatgtgtgccggaggagtccacggcgccatcgtgggaaaggttcctcacgtactaggcattgcagttcctctcgttctccgccagcgactgtggtcttcctgccgaagccattccctcacctctcctttgcaccccttacatcgcccctcccacctccgcctttgcctctatccctagaggcggcaccgaaaccttctccaactagacctcctgctcctgaccacgttgccaccaaccggttgacacgtgggacccacaagctgactcagccaatcaataaggtcaaatatgccacgtaggacgaaaccgactcccaaaccactaaagcaagcgatttgcaccggttttgattcaaacatgagcaaaagttaagggaggtatagtagacttccaaacaaagaaaacatggccgaaaaaaggctgaaatccacgcaagatcggcccagatgaacgggcctttttgtttccgtgtggcatttgttcgaatttttttcgtttttagatttttttttaatatttacagaaataatctatcgaccaaaaaaattgcagaaatagcccctgccgccctaatggtgggcggcaagctgacatggcagacggtgggtcgaccacgccgtctgccgccgtcggccaaaattgcgattaggcccttgccgcccaaagagcttgcggccgtactttttcatctgggtccctacccagatgaaaaaagtacggccaaaagatttttctatgttatgttaataataaataaagaagtatttattggtaaaacttgttaatattgttataaaaatgtattaaagttggttgttgcgcaatttcatatgttaagtgaggtattattttgtaccttattcgacgtattagtactcggataatttatataggcctatcgcagtctgggtcgtagaaacattatatagacttaaacaaggagaattatgtaacatgaagaaatagtagtacaatttgaacatgatacgactatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctacacaacacggctaggtggagttagaacccttctggtgtctatccattctctgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctatgccagtttggatcctcaacaccccggcgtctagccattgacgaaagccggtcagatttgtaatgaagcaagtggggaagagagtactgaatgtgattgagttctgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttacattggtcgtatgcgctaaatggcgggcaaatactcgtatcacacgcgaataaaggaggctgcatcggtgcggcagaaagtagtcgtgcatgcgccgaaaggtatcgtgcacatataacaacaacgtagtcattacacaagcatacagtactggaaagtgaagcaagtaaacaaagagaagactgctctactggccctgccccgcgctgcgaccacgcttggtcctccgggcctgtgctcgcacgtggtcctgggagtaggtgaaacgatccggtggcacagcacgggtagcacgagtgtcccgcggaggagtggcctgcgcctggtcctgcgtctgcaccggcggtgcgcctcccagctgtgaggggccaatgacgtcctctgtcgagcctgaagcgaagtcaaaatcagtgatgtcgaagagcaaggtggaaggcagcaagcggtccgacgaggtcccagcatggtccagtggtggaccctgactcgacgtgccggctgcctgtgacgaagtcccggtgtactgccagaactgcgctgagtgcgaggttgacacagctgcctgagacgctgaccctgcagcctgggagaagtgggcggccttcgtcatagcaaactgggcgaaacctacacatcgacaacgggacccttgtaagctaagacataaaatgtatgtaaattgattgttgaagtaatgttgtttttttaagtacctgtggggggcacaacagaaggcctagccgaggaaggcggggtgctgaacggtgcacgaaaccctgaagcaatcggcaagtgaaacggctcacttatatgtgcgaggcatgtacaaaaatagtaataaaaatacttacctctgtgcggagggggagtcggcctaggaacgtgcgcagctggacggggaccagtcggtacgggtggccgctgtacagctgcgtctgcccgagcaatgtcgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaacgacgacccggttgatgtcgtcgacctgcatgattaatttgttcgtaaatattcgtaaaatttgacgaagagaaagacatgaaaacataaaggaatggtgcgatgcagggtactcacagcacgagcgaagtcctggtcgcggtgcctggcatagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccacgacctcctcagttgcgagcaaccagtcctcaacaaaagttgccaacttggcgggccagtcaccagctgactgctgacccttgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacgatggtcggaaacagtactggaaagggctgacggaagccgaactgccgcatcacgcggaaaggggcgtgaggctcaacgcagatgtcgaagaccatcggaaccgtagtcatccagtacgcttggtccctggtgcagagtgtggacagacccaacggcgcacgagcctgggtagccgcggcactgtagggctcccacacgacgtcagtcggcagaaggcggtcgaactccataacaaactcaggatacgaccgcctaacttggacgtgagcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaatgcggaaccccagctccactgagtcacctcgcctaccgcggcgtcggcgatgctcctggcgtagtgcacgagtcccttgtcgaccgcgtgcccgtgaccgccacagaacatcacccagccaaaaagccagagcaagtacgcctccaaacatcggctgtaggagtactcgtcggcctccgcctgtagctgctcaacctgcaagccgtcgataaaatgttaggcaccttaactgcggattaaatatgtaatacgattgtcatttcggtacaaaaacactcacggtgaactgaagcagccacctcttcgtaggtccggtgttgcggtggtgtgccaacggctcgagcaggaggtgcggtgcgcgctatactagtgcgaaacgtgccgtcagatcgtcctgccagtccacagccgtggtcactggcccaacagcgtctcccgcgagcggtagccccaacaagtacgatacgtcctgtagggtaggggctacctcaccgcacggcaagtgaaaagtgtgcgtctctggcctccatcgatcgaccaaagctgctaggagggacctgtccacagtccattgtctggccgggtccgcgtcgccggccgcagcctccaccagccgacacatcggtaggaggccggcctcacgtagcctgcaataacaaattaatatgtcattataaaaattattacagtgcaactaacttatagtaaaacactgttcgtacctctcgacaaaggagtcgtgaaccgtgagtagctcaccacacgtccgtgcccggaacgtcccaagctgagccccctgcaccgcagtaaggtgagaccggtgtcggtgatctatcgccgggtccaacaactgaggtgtatcctgacatgccatctctgaaaaatatagtgtttcgtgttagaacaattcaaaaaatagtaatgtaaaacaaaagataacttgcaaaattatgaaatagtaataaaatcatgagattaattatgtacaacaagagtacatgctatttaaatatagcaaacgttactaatggtacataacgatgacgtgcaatttaacatatatgtagagttcaataatataacataacattacgtgtcgaagtccgacaaacatcagcatacctaaagacgttaggcgccttagtccgacgttacatcacgagacctaaagacatgacatgccgaagtctgacattacacgacgaaacataaacacatcgataagttcgaaatgaattacaagcaaatccacatgccgacatagaacataagaactacaccacgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccttgctagcctccgtctcgtccatatcattgtggatgcgacgagtcctcctccttccagccttgcctcggagcttcgatgggtcaggaatattgagtacttcatcgttagtctctgtgaactccccagctatgccgaacccataaatcttgccgctccatgtatgatatattgcttgcttactgaagtactgtgacatatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactacagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagccgctgcacgctgatcactacatttggctgtcaactcatctaatctcttccaaagctcattgaattttttctcctggttctgattgcacagcctcttgaacatgttcttgagctccttgttcttgaattgcttgaagaaattcgctcccatatgacgcatgcaccacctactctgtacatcttcccaaacaccggggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatatctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgctaggatgttcaattgaggggaatttcttcacttcgtaagagctcccagggtttctttcctcgataacaccaagcaggcgtggcaaattgttatacgaggcttcgtaagttccaaatctcatctctattattttctgtttggccctccaggccttggcatagctaatagtatacttgtatgtctcttcgatgtgtcggattattgaccttgcttcatatgtgagattatcgatgacatgcgcatacatctcagatgcaacaaatgcacaagtaatgttcctgtggtatttctgaacaccaggtagaaaacatgtatgcttggtaacgactgacactgtccaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctcattcatatcttctgctctactataaatcgctccctgaataacctcattttctttgtactcccatctcacactatcctcttcagagacgatcagcccagaaaaatccttactagcccattctgctggattaatatccgtctcatcatctgacgaatcaccttcctctacacgctcgttgtcagaatcctccctctccatttcatccacaatggcaccaacagtctccccctcgtcggccactccacctggttgaatgcccactggagctactacgcccccgtcctctcgtgcgttgacctcctccacagaagtctcgtttacttcagctcttggtccttcgccatcatccatgttcatctgcacacctggatccttcgggtgaacaaacggaaccaaagctagaggccacccgcgttgcaatgcattttccaaataccatctccacactcgagagttttgaactggcattagttcccaaaaaaaacctcagttgcctgacttactataacattgattgttatgtcacttgtctgtggatcaactctcaagcccctcattaaccatccttttatagaaggtacactcctctcagccagtctatcaattcctctttctgatacaataaaatctaacagatctaccccagttggcccgtaacggacgtttcctagtccatggtaaacttggaatatttgtttgttcgacatatctgtcaacgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcaggacttcgccccttcttctcttctcctcccctctcttatttttttttcactggaattgaggagagaagaatgagggctgggggctgggcagcaggccttttataggcagggaggcctgccgcccggccagagggcggcaaggggccgcctgcaaaatagccggccccgactggcttttttgcattcgggccccttgccgccccaccagagggcggcaagggttttcctgcaaaaaaccctccctccgtcactgcccgttcctcccccgtttgccacgtcagcttgccgccccagaggtgggcggcagggtatatttttgtaatttttttggccgatagattatttctgtaaatatttttttaaaaaaaaatctaaaaccaaaaaaaattccatttgttcagtgtaggggatatcaagaacaaagagcgtcaataattgagacctcaaatactaaaccaatgtcaatactacacatttagaaacgccaaacccagttcagaaccagcaaatacctcaattagccaaaatcaccaaccacccagttcccagatgccattttgagtgtgccacttcgggtttgcaattttcagttatcaatcaacagaaatatttccctgcaccactgaggttcattgttaaacactgcaattgttatggcatcctacttgcatgactatttccttatatctagtagataagcaacatgtatatcatgtgagtgttttcacgacttcctaactgttaatcggattaattatccgcaccgctcgtaatttatacaatcatccctatagaatgatagattcatacttaaacacaccttattcataaaactatttttttctcctcgaattgcttcccaaccctatttatatttcagtaaatactgtgtacaatgctgcatcttttttctcaatccctcttaaccgtgctttttgttgagctatgagattttggagaatactaaaacaagccaaaagaaaagtacaacttgtaagattgaagacgtcaatggttgtggtctaaccagttgtcggtgatatgggcccgggggtatcacgtctagagggaggaggccgccctcaaacccacgtggctccccgcgaggggggatcaagcccggggtggagcggtggctaccccctcccagctagagggaggaggccgccctcaaacccatgtggctctccccgaggggggtcgaacccggggtgttgtggcggctgccccctcccagcttggggtcgggccgcccccaaacccacgtggctccccccgaggggggtcgagcccggggtggcgcggcggctgcccccccaagctagagggaggaggccgccctcgcttggggtcgagctgccccgaccccctccacgtatcagcccacgtgtatagggttaggtgggcgcgcctaacgcccacctaactgcatttaaagcggtctatgcaaccgcgccaatccgcatttaatgcggcgtgctgcgcatctgaccggtctgtgacggttgaatgaccgatgggacggcgactgtgtacccgcgccctatcagtgtgtcaggcggcgagtggcgtgctctgtcccgtcccatcataatgatgaggggcttcacagcctcttaccccggttagagctggtccaaccactctgaactgacccgagttccccttttttggtgtgaacgagaacccagaagtcctcatccattaaatagcgaatgacaaggatgccctgcatgatttgatgggccccgcgcagcaaccgatgtgtagatagcttctgggctaaggcacaagacatgtaattattatagagaatattttcccttctctctaggtagcactcgcagcacatgtggtatccccttagagtataaaaggaggaccatgcctagcaaggaagtgggatcggaccgaggatccctgagccaaagcttgtctaaccctagcttgcataccagggactttctaagcacagaagaatcatacacacatgagtagggtattacgcttcatagcggcccgaacctgtataaacctcttttgtctcatcgtcttggaggagcctccgagatcaagatcacacatagtttcgctcaccaaatcctcgaatctcacccgctgcccccggccgaactctcaaaggggggcctcacagcctcccgctagagagggtcacccctcgacaccagtgtagatgcaccggtcagatcggacggtcaaaccgctcgatgacatccgatctaactggtgcagtcactccggtctgaccgcccgatgcgcctgttgcagttgccggtcaaactggcgggcacggttagaccaccgtgtgcccgccagtttgacgccacgttgcagtcggtctaaccacaagtatcatgcatgttagaccgtcgtactcgagcaaacataaatcgaagattctcaaaatagattaaactttattacttatctctgtgtttacaaagtgtaacaatagcacttctcatgaaaatcttgactaaactcaaaaccctaacttttctcactctctaaaaaggataccgcaagacacaccctccctctctatttataactgaggtaggtagcctaaagtcacgaaccaaccttgtacaagaagtcctaatcatataggaaacctttccgaaaaagaaacaaactttacaaactccaaatgtaccaaatttggactccttccaaattcgactccgtatctcatacgcacacaatatctacatcgtatgccatatgaaatcttcaccaaccacgtgcaatgatgtttagccaaagtattccacatgatatcctgatcgttcgaatgtcttattttcccaagttgactcccgatccatcaccggcaacactctcttgaggcaagaccacctacacatgcatcaaccaagaaaccatatccgagcacaagttctcaccaacttgactcatttgttagcaaacaacagtattacatacgcatagtatccatctagaagttataaacataaattatccacgactcagcgtcggccagtaagaccgcgggctggtcggtttgaccgctcgcataacaccggtctgactagccttacccagccgatctgaccgcaaccgtcagacttgtcaatcctgtccatcacctgtaaatcaatcatctccaaaaccacttcgccaataatatctcaacatcaaaaccaataatctcatatgccaattattcatcacgaaacaataatcaaacacactttgattttacacacacacacatacatatatacatacatacatacatacatatatatatacatatatatatatatatatatacatatgtatatatacatatatatatataggatacccatatgggactccatggtgcccgggctccaaggtataaaacacacaaattctctcaaatttttaaaaatttacaaattgtaagtagatatctaggtatatgaatttgattcatacaaatacctaacaacaaaacaactcaaactcaactttatttcacaattcattattacatacctaacgaattatatgtttggatgttatatacctagaaccaaaatctaataaaaaaaagttcaaactcagttcaaacttgtttaaacttgttagtaaagaagttaatgttcatatctatacatttaaaaaaaattcatactcattcaaattgggtatatactcaatttgaatcttggagcccatactccatgtagcaccagttaatttacctatatatatatatatatatatatatatatatatatatatatatgtgtggatgctatatatattcaagtttgaactgaatttgaacttgtttttgttagattttgattctaggtatatagcatccaaacatataattagttaggtatgtaatcatagattgtgaaataaagttaaacttgagtttgttttgttgataggtataggtatgaatcgaattcttataactaggtatatactcacaattagtaaatttgtttggtgctccatggtgcccgggcaccattgttgaaattgagtatatacccaattcaaatgagtatgaaactttttcaaatatttaggtattaacattaactactttattaactagttcaaagcaagtttgaactgaatttgaacttgtttttgttagattttgattctacgtatatagcatccaaacatataattagttagatatgtaatcatggattgtgaaacaaagttaaacttgagtttgttttgttgataggtataggtatgaatcgaattcttataactaggtatactcacaatttgaaaattttgaaaaatttgagtgattttgtgcatttgataccatggtgcccgggcaccatggtgccccatatgagtgttaccatataggacgcacggatggggctccaatgttaggagccgtaggatgcttactgatcggttttgatcatttgggtacatagcttaatgggtatacacccgtttagagtatagtatttaataatgaatggattccacatatttgaatagacagtaaaaaaaaggaataaatgcatttatatgcatgcaatgcggatgagagaatttccataattgcgtgtacatttcaaaaatggaaacattaaataaccgtgaaattggaaataatatcttgtaaatatggaaacttacttgcttcacgttggggtctgaataaatggtaacattattgtgaaaaatggaaactaagtatatggaaaaataaattaattttttggaaaaatggaaagtaagtatatgtgaaaatgggaactaagtatgtaacactaaatactgattgttggtttttggaaacatggaaacaaattagttggaaatttattatatatatcgcagcaaatttattatattcaaatgtatttggaaacatggataatatcgcaacaaatttatatggtaatgtatccgtaccaaattattacattcatgactccattaatttagcaatttgagtaacaaaatatgcactacgagtcactttctatttttaggtacgaatgggtcgtatactcaaaaatttggtatgaaacggggaaaaaaatcccatgcaatgaaaaaatttcgattttagtctatgttaattttatggcaaaaaaaactaggtattagaagtacatttttttgtaattatatgatgtacggagatgatatatactcaaaaattaatcgtagtatgtgaaaaaaacttatgtacagttgtgcatcacgccgcctagcccttcgatttaatatatcttggatacttgaaaaatctagtatatactatctaaaatatcagcatataccggagaaaaaataagtacaatataaccggtaaacagaattgatttaggtatatacccattaaaaattgcatatttcggacacccatttttagttaggtatatacctatctaaatgggcgtgaaaaaaatttgactttcaagtagcttacattttttttcttgaactaaatttgaaactagccaggccttttagttaagttttttttatactctcgctaggtagctgaccagatgtaattaggtacatgtagatgtatgtatataagtctcgtgtgttgtgctttttaattttttgggtatgtgacgtgcatgcgtttcaaacgtactacaaagctaggtatttacatgcatgcatttcagatgtacatttaattgggtataataccatttaggatacacatttttaggtatttaaacacgtatattgggtatgtgtgacataccagattctatttgggtatataccggtctaaacacacatactaggtatatacccattaaaaattgcatattgtagtttggtatatacctatctaaatgcgcgtgaaaaagtttaattttcaagtaggtttttttttcttgaactgaatttgaagctagctaggccttttagttgagtttttttatactctaactaggtagcttggccagatgcaattaaatacatgtagatgtaagtatataagtctagttggctatatacctataaaccatttatagatttaggtatataagcctcgtgtgctatgtatattctaccgatgtagattaagtaggtggtgatatttatggaatagtaggatggtaggtatatacatagtaccaaaatattctgtattaatttgcatgattacaacatgcaaatttcatgttaatacactgtcaagaacatcagtttaaaaaaacttgtgttaatacactagctcttagcgcgtgcatccaactggtgtttcttctacccacgaccatcttctccgcatgatcccagggcaacatacgtacgtatagtctttggctcaataggaagatgaaccaaaaacttattagtaggatgcattcccatcttaaggtcttgacaacgaaataaaattgttacagtactcaatctacgaaaacggtagaacagggacttttcaaaatataagaataaattgaaataaattacacacgaaccacacgcgcggcgaccgtcgatgacagtagcgacgaacctcctcacgggcgacctgcggcggcgacaacgaaccttgcgaacgaccggcggtgcgtaacggcgcggtgacgaagctaacagatgactgacaacggcaacgaaaccttgcagacaaccgacagagacgaaaagctcgccgacgtccggccggcagggtaatagcgtggactggacagtggagtgtgtaaaaaatgaaatgtcataccattttatatgtacacaaaaagtggaaaatattaatcggtattgatggaaataaatcaattacaacttaattagtggaattactgaaaatttgtggatctgattcagtgtcatctcaaatatggaaataaattatcacacaatcatagggaaacgatgtgagcatgtgcaaaaaaaggaaagtatgtatcatatatggaaataaattatcatgcaatcggaaggaaattattacgtacatgtttgcttatatggaaacgatgtgagtacgtttatatggaaaggcaatcactcctgcaatatatgcatgtatgcaaatcatgcgggtacactaaaaatggaaagatctaatcgggtttaacccgttaatatatctaatactctggtttgagcagcacaaatctcaaagcacatatacgattcatcaccactacttttccttttgcagatagtactaattggttttagcctctattataaagtgtaaagagtttgccagtacaatcatcatgacattgcgggttagcattgttctactccctccgtcccaaaatataagtatttttagaatagtgctaagtcaaactttttaaattttgaatattaatagcaaacaaatgaaaaagatgatgtaaatgttgatgtttgatgtaactctctttttaaaacattttatttttatagatattgttggtcaaagtgatatctcgaagaccgtgtcgaagtaaaaaatgattatattttaggatggagtgagtagttgatactcttgctaggtcacatttggtattccttccgtttcagattataagtcattttttactttgatcaaagtcaaactgctttaagtttgattaaatttgtaaaaaaataacattttcaacccaagacaaatatattatgaaaatatattcaattataaatttaaccaagtttgtctacaaacttggttaaatttggagtagtttgattttgatcagagtcaaaatgacttataatctgaaacagagggagtagcattcatgccgaatttccacttgaaattttccagaccttcagcacgtttccaaattagaacagttgacgtgtgatggcgagcatgttattgttgttgcatgtgcttctgctaaagactattaaataatcctccatcctaaaatatattaattttttgttagacaggatatatatcctgataccatgaatctggatatatcctatccagatttataatattagaatatattacatccaaccaaaatttattttattttaggacggaggtagtaattatctttgcattagtttctcgatagacataaggcggcaaataaaaatacaatatgaaggagtattagggatgatagggatttccttccctttgagctgaaggatgtgataccaagatcaatggtctgaatttgataaaaaaaacatgcttaatttgaaaatagaaatattattagatgagagaagtgcctgacacgtacactgctaacaacatgcttactatgaaaaagaaaatattagatgagagaaatgtctggcgcttacagtgccacatacacattttgtataagctggcaaagtaacttcaaagttcatatttttgtgttaatcatgggttctactgtttttccaatagtgtcagaaaatgatgttcaactaagttctaacatgtagtactattgaacttctggtgcttgttgagctgggaacatctgaagatgaaaaaaaaaggggcagatatttttggaggaattaaagaaagaaaatggttacttgggccgtcacttgaaagatcaatctgtggatggatctcctggagaactccaaattcctgaactagctgcagcccacacatatgagcttactaatttcccccaacaaattaagcaggtatctgagttgacaagcatccttacaatttcaagctttcaacaaagcatttcgagtgtgctatgtgcagtggtcatcttttatttttagataaatgttcttgctagttatatgtattatctgcaaaacgtgcaagaacttttcactttgtaagaagaacccaattgcacaaggtacattaattacgatagttttgctcactttgctgacaacttgaaatagtttgtggcatacagtttcagtaggcaactcaatttttccaaaaggcaaaaaggcgtcagtacgaagaggtttacatgacgggcacgccgtaatgatctgagggttgttggatatttgcgtgtaatctcagttatcctgatgcatgtggccagtgccaaacacctgaagaaatcaatccaacagaggaaagtgtgatctaattggacaactgcagagatggcatttcttctgggcatcttgacaacaacgtaatcatcgaagttgaaagatgataaagccatgtatagccatcatcatcagtagtagtacgtaagtttgacaacttcgtcttagcaaacggcatctaatgataaaggcgcgattacacctccacctaacgaagtattactagtaaggatgatccaaaaataagctgaaggaagattttatggtgcaatcccggcctgtacgtctactgatttcaattttcaggtccaacatctatgccaaaaatgattttataagaacaaaaggagtatctattgaaacttcaaacgctaaaccatgcattgtaaattaaaaaaaaatatataattcagaacctgcaaacaacatgacatttagccaaaatcatcagtcatgcatctgttacccaacgtcattttgagtgtgccaccttgagtttgcttatttcacttatcaacagaagctaaatatttctctgcggctcaatatgaacactgcagttgttgttggcatactgcttgcatgactgctttcctatatctatagcagctaaacagcaggcatatcatgcgagattcttgatgccttccttacagtcagtcgatttagttattagtacctctcatgatttatacaccctcgaggccttgaggcatccagcatgattgattcatacttagcacgtgttcaccaaaagtttttttttttctattcctcctctcgccacactatatatgttcttagcccctaattgtgcatcatattgtctaatgcaccaactccttacaatatattttagacagtgagatgagatgagattttggagtaaactgaaatgggctgaaataccgatgagataatatttcggatcaaactgaaacatggaggaatgcaacgaaatgagatttgatctatgtacattcataacatggaggaatgataatgaaatgagatttgttctagctccattcatttctaatatcattttagtgtcttgtcaactctttaaatcatattcttctttagtgttgtgagcgcatatcacaacacatgtgttcagtttccagttccagttcacttcaaattgagtgtcctatacacatattcttttttttatcattatcaaaacaaatgcatatcaaagtttaaagagtttatacatggcttcccccaacatgtccatgtttttctttataaattgttcgatgatcttcttactttttcttttccttaatttgataggacaccaattcatcagttttaaaatatatatatgtatatcaaagtttaaagagtttataaattggttttcaacttgttttttttaaataatttgtttgatgatcctcctacctctccttttctttaattttaaagaattaattttaaagaatttataaattgattcccaacttttgtttatgatttgttcaataatcttcctaattatcctttcccttaatttataaaaatattgtttgcttctaccatgtatttctactaatataaatactaaatcaataatgttaatataaatgctaaatcaattatgtgagtgaattagcatcacgatatggttaagtttttgttcccattaccatagatgcattgttcttcaccctgcatttgtagaccaattatttttcatactttcagcacgttttcagactgaagcaattcaataagcagtagaaagaagttgcacaagggcacgttgatttactaaaccaatattatgatccaatagtattgaattgtgtgtaatctgatctcagaaggatgggtgatgtgatgcatgtggcctcaacctcaagtgcagaagtggttgcctgctacctgaagaaatcccacaaaggaaagcatataatcccatcggagaactgcaaatgagtaaacattgcattaatctaatcttttggacatcttgctaacaagtaggagtagtaattaacaaccattttaaagttgaaagataataaaagtgatatatgtagcaatcagtactaatatgtaaatttgacaacctcatctaaggcactattacacctcaccagctcacctaatcaagtgctagcacactttgcagcctgcacaaggatgagccaaaaatagactgaaggaagattttgtggtgcaatccctggctaccaatttccatttttcagtcccccagcatctgtgctgaaaatgattcatctgcaaactacccttgacttgaaatggcttgcgttccagctccaacaagtaacaatccaccttcatctatacaaccaaacagctcatcttgccatgtcacaatcctatctcttgcagtcgcaggccgatcaattaaaacttcgcgaaagatcaatcagagccgcccaagaacgttagctaaatcgcttgcgtctctgaaaagataattcagtgccatgtgctgctgctgtttcactataaattcacaggaagctgatgtgcagaagaacactacccatgaactgatgaacaacctgcagtcagagatggcgtcgccgcgaatctgctgttcggcgctgctcgtgctgctcctggtttcctcgtgcaatgcaggtgaccacccggcctgcccggcggcgtggtcggcggcggtgggggcggagctgttccacggcggcgtcggcggcggcggcggcggggaggcgcagtgcagcgcggcggcgccgcacacgccggtggccgtgttcgcgcacgacgtggacccggtgcggttcgcgctgaacctggagttcgccgaggcggagttcttcctgcacgcggcgttcggcgtggggctggaccacctcgcccccaacctgacgctgggcggcccgccgccggtgggcgccaggaaggccggcctcgacgagctcacgtggcgcgtctgcgccgagttcgcctaccaggagatcggccacctgaggttacaacaaagaatatgattgaaattcaaattcacatttcaactatagttgtttttggctaggaaagtgtccgtgcattgcaataggaaaaacaagtttaaaactaagatttaacttttcttgatctggacgcttcttccaggaaacatattttaagtgtgatcatatttcaacttagaaaagtaattacacacctgcgagtaaaacctgtttgacatatgaatctaataacctcgtagagttctactaaaacgggcatgtctcgtatgtgtgtacgagcctcattggtttgcctatattccctgtgttgacatacgatttttcaaacttgaatttaaagttgattttaagatatttttgacataatttatttttagcattggcttttaagtcgttatgaacaaatatataaaagttttacctataaggctatgtttagttcacaccaaaattagaaatttggttgaaattggaacgatgtgacggaaaagttgaaaatttatatgtgtagaaaagttttgatgtgatggaaaagttggaagtttgaaaaaaaaatgtgtaactaaatacgacctaaattaatttttattctttaataagccagaccaatcgatgaggctctacgtagttatgcaaaattggaaagatcacagttcatagatcaaaattcatgagttgttaccaagaatatggattctaaaatggcggtgatatatatatatgatcgcacttaaaactaattgacgatgcagggcaatccagaggacagtgggtgggatcccaaggccgctgatagacctgagcgcacacaacttcgccagggtaatggacgaggcggtcggctaccacctagacccgcccttcgaccccgacgccaacagcctcaacttcctcctggccgtctacgtcatcccttacctgggcatcaacggctacacgggcaccaacccgctgatcgacggctacgccaccaagcgcctcgtcgccggcctgctcgccgtcgagtctggccaggacgccgtcgtgcgcggcctcctcttcgagcaccgccgcgagacagtgtccccctacggtgccacggtggcagagctcaccgaccgtgtgtcggcgctgcgaaacaagctagggcagtgcggagtgaaggacgaggggctcatcgtgccagagcagctcggcgctgaggggaagatatgcaccaacatcctctccgccaacgtcgactcgctctcctacagccgaacgccggcagagttgcttaggatactctatctaactggcgatgagcacgtacccggcgggttctacccggagggcgctaatgggaggattgcccgaatgttcctcaaaaagccacctcgcattaaccacggtgtctaattagctatgcctacaattggtaaatgggtcctatcctcctattacctcacacatcaatatataatgatagtgtcattagaatgattaatcactaattattaccaatcaataaccactaattaattttcaaaaacgatctcgatctcgctctttggttgtgctcggtcttgcaccggcaccgcgagagcaagcggtctctccctgttgagacgtcattctcgcgtatcaattatgcgataccgatggtatatttgtgaaaaaaaaaattaaaccctaattatttttaagaaaaaaacaaatgatagtatattttcaaatttaattcgaagaatttatcgagcaggatcagtaccagaagtcctgattattttattgatcaggcggtacccagatatgaactatgaaacattagcagatgaatgagatccaaacattagcagatgaatctgtgatcctagatggcgacatataggactcgagaggaagaatccacgataaatatgtcagcctagaaaagaacttctgataagcatagcgacatggattcttttgaaacaagtgcaatgatgtcagccacacgatgcatcaagaaacagatgtaataaagcttcaacatggataaaacattatcaggataaaccgatcaagtcacacgaattttttcggagtacgaactgataacacaggcattgcatgaagtagctagagagacatgaaattgaaacgagttcttccaggtaaaactagtagcaagatctactgctgcttgacctcagccttcctcttctgccacagcctatccagagcactgtcagcatctccctgtcaataaaaagagatgagaaccgaccggaggaggcaacattgcaacaaaagtcatgtacatagcatatgagcaagaaaaacagctaggtcctagctaccaggatggcaccaagaaataactgatgggactcgcattagaaaaagataaatgctagctatctggttttggacatcatgatagtaaaagagtcaatgtacaagtatgatttttacattgctgtcattcaggtaaatttgccacaatatcaatgactacgcaaacttataaacaaagatgtggaccaactaggtatcaaatgaaataaaccagaagcatcacataattatgtaaaatgctcaggctaacaaaaacgagaagtgaattcataaaaacaatccacaaaattgttagccatatcaaactttctgcttgtgtatttacagcactaaagttcagtgacatgatcagctgccggcaacaagaagtcacgcaaaattcatgaccatgaaggaaataacacattctgaattctgataggctgtgagcaatacagctgacagttcacaaagaaaaatacaggcacattacaataaacaaaggattgcaatgattacctgagcacggatgaacccagagagagcaaaggtggtgaagcggccatcgtacagcccattctcatccacatgcccaatgttgatctggaccgaggcgtggtccttggcggtgatgatcctgttcgtggccgagctgcggtaaaccaacacgacaagcattaagtacatctcaacaatcaatcgaattagacaaacaactcatcaggaatgacagaaacataccacttcctggggacgtagaggtccaccatctgaccctcctcgttctgcatggtggcggtggatgaagcaaacaccacaacagcgactgcaaagcaaagcaacaatacacacaaagattaggagaagatacatggaacaccaaaacttatcccccctcaactaaaatactcaatagaactaggcatacagttttagtttatctagctccatatcaatcaaacgggacgatataagcgacatatcatctatgtgtacccaagaattaggatgttaaccttacactagacctcgacaacgagaagtaaccggatctgagaaaaataaaagcacttccttctatccaattcgacaaactagccacgaatttaaccgtacagttgcaaagcgtgtactaaatttcatctgctagacatggaacttgaccaacaaaaacaaaaaaatgctactcgacatgataatgctaacacacaccgattcctcgcgaatcgcaatcagaagatcgtagaagaatcgtcctgctaagcaaccgcgcatgcgaatgggagaacaggaagcagatcgggaatcggggggcgcacctgaatctcccggagaagggaagcgagaccgaagagagcggcggcggcggcggcgtttgaagggggaagaagaacacgaggagcgagggcgatatatattatggcttcgggagagaaaaaccctagcttcggcgtccatgggcccaccgttattgggg

SEQ ID NO: 44169 - DNA, 12884 bp, Oryza sativa
gccaaggtggtaaccgccgccgcctgcctgcctctccgccgcggtttcctcctccattcgccggcggcgagctgttctgacattttctttgggggtgatttggtttctcctttttcagcttgagctgcacacgctcaacagctcgcggtcggcgtacgcgtccatctcgctggcgcgggacttcttcgacgagttcagcctctccgccgccgccgccgccgactcggcgccgtcgtcgacgccgctccagtgcagcgtcctcctcaagtccgtcctctccgtgctccgcacgccgaccgccgcgctcgaccgcatcgccgcctccctccccaaccccgacgcgcccaagctccagctcaccctccactgcctcaacggtactcgccgatccccctccgtcctctagggttttgcaattttgtgggggatttttgcgcgcaacatttttcttgccgttggcgcgcttttcttagttttgccgccatttttgctgtttttggcgagtgctcctgaatttctcatcaaaatttcgagctgttcaggggtgaagaagacgtactggatcgcgtgcagcgcggagtccgaggtgcagacgctggcgctcgaccgcagcaacttctccagccgcctcgccatccggccgcgggacctggcgcgcctgctctccaatttccagtcctcgctgcaggagctcacggttattgccaccgatcctgctgctgggctctccaacgtcggcgtggatggtgagattgaggggaaggctgtcgagctcagaagctacattgacccgacgaaaggtggcatctcatggtgtttgtaaactgtccttttttgtattatgaggtgatgattgggttgtggtattgtgaatgtgaattttctttgcactttgcggttatgcagatgactgcgatacgaggctgcacacgcagctgtggattgacccaacagaggagttcgtggagtatgtacattccggtgattcagtggatgtcacattcggggtgaaagaactcaaggtgatctatgatcagccctatcagtattttgtttcttcgaaaacctacattcaatagatgtaggacaaaaaacttctgataattatagaatggctcctttaaatgggaaataatttggtatttagcattcacctaattgaatcagagaatatttctttaagatcattatagaaagaataacgtaaataatatgtatccgtgtgtcagcatgcacagtactgaatgtatgtagagcttacaagttgcaagtcaatactcttgcttttccatcgaatacatgtaggttgcttccttgatgtagttttgttaattcttccgtctccttgctggactagaaggatgtggctttatggctagttgtattctgagtaattggtatagaatattcattgttttttaaactttactgctgaaactttaaggaaacaacttagttccctgctcaggtatttttatggcatgagactacatatattgtatttacttttctatctcttccaacccaggctttcttaacattttgtgaaggatgtgaagttgatatcctcctattctttcagaaggctggcgagtaagtagccatactggtttagttttattatccatttggattggaccttacaagtcttcatttgaattgcaggcctgtccttttggttcccaaatttgggcttgacgatggatcaagttctgattttgatgcaacactagttcttgccactatgcttgtatcacaacttactgacagcagtgttgcccaacagccaactacttctgcacagcgagcagaagaaccaagggttgctgctacaccaccaccagtccctgaaaatgtctcaaaccatactaaaatatggtcggagctatcaggtgtgtatttctgataaatggatcctgtcaactattggtatgatcacacaccaggcagggctttctgtgtggtactcaacgcaggaccaaagggcctgtacagtgcatattggctactttcggaaggccataattggactgtacgccatatgactgtgtgtgatcaaactaactggtggctggagaacttcatttctctctgattatagaattatcctgttgatatatcatcatgctagtcaaacataagaaagcttttgttaaacaggtagtgctcccaaaagttttgaagttaacagagaaaaatacacccagaaggagagaaatgccaattctaatgcactgaatgacacatcaatgctgcatagtgtaaatgctcgctacaagccaccagtcgctgataatgcaaacgatacgtatcctatagatcacttcaattcattctttctaatttatcctcttgtattatttgctactgcatcctattctgcagttgcagctttatatcttgtatatttcttacgactgtgaccttccaatgtgttcatcagacatcagacatattaacagcagtccttaactctgttctctctgtccaagtaaattaagtctggacttaaaaaataaatttctttaatcgggattatgatatcattatggattatgatatcattatggtattatatacttatgtctttctctcaatccaaagaaattaaggctgcatgcgagaatttttctttagttgggattgtgagatcagcatccctcaacacaaaatgcttccttccaacattatatcaatagacagaacagaacctgtgtccacttgcctatattccccatggtaaatacttcctccgtttcacaatgtaagtcattctagcatttttcacattcatattgatgttaatgaatctagacatatatctatctagactcattaacatcaatatgaatgtgggaaatgctagaatgacttacaatgtgaaacggagggagtatgtatttattgcaattcatctagttaaaaccataagacactttcagtgataatgttaaggttagtgttaggagtcaacttacagtcaatcagtcatactgtatttgatctgactaatctgcatgaatatagatatatacagtgtcagagggagatagattgtggttttcttagacacaatgccaggccctgaggtccatagaaaatcttgcatacaattctatagggaatagttactaaggaaaacattacatcaatggagagaacagagcattacaatcctatagggaataatatggcaattaggtcctagtattgagcatttgttactgcacagaactgatgtattatgtcaagatagttgatgttcatgtagagttttccatatgttgttaataatgaaagaggatccacgaggtctgagtttcgagttatttctgctttcctacttccagaatgtatttccttgactagtttgtactacagaatgcagcctatgcaaatggatcacttggaagagcctcctggttaatatcacaacataaaacacatcatattttgaagtcgtctgttactgatgcatttatattacaatatatctaaataacttgctttattttgttgtagatgttgtcagtgataatcctcgatcacagcatcacccaagcaattgggtaggtgctgatgaagatgacgatgatgacgaagatgaggagcttttcgtccaaacaacaccgcactacatggactagggatcgatgctgatccttatactttaggtacatatcaggctatcagcccgatgcaaagagaatggactagaaactagttaagtacctttctctttgctcttagttctttcaggcctgaagttaacacagaatatgttaatctttttaacaatgtgacttgtttgtatccgatgtggctatggcatttctcatagtgcagagattttttttatgacatattgaatgtgaattgttctatggtgcacaagtggcctgtttgtccttgttttgtttgtaaggaaaataattgtgtttgaatctatacgagctgcatagtcccttgttcataaacaacatttctacactcccggtgttttggggggtgcaaccaggtatcagcttgtttatgtgatctcttcataaacctttgtgtatgcggacgcatgtgctgcagggtgcatcattgcattactgcaaagtttaggaggaatcatgaattctttagtgatatgtttccatattccaatatttctcaatctctgtgaaccactcatgcgttgtatggcttgtgatgatctgctttgtatggtcttttggtttgtttactactgtgcatgtagcaatgtggttaaactaacatgatgcttttactttacctgaccatagaagatggttaaaaaaaatgtaatttgagatctggcatggaaactgcttcctttttctaatggtagttttgcttcttccgagcatcttgcatcggcatcctgccatgcgcgttctgctttgatggagcctgatgtctcaatcctatcaccttatttttaatgctttgattgatctgatacattggtctttccctggagtattggttagcaagaactcagaaagactatcggtagggaaaaagagttaacctttagaatttactctaaaatataacaacttatcccccaacattacattctcaatcaatcataaccctccatcattcaaatttcctaactgatagtatcttcaattctcaaccaatcacaatattccaccatttaattcaacatatttttttaataatcatgtttaactctaaaactctttatatgtttggacagatgtagtagttagcaaggtaaaatattactgttcaaggatggattaacattaacagtctgtttataggagtaaattttaggcatagttaagttcactcattaccctcatgtaaaaacactattactgccctgttctaaactctattttggagttgtagtttaacaacacgaaaaaacatgatggcttattatcgtataattaattaagtattaattattataaatttaaaaaatcagatttttttttatttataaaacctttatatgcatattttttgaaaaaaaaaatatcatctaacatcttgaaaaatatgctaacgtaaaacaaagaaattgcagtttggagttaaaagaaaagagtaaatttcactttggtcaacctttatttaccaaattttcacattggactagagttagacttatattttcacttaacaccatatatagttaccattatttgcacttcgtaccgggtttcacaaattacacatagtataatgattgtagatctgatcttatttcttttgtgttagaaaacttagaattcaacaatttgtactaacactacagttgggtattgtaaaacatgtaatatcttttctagaaaaatagttcttaaactcaatatttctccaattttgtccctagtataagggttgtgaatattcatatgtagtagtaatgaagtcccattaatttgataggatatcatataacatgttacaattattgttcttgcgctaagcatatttgcatggcagagatttctatatcattgtttcttgtaaaatgctaagcacctagacaacaactcgtgtgatggtaactataaaaccaggtctaaagtgcaaacaatggtaattatacgtggtgttaagtggaaacatgagtctagccatagcttaatgtgaaattttagtcaataaagatggtccaaagtgaaatttacttgaaagaaaataacgtaggctataggtcagtattttgtggcctttcgcgattaatttggttgagacttcttcttaatggcaagccattcaggtcagcaggtgtgatctttccctgcaagttgagtttttttttaacatcacaagtaaagcattcagccaaattcaaacagtcgtcgcttgtcaaatttaaacaaggtcaacttttcgtgtcattatcacgtaatttgcacagaattcgaagcctagtagtctccagaatctctgtgctgcctgtatataatgcccctggtcagctgctacggccactctccagtctccacacctgccggcgaccaccgcgcgcatcgcaaggcacagagggcctccgttgccgacgtccgccatggcacggcgcgcgccgccgttcgtcctcctcgtagccgccgccgcggcggcgctcgtcgtcgtccctgcgacggccgccaccgccgaggcgctcgtcgcccactgggggatgcgggcggcgccgtgcctggagggcacggtggaggaggaatgcgtggccgacggggaggtcggcgtcgtcgggctgaggcggtggcagcggcggcggcggctgttccagctgatggacgactacggcggcggctgggccggggcggcggcggcggcgcagtacatcagctacgcggcgctgatgaggaactcggtgccgtgttccatccccggcgcgtcctactacaactgccggccgggcgccgacgccaacccctacacccgcggctgctccgccatcacccagtgccgcgactagctagccagctcgccggtgcactgcacgcgcatgcagctcgtgtgccactcctccactccttctttgcccttgttagttgtcgccgatctccgaggggatcctctaccacaatgtcactatacagttattcgtatgtggacctcaccattttattactctatctgttagtgtttataatggtggtgctattatgatagatgatataaaacctgatctcctgtagccacctgagctcttgttctaatctggaccatctggtcactctgcctgtctcgatgtccatgatcttgagagggttttttttatcctgcttgatttaatttacagcgcgttcaattactactactatgctgttattgtcattttcccatgacatgtggttgcacattgcacttgcaatactcatcttgcatcgtcatgttgacgagggtaatctagctagctaccaaagtaatggatgcttcgattgatcggagacaagcatttcctgctgcatgcatagctcgattctgtgctgatgaaaacattgttgaactggaacgcggaaggagcttgcttcgcggggaaaaataaaaaagagagagaagtattgagaggagtaatcgcgccgacaattcaatctcctggggaggtacaaactgtaataggattgacccaacgtcgcaaccaaaccaaaaaccacacgaagcttctcacccctccaatggaaacccagcaagttgattggcaggaatcaggatgtggcaggaatttgcgaacgcaatttttttttccccgagcacaacttgcggtggaatttatccctccaaattatagctttttttaggctatgtattagtcgacagcgagatatttgtgataacttcgtcaacctcaagacgtcaagatatgttggtacattcttttaaagatgtttataggggaggagagcgtgtgagcactcataaaaatgagtgtgagcgcatgtatttataccgtattttctctactactccacctccatgtaaaaacatctttccttccgtacaaaccgtcaaccctgaaataccgatttctaaaaaagaaaaaggccatactaggaaaaacgaataatccattggtctaaatccttccattaaactgaataaaaaatcatttgtaacgcatatgtgtccaatagaatgggagaggtcataagcctagtatagtctacttatacatcgtgtattatctttacagtggtacatggcttgagctatccatatgcatttgggtagccataaggaacaaaacaacaatataacaaaacaacaatacaatctttctcttctctcctcacactctctttttctatgcatatgagatatttaatataggggttattaatacgcgcgcacacgtcaggaatcaaagtcgtgctcccctcaatttcgacttagatattaagccccctaccgtgacgagtggattggagtagcgttttctatccatggttcatggttaaaacttcaaatcagattgtaaaactttcaaattaaaaaaaaagaaactttcaactaagaacaataaaaaatttagaatatttaatctttctatttatggattgaaacttctgactcaaattagaaaactttcaactcaaaacacgaaacttttaacttgaattgaaaaactttcaactcgaattagaaactttcaacttgaattgaaaaactttcaactcaaatgggaaaactttcaattcaagacctaaaactttcaaccaaaaatcgcaaaacctggaaacttgtcagtagcaagagactcgccaaaggaaggggaagaagaggaggtcgatgtcttgttgaggacgtggaggatgaagaagggtaagctgatgtcttgagttcgccggcttctcattcgagcagagcatcgattgatggagtagcacatcgaggaggcgagaaggtgatcctaacctcgttggtgtcttggggggagaggaagaggaagagggagttaattaggagcagcggactttgccaatgctgttgatgttagatgaaggcaaggaaaagtggcacgtcgaggttggatagaggttgggagaagtaatggcgaactagaagtgggagcattaggaggaggtgaagcagagcgataggtgtggaatagatctatttaagaggataatgtgtactggaaaaaaagaaaagaaaatgaggaatgggttatccacatggatctactagacctaaagccttcgccgtagtgaagctgggccaaaactgttcacgattttatttcatagcgcgcacctacaaaataggaatcttgtttaatatactcctttattatttatctgggcccaccttacaactcacttctaaacttaaccattgtgagaaatgaaaatagctaatgatcacttctcatggttccacctataatgactagttgagcaatatacattggcacattgcttatgcccgaaagcgcaagagactcgggcttgtttgggaaacttgaaattataagaagctgttggtatcaagtcaaattatgagaatctaaaaaagttaggtttcccaacttgtgatttttttgtccattttctggattctacgactacaatttcttagtatctagacgaaaaactaaattgattaagaaagccttctgattcggagagaaactagttccgtttgagaaagccctccatctcccgttgcaagttgtccccatccctggtgctcttggtctcttggcagctgtggaaggaacaaaactctagggttttcgactatgcactctcttcgatctcagtggttctggagtccatccactcagagggccatctgtggtctttagctggcattgccgcttttggagacttgttgggagtatagagtggctcggccccttcccgctatttggagtttgtttttagccgccgtagttttttaagctccagtttcttttttgcttttttcccccttccctttgcataagccggtttggctgattgcatcgtgcaactataactcttttcttctaatatattgacgtgcaattcttttgcacgttcgcgagaaaagctgtccccatcccattgacgattgggacccacatgtcagtatcccgtaaggcccaaaataacccatctccgtttcctacggcccattacgcagtgagcccacatccaaagcccacgacgaacaaactgcaccactcaaatcactcctctcccaaatccccgaccaaaattatccaatcttcacctcccacaccccgagctcgagctcgcacggctgccgccgccgagctccgcccgccgccatggcgtccgcctccctgtcgctccgcctccccacgccctccactgcaccttcctccggggcctcctcctcgttcctctccctgcctccgaccttgctccgccaggcgcggggtggcgcggcggcgtcctccgcgctggtggcgcgggcggcgtcgggggggagcccgaacccgctcttcaacccgagggccgacccgttcctgtccaccctcgccgccgcctcgccggaggagctccaggctgcggcggcaggtggcgggcgccgcggcgacgaccacctgccgttcctcgagatcttccagaacgccaagctcatggcctcgcccgcgcaggtgattgggggggaggggtttcccgtgattttcctgcgaaagagttagccgaaacatgagatgctgatgccgtagtccatagcaatagcaacatagcgttccgcgagttagccgaaacatgagaggttgagaatgactataatcatccatagtccagcacaaatcaaagtagtgcatagcgctcaacatcacctatcataggttggtactacctccgtttcatattataagtcgttttgactttttttaagtcaaacttctttatatttgatcaagttgatagaaaaatataataatattttcaacacaaaacaaataaactatcaaaatatgttcaatgttagatgtaatgaaactaatttggtactataagtgttgctctatttttctataaacttggtcaaactttcaagaaatttgactaaaaaaaatcaaagcgatttatctgtactaatataaaagatggtagtggtggtagtggtgactttgtcattaccatcacccaactaccatgcgggactcatgaaccgtgagataaaaacttttcttgtttcctagctcccacataccattagggctgtcaacgagccgagctcgagcgagctcgtctgcctaggctcgagctcgatacaagctcgagccgagcctataaaatgttcgagctttctgacaggctcggctcgagctcgactaccgagcttgatttttaagtaagacaatatatatttcaaagataatctttaaaaaaataatcaatttctagttcatcatattagtagaagagtaaaaaagaataaaataaatatatgatgtcaatataagacatacaaaacatatttgatctcctaatttattaaataacaacaaaaatcatatataactaggctcgttggaagctcgagctcggctcgacaaagctcgcgagcttagggagaggctcgggctcggctcgtctggagctcgagccgagctcgagcagctcgcgagcctagagcttttttgacagccctacataccatagaccccgtcgaaaggaaaatgtaacgatagaatattgtgaaattttccatctctgtgaaatggcagtaaaattagcacaatgataatatattagacaattagaaaaaaatcattgcaacgcatgggcattatactagtaatatgaaacagagggagcatttattactaattctaaaagattctcaactagtaacatgtaaaatacaacctcaatcgctcctcaagcaatacattaagattacctgggattggaatgttacacgcttatacatggtgatacctattgtgttaagatttcgatcaatgaactgctgatttgaactgtaatgcacccagcttaatcatctgtatgtgcagagaacacctttattttcatactgaacgttgcttcacttaatacttcattacctataatctgtggcaggtggaacgatctagcagttcttacagccagcacaggcctagaaggcctccccctgacttgccatcattgcttcttcatggccgaattgtttacattggcatgccggtatgaattgcaccatgttctctatgtgaaatattttcttcaagtcttactatttacatatgtggatgtaaaacatgatgacaagaatgttggtgaggtcaaccaacgtggataagcaatttcatgagaatgttagatcctgagctatcaaaagttgaaactactagggactggctactgacattttgcatttcagtggtgttaaaaattgtttatattagcaacaaaatataattgttgttgacctaattcttgaatacaaggttggatgacttctattcccggtatacgcctgtcataacaaattctttcttatatactctgcattatttaagatgtcttggactaccaatgtcttttctcctctttttttttttgtaaatatctattaaatcggttattcatgcagctgttatagcctcataagattgttttttcttgctatgtagttggtgccagcagttacagagcttgtcgttgcgcagttgatgtaccttgagtggatgaatagtaaagaacctgtttacatatacatcaactccacaggaacagctcgtgatgatggtgaaccagtaagcatgcttatcttgttcggttcatggctcgcagtcaactattctctaccgttttgatagtattaagtagccttttgtcattaattatcatcataattgccgaattgttcttagactgactttgatttaggggataagataaccaagttagctaagcttaattccaaaaattacgtttgtcaattaacatggataacctgaattaccgttttggctagattagatggggtagcagtagcacttagcagtacaacagatagaactcttgaggactaattgtggtcagttagcttatgccacctttctatgggctaacataatcttaacctcttgggttagggtggtttaaaggtggggtagtagtagcacttagcagtacaacagactcttgaggatcaattgtggtcagttagcttattccaccttttttttttgagggggggggggggggggttaacataatcttaacctcttgggttagggtggtttaaaggctttgacaaggttaaattatttacttagcctgtaaactaccaatgtttgagatattaagccctttacccaccccctaatcatcgttttattttgaaaattgtcaggttggaatggagagtgaaggttttgctatctatgatgccatgatgcggat

SEQ ID NO: 44170 - DNA, 12641 bp, Oryza sativa
  unsure (1)..(12641): unsure at all n locations
aggaaaacgctatatgttccctcatgccaaaggtattaatatgccaggagtactttctttccttgattgtttcctttttatgatgaaaagattctatcatgccagctatgattcagcaacctcgtatcccttcatatggaatgatgcaagcatctgatgttgttattcgggcgaaagaggtatgatctgtgattttagttcttagtattttctgctatggtgagagttttatcagggcatgcaggagatcttagttctcctttgttcatcttcccgtttttatgttgcataatcagtcacagttaccttcttttgcttcttgtaggttgtgcacaacaggaacaccttagtgagacttttagcaaggcacacggggaatgtatgtgtatatttttaatatatttcttgaactacttggtgccttgttgtcattagaacataaatttatcttttatcagccaccagagaaaatagacaaggtgatgagaggaccattttatatggattccttgaaggcaaaggagtttggtgtcattgacaaggtattgttgtttctccgttcatcaaacctctattgttttgctgttttcggcatatctgaagttcaagccgtactagttttctattgtttagtcagccatataaatctgttcgttgcacaatgcagtcatgaaactcatgatcttttttgttgtactccaatggtagcttgctaaattgtattgcctgtgtatttgaacacatttcactctgcaagatgttgaatttgttaacttgtgtgagttacagatcctttggcgtggtcaagagaagtacatggctgacatgctctccccagaggaatgggacaaagttgctggagtcagacgccctgatattatgtgatgttgtacattgaaattttaaattaggtaagatatcctccgttgttctgtagattgatgtttggaattatgaacatttattcatatatttggtttgatacttttatgatgtgcagattaggcggttaagttgtgggatgtgaaagcagctgtcatccaacaagaatacccctccgctgttcattataggtggtaaaagctcagcgaagttcttatttactgataagctagattaaagcaggaaccatcaaggtactctgcatgatgtctgaatcagagctagcaaggttatgcattttctggagcaattgatattcctcgcatcatttccacgtcagattttggtagacattgctggtatatagtttggtagtttacacatttgttagtaaaccttgacgcggtatcaactgaggtccaaacattatcagcacgaacaggatggtgtccgagagataacattggtcgttatatcctgatgttatggacttctgggatactgtggctgctgtaattctcgatcatccacatgttcagtttctttatgcttgattctctggtgttgacccatcacccagtgcacctacagcttcggcttataataataacagttgcaatctgacgaggctctactccctccatacacaaaatttgtttattttagaatgaaggggatgcctatatccaggtattcatgccatcattgtattttcgtgctcggtatacactccatcttaaaacaataagttcacttttatacatgtgaatcagtataaaatggatttttttttatttttagacggagggtgtacgtagtagtaacaggaattgatgaatctatgtctagatttacatatgaaaatgaacctatttttggtaggaggatgtatatgtagttgggtgagtgctcttctctcggcaaaagagacatgtcacggcgggtgcagcgtcagacctttcttgctgctgtcggcaagcgttttttgacgcaggcggctcgtcgtcggcggctgcctttctctgtgcaggccggccgaaagcgccgagctgcttggagttgagctgaacctgcaggttggatacttgcatgtgtagtacgagttttcgcagagacctggcttgagagtgcggccaccacccgggcacgcaccggcacatgacgcggtgaaatattccgtggagtatttgtttagtggtggtggtggcatcgctgcatgttgggtctcgtttagcctctgtagctgcagctgcgtcggatgcttggatgtggaccgtgattgatggcttgtggctcaggcaacgcgacgatgttatgctttgctgctgctctgcctttttttttccgcggcgcctgcggctgcgcgcgccgtcagcggacggcgcttagcttaaactatacgtatactactccactataatggctatggtcttgtttaggttccaaaatatttttcctaaaaaatgtcatatcaaatctttggatatatgtatagagcattaaatatagataaaataaaaaactaattgcacagtttgtataaaaatcatgatactttgtatgaaaatcacgagacgaatcttttgagcctaattaatccatgattagatataagtgctacagtaacccatatgtgttaatgacggattaattatgtttaataaattcgtctcgcggtttccaggcgagttatgaaattagtttttcattcgtgtccgaaaacctctttcgacattcggtcaaacgttcgatgtgacaaaagaaaaaaaaattttcgcgaactaaacaaggcctatgttgccggctgaagcgcttgacgctgcaggggtttctttcggagtgtttttgtttgtcgcaataacggtggtgctaactgtgagcgtgcgccttcaactgatgaacggttgaccagatctctttgctctccaggtctggtggttgcagcctatacgaacggctcacctggcgacgtcagacactctcccaactaatggagtatggtctaactgtatgtcttaatttaaagtcaatcttcaattctgcatagtacttgtatatgaccattattgtttcagttgaaatctagacgcatattcctcaacttttttttttggcatgtgggatgtacaacatatttgctgttgctttatttgtctatatcgctggtatattcaacatcctaatttaagaagcttatctatcggtagcttctctatcaggttatcaatgatcgaatcgatggtgccggatttatatggtctaagttactgacctatttggctattacattggtactcgtttattcgctcttgcacctataaaaaatgatcaatattatagttgcaattgtttactcgcatcttctacaacaatttaagatatccaacctattttaacatgttttgcacaagaaaaaaaaatcctaaattaaggtattcaaccctttgactcctaaaccaagtataaataacaatctaacttgattttgcttacgtggcacactgactaaatctttattgttactcgtcatgtaatgtatatgagtcgtatataacttaacttactgtttacacccaacattactcagctctacctagtaataggttaaatgtgtaagtagtgttagtaaacggatagttatacatttagtttccttaatcaatattggagttagcataccatcaacatgtgatattttctttgactagaaaaaatgcccgtgtgttgcaacgggtgaaggctattttaatattatttgttatatggtttagttaaaataaaattcactgtgttaaatttgcttggatatatgttttgttagaaaatcaagagctgtaattaggagtccgaccgtctcaaattagcatacgagttttttaacaaagatttttttatacgatttcttctgtatttccaaaagcgaacgaacttaaaaaccaactcaaatacgaatttgtatttctaaaagcaaacgaatttaaaaaccgacccatacacgtatgacgtaccaaagtatcagtaaaaacatcttcaagttttatatatttttcagagaagattacgggcaagaagtccttttttggagtcggacttttttttaaaggagacgacgtttttatttcttttttatactgtagaagtttttttttcatttttttatttttctcgcctttttttttctccacagcagactcggacttttcttaaaaggagtcggacgtttttttttacggagatgactcccggtcgggcgcccggtcgggagggggtaaaatcgggcgctgacgtcagcatgacgtcagcgcttgatttatgtgcaaaattactttaaactgatttatctcttaaattacttatccaaacttatccaaatcatgatccgattgcacgattaaattcgttgcaattaaatcttcaaaacaagaccacacatggatatatttcgatgaaaaaaaattaacttattattgaattatttttaaatattgcactatgttccaccaggtatatcggaattgttttactaagtagatcgaaaatgtttcactcgtttaaatcaggtgttgtttcaccctatataaaaacaatgttttagtaaatagtgaaagaatgtttcagttcattgcaacattagatctatatatagtgaaacattgtgagtacattatgtgaaacatttttcggtggaacaaaaaataaactaaactcccttaatagggggtttccaaaatatgttggttttttttaatggaatgtttcgttcgttgcaacattagatctatatatagtgaaacattgtgagtacattaggtgaaacattttctgtggaacaaaaaataaaccaaattccttaatagagagtttccaaaatatgtgggttttttgttgcaaaagaatattttaattcactgcaacattagatctataaatagtgaaacattgtaaatatactagatgaaatatcttttgtgtaaaaaatggagggagaagtagatgggtctagcagatagcagatatacaggtgggggaggggtgcgcgggggagcgtccgatccagttccccccacgccggtcgcccggagtacagcatttttgttttttatgatagaagttatttttctcctttttttttccactggaggagtcggacttcgagtcggtcgtttttttacgatagatgttttttttctctttttttttgttttttctctatttttttcgtcgtctctctctttttttccaccggaggagtcggacgtttttttacgacaaaatttttttctccttttttattttttctctcaatttttttccgtcgtctctccttttttttttccaccggaggagttggggtcggacttttttttatttaacgatagaagttcttttttctcactttttttacaccggatgacggatatgtattttcaaaagcaaacgaatttaaaaaccgactcatatacaaatgatgtatctaaataccggtaaaaacatcaatttttataatagtagagactaacttcagaattgtttaggaatacccgattagaatgagtagagatataaatagatatagatataagcatgggaggaaaagaaaccatgtcaaccataaagaatatattttttttggatagaaacggaggagttaatgatggacacagacgcgtaaaaaccgtaaaggcatattttaatttttttggctaaagagtttaccaacacttggtattaataaattctaaccaaaatccgatacatcatcaaaatcttaatgctatactattcagtttaacgctaacgccactaaacttccgcaatgctaaatcctctatctaccatgaaaacatagtcctatatctaccatcaaaacataatagactactctttctatcccacaagaactccaatcctgatttcacatggtggatttagagcaggtacaatagatcattttttgttggctatactgcatccatgtcagaaaaattgatgagttagagtgtgaatgactaaatgagtggacagagagtgaaagcgagcgaataaataagcgtcaactgctcacacgctccaaggtgaaaactatctatgctaccatatctcctattagttccaaggtgaatatagacattgtctatattcgttgtactaggagggttatatcctctcatagattgtttttttacgaaggagtagttcttttctcacggagagaatgattggatagagagcaaaaggatattggcagacgtgaaaaggttagattaagaaattaagaatagatgtattctatttgggtgtagatgatttaacatctactgctaccctgtcaaaaaaaaataaattctaaggatgtatctagacaacatgtatgttcaaatacatcctcaggattggacttttttttagacggaggggatacttatttgtacacatactgctcttattcactaggggcctgtttagatcacaccccaaaattttacaccctgttacatcgaacgttcgaacacttgcatgaagtattaaatatagggtaaaaaataactaattgcacatattgcgactactttgtgagacgaatcttttaagcctatttgcttcatggtttaacaatgtggcgcaacaataaacatgtgctaatgactgattaattatgcttaataaatttgtctcgtggtttactgacagatattgtaattatttttttattagcgccaaacaccccatgcgacacactgtataatacccgatgtgacacgccaaaactttacacccctagatctaaacaccctctagctctattgctgatgtggagatttttggagccaacgataggttatactattaaacttactctcaaggggagagacaaatgaccaaaataccgctaattaatatactgatgggtgggtaggcgaggggtattgaagagataaaacttttcgatttgtggaccgatgataggtaagaaggtagaaattggtttattttagttgaaaggggttcaagtaaactagatgaaaagtttcttggaagtgaatgaatgagtttctgaacacagtgaaatatgacatttgagtgtgtcatacacttgtgcttttcactcgatcccaatgactggacgtgtaggtatgcagtatgccgatcaccaggtttgtgaagtctaggatctagtatgtattttgtttggattaggatgcggatccggtccagtgaatagggtatgcctaagcgcccacccgagattaaactcgagggtgggtaagacccagagcgaggttgtccccgagcgaaggcccctcaaagaggcgagcccggaaaccatgcgtttttttagtaccctaatgtctagtgtttttaagtgagagggattctacctttggggaaggtaggattcctcggagcaaagaaatattagtgtttgctatttttgtggaagtgagataagtacttccttggggagggagtacttatcggagtaaaggaaagcacggcggttacggttgtaaagaggttagtcccgttattaggaacagttagcgatgttgccatcggagttacgtatatgaggatacgtgtattgagaaaaaaaggccgagaagacctgttttcgaagttagaacataggtttagtgatgttagaagttgatttattttggtacagagggagtatctaccatcaaaacatagagaactgattagtacacaaactaaactaggcatccagattaatgttggtacgataacatattaatccttatacggttaaagttcatacattcgcaaaacacgcacaaaatccaccgttaaaaatcctctccccgtttttgaataaagttcctccgcctccggagtccggactgacggacggccgaaccgccaaacgacgacggcccaaactctctgctactcccacaccacagtcagcacgacagtacccaatccccagccccacgccactcaaacacccgaataatcctcatccgcaagagggcagcagaagcagcaaaatcccctgaaaagaaagaaaggaaattaaaaaaacttccccaaatcgcctcggccctcgaccctcatcgagacagcgcagcctaacctgtcgcgcgcgccgctcgcccgtatcattggtggccgcctattatatttgcccatttgcttgcccctttctctcctcctcctctcctcttcgcttccccactaatcaatcccaccacctctctcttaccttctttctcttcgattttgttcccttctctcgcgtcgcgagttccttgcttcgtcgcgtctctctctctctcttctctcttccgccgcccttatctcgtcttcctctctctctcttcccctcgcggatcgagggggggcggagatggtggatacgaggaggagcgcggcggcgaagcgcccggcggcggaggaggaccaggaggaggagaaggcggcggcggcgccggcgccggctgcggctgcggcgggggagggggcgggggcgcccgcgtcggcggggcgaaggccggcgaagcgcggcaaggtgcgggcgggatctcaacccttccgtgcgcggcggtggcgggcgtctgtttcggggggttctgatctgtggtggctgttggattgtgttgtgttgtaggccgtggcggtggaggtggatagcgggaaggaggatgaggaggcggcgtcggcgtcgggggtggcgtcggcggcggatgctacgcctgtggtcgtcggaggcgggggcgcggcggtgccgccgcttgacacggctgggctgcaggctctgaccggcgcggtggataggctggaggccatcctgaggcccggcgaggcggtatcgaattcggccggtacggtttcttcctctctggtgggtaagactacgggggttttggattggccctcggggtctgatgaatcgtcgctgcaggccataagcgcagtgctcttgctaaggatttacaagcaaagttgaaggaagtgaaggatttggcggatggcgtggccaaaaagcggctgcccccggtggccaacaggcgccaggagccctggtgcagattaatatctcaacatgctaaggtctggctgcgcggtttgttcttgatgttgtttgggtcaataaaaccgtgaactcgatttgctcattgttaatatattttttattttttatgcttagatgataaattagactcatgaacacttttgttacttgtcaacaacatcatttctactcatcagcttactgcatactacattttcgtaaaacttcttagttcagaatagtcctgctcctccaatctttaataagaaattgtactatgtttttggagcttatcagcgaacagtttaatttcatatataaatacaatttattctataacataatgttcacaaacaactaaaattcgtatattatgccattaagaacctggtagtgttctccaggaatgcctaaattaaagacacattgttaaatatgcttgtatccactaagttactaactgttaaatatgttatgaatccactaagtgttaaatgtgttatgtatcttgcagtcataaatccttttcctctaactaaaccttcactgctatttcagttgggccatcaataggtattgcaatgtgcaggaattgtattactacacaacgaattacataacaattctatcgcaagcatgtataattatgaaacagcgctattgttatttttgctattgcatatattttgccaacattagttagtagctacgtaatacttctagcaaattcataatacactctctgctcttcatttgatttactgcatttctttcttaatgtgcagaatccttccattcctattaatgcctcgcattttactgttggttatggagctcaccataacttgagactggaagggtcatataccaactcacttgtttgtagattgaagcatgctaaggtaacgtggtgttttagaagttcctgtgttatacacatttcacgtcttatgtaccctgtcttatctttatttcatgtatcagcgaggtgctcttcttgaaatctacgagtccaaagttgttcgtgtaaatggaaagtcttttgacaagactaataaagttacgttatgtggaggggatgaagttgttttcaatacacctgtgaggcatgcttatgtatcctttttattgcctacgccttatccagtgggttccttactggctctgtttgaggctagcaccaacaggatttgatttttactggacacttgtgcataataagattttcaattaagtgataagcaatgattagacaattaaatattttgcctttgaaagtccttaatgcgatgttagatatttgagcaacttccagaggagaaatcaagcacatcgccattttcctctacttggtgtagtgttcagccggggcagcattcgcttatcaaagattttaaggatattttttcatctaaggaggccaaagtaacatccttttactttggaaagagtcgacctcctttgatgcctgttggtaatgtatttcatttgaaattgcactttacctgatagaaaaagatgctaatgtaagcattattgcaggatcatcatcggatccagatctggtcagtagtctatgtaaaacaatggaggaccagtttaactctgaagaaaacacaccatttgcttggtgtcaattattggaggaggatttgaaaaatgcaactattgatcctagtgaaatctccgagacatttgatagctgtccatattatctaaggtaaactgtacttagctgcctgtctcatggcttataattctgctatttttgttcttaggatatctctgtaaactgttgtaataaattttgttaatacttatgagattgagtatttgttctttggccttgaaatgccatggttggtaagttctgtggtctctgtgcatcttagtttggaactcttgataagcttcatcattgtattccacactcatctaaatgatattagtttgcagacatatggtgctgttatttcttctaggaagtcttattcttctatctgtaatttgcagcagatgtaaatgcttgatattagtttttttccttgttccttccaatttattctcaaatgtttcttttgtaatttctttttgtaaattctgacatacaattagtccagcaatatatggatttagtgactgaataaaatcattagatttatgttatctatgcttccatagaatcacttctttattccaaatggtctcccagtatgaataaatctatactattgagttgactcctcgctgcccttgcagcactatgggctacagtagagtagtagacacacataggccttggggacgttgggctatatcaactattttatgttccttctattttttttttaaaaaaatactttccttctagttcctcaagccatttcttttctaaacggtgaacgcatagttgtcatgaactatattctaataactcttttgtttatgtagtgagaacaccaaatctgctctccagtcatcagcatatgtaaatttgcactgcaaggactatatcaagttcacaaaagatatttcttctcttagtcagcgagtactgctgtctggtccggcaggtacatactgtatgcattctgtaggcttggtgttattgtattgtataatgctactatttttttccaatgattaatttaattttactatgtgtaaagtgtggtaacatatgtttttacaggaaccgatatctaccaacaatatctggttaaggcacttgcaaaacactttggtgctaggttgctcaccatagactcttccatgctatttggtgtaagcttcttagcaattataccttttttttcatttatgttagccaagaattttttttatgaactttttatctgtattcttattggaattattgttgttatttctttttgttgtacctgtgccattcaaccaatgttggtgttcttacttgctggcctttttgagcaaaaaaattgtaaacacttgttttggtatggtatgaatttaagtaataaagactctgagcattatttttcttatttcaggggaagactaccaaggaatcagattcatacaaaaagggtaaggacatacataatacattgttgccttgtactgagtttcaactcacaaccctagttatgttctttccaaagataggccatcgacattgttgtattgcaagtttatggctgagcgttagtagtaatgcgagtataatgaacttattattcttgtcaaactggtcaagcgagtgtgggtcatttgttgatcttcagatgttctttttttttcaggtgatagagtgcggtacattggttcgttacagtcaacaggtattatccttgatggagaaaggtatgataatttttttaatatttatttattctctatgtacttcataatatttgtagtcataagcttgtcttagctgcctgtttctttgtaaaacaacacaaaataaatgggttctcacttttgcatgatttatccttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44171 - DNA, 772 bp, Oryza sativa
tgcagccctataattgatattccaccaaattagctaataaactggcttgaataagagcagttggggaaatgcgggaaaaatataggcaaaatgcacatgtagataacggggacctatttgattcatctggtggaggtagctcacattgtaaattttccttgcaaattaaggccttgtttagttccaaatttttcttcaaattttcaatttttttcatcacatcaaaacttttctacacatataaacctccaacttttccgtcacttcgttccaatttcaaccaaacttttaatttttgacctgaaaacacactctaagaattcttgccgacaactatgtttgtcattgaatcgtgagctacacatgtatccagaactttgatattccataatccctaatagactacaataaataagagtggttaaagaaagcgtaaaacttataaccaatccacacactagagaaatgatctttaataccgattctaaactctttttaatctcggttatagtaaccgagacttaagatctaaagatgcatactaaataaaaaatatataggatgtgggattcgaacttaagatctcgcatctcaaccattatctgtgttaccatcttacctactccacacgtttaacttggataaaggtattttcattttgaactaactctagaggcatttttagtactggttggtaacaaccaacttgtattaaaaatatctttagtcccgattgatattatcaaccagtgctaaaaatatctttagtatc

SEQ ID NO: 44172 - DNA, 1272 bp, Oryza sativa
  unsure (1)..(1272): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatgcttcaatgttacaaaactagagacacactggcgcattgccttatccttttaatatataggatttttatgagcatctatgggcgccaatattcaagattatcacacccacaatcagactcttggcttctataaacatacatccaaattataaagcaccaaattgtgcaatttgcatcataaaattgatgcctattcattgttgggcacgacagcacccacacctccatccatgttatatgaagcgtcaatatcagagttctgaagttctgatttctccaagcccttatctggtccaagattctctagctgaaccccatgccttttcaatgcatctttgatcttataaatctgaaatagcaacaaaatatagcttgaaagagcttaaaggtaatctgttcacaaatgggcttagattaacggaactcacagttgaaattgtacagctgaagctacagatacggccttctgcacctctgtaaaagcggaacattggcaatacatgaacattgagcctgcggcacatctccttttgttcattggagttgaccataagaaactgcagttccggatgcatgccagccaattgacataccttttgggacattatgcaaaaaggtgttataactattcaaagtatgaaatgctcttttttcgttaatttatgtttgagaaaattgtttaataccatgcatgtgttcttttaccttagggtgtagggccttgcaagctccacaactaggggaaaagaagtgcaccacggtgagcttatcgctggccaacaggagctgcttgtcaaaatcgtcttgtgattcaatgtttttcatgttgcaggatttcatgttcttttcccaccatttagtcttcattggggtgtgaacagcctaacaccacgacaatatatctcattgacatctcttttgtgcttgagcatgtattgtcaatgcatatttgagttttgttatttgtgtatttcgaatgagaccaacaatttcatcttctgtgcagatttttcaaatacttttggctgtagagaatgttttaccaataaaattctataatgttaagcattactaaacatggttagcgaagc

SEQ ID NO: 44173 - DNA, 1236 bp, Oryza sativa
gtagaaaagttttaatatgatgaaaaagttagaagtttgaagaaataagaatgtgtaaaactttgcagttttggtttataaagtttcagcatgaaattctgaatgtgtgatgctaaccgcctaacttaaccatttgtgtggaatttttcagcgattgttcagcacttcatcagctccgacagttcaaagctctgaaccgatggagcgcagccagactccgcgatgacgccgccgtcgccgtcgatctcgccaggtgatctcgtatccttcgccggcaagtgctcgacgaagcgcaagctccgcctcctccacggggccctcttccgccgccgccacctcctcccgaccgccgacgccgtcgcggcactcgccaagctcctccgcttcgccgccgtctcccccgccggcgacctccgccatgccgccgcgttgctctccctccacctcccgttcctctcctcggcctcctcccacctcgccttattatacaacaccctcatgcgcggcctcgccgcgtcctcctcgcccgccgccgccatcgagctcttctccgcgatgcgccgcgcgggcgccgcccccgacgccttcaccttcacgttcgccctcaagtcttgctcgcgatgcgtgtctcagcggcggttgccttccgacctccacgcccaggcgatcaaacacggctgccttggcgcgggcagctctcacgtgcatgtccacaacgcgctgctccatggctactcgtctcgggctgctgttggggacgcacgcagggtgttcgacgaaatgcctgctcgggatgtgatctccttctcagggctgctgactcttcacctcaaggccaacgatttggatgccgcacgcgtggtgtttgatcagatgcctcaccgggatgttgtttcttggactgccatgatatccgcgtatgccagggcacgacgtccgcaggaggccttggcattgtttgatgcaatgccggtgcagccagatgaagtgaccatgctgagcgttgtgtcagcatgcactgcactcggggaccttgcaactggggagcgtgtgtgtcagtatgttgattccaatggcttcgggtggatggtgtcactccgtaatgcactcatggacatgtatgccaagtgtgggagcctcactgaagcacgtaatttgtttgatggcatgaccgtgaggagcttggcatcttggaatacatttatctcggcatatgcatcgcatggtgatgtggag

SEQ ID NO: 44174 - DNA, 1729 bp, Oryza sativa
agaggagaaggttacaagctgatgcagccattctgtaactgcatttgcctggttattttacctaggcagctctagcttgttcttgtaagatgtcaacagggagaagaatgacagacgatagaaaatttgagaagctattggacatatagtttagaaaataccatgttttaacgtctcctgaattactagaattaatcacgggtaagcagttagctgatcaactaatacatatatttaaacaatttagaggtggtgacctataaccttgtactggatcagcatgcacagtggagtcagttcaacagctataggtgggttggcgaataggagtatatatgaagtcatatcaccggccattccagctttatgcatatacatatatagtgcactgcttcgatcaaatgattggcaaggacaaatactcatattttgtaaatcaaatgcatgatatcctcatatctgtttgccttttaaaggctgtaagcctgtactgatatgcattatgcatagtccagagtacaaccaattaatatattaagcatcttggtggccgaaagatgattagaaggaactaataatgatttgaatcggttgatagataagcaactcttaacacgtaataaaaagatgcaaagtacccacgggaacacttggatttagtgactaacaactaagtaaagtctgccacaggttggtggtgtcttagaaaaaatatgtatttgattatgctattgcttgcggaactggagaaattaattgtcaataagtgtatttaataaagtatcacagttctttccatgagacaatttgacatgtaaaattctgagttgcaattcaattcttctacatactctgagatgcaggtactttcaaagcatcatttttttggaaataaaacttagcatcaagtatgaacttatgcgcaaaaactaattccgcagatatctgcattcttctgtgtaacattaactgattttagtggcctctgagtttctgactggaacttctgatgcagggaaggaggacgtttctgagctacttccagtgctgtattaaggcctgaagaaggactgtcaactactgctattggctgtactgttgtgtcacagtgcaaactactcagcttatttttagattaggcttcttgggctttgtcaagcctagcaagatgtgtaatatattcgtcgtgatgcttaatcttttggtcattcagagaacaaaactatttatgagtggcacagattgcttgcgaattgaggtgcaaagctgtaatatattgaaggataaatggcatcttgtgtttttgtacggttgcagaggcatgattgatttggatttgtttctgctatcacgaggaaagatataatgcctttttttggggcgaggaagaaagatgatataatgtttactcatcacgtttctttgtaacatctggagataacactgcaaaatctgtcatttatgtggttctttggttgatttttctttctttctttttgagtttggacaatttgacagaactgtctgacctaattattaggaagatagttcactacacattgttttcaggcttcagtgcctacaggaagataatttgctttacatcatcttcagctctctgtgagtttcttgtccaaagaaaatctgctcatatgttagtcacgggtacaatgattgtttgggaaacatcaaagcctgggctgtcgaatgcttcagggtaccgagctcg

SEQ ID NO: 44175 - DNA, 1086 bp, Oryza sativa
  unsure (1)..(1086): unsure at all n locations
agaacaaagactggcctgctagcaggtaactgaataactgacgcagtctcatttctcaacaataaactcctgaatctctattccagtgtgacgggcaccgccctgtttcctcaccaaaacctcatcaccaactttcagtgaagtcacaggtatagcagttcttccactagatcctacataaaacaatcatatggttccagaatgagttgattgaatatgtgtactaatcacatggtgattagcatcattcaaacataactgaaatttatggcttattatagttgcagctcaaaacttacagtcctatcttcaaaagtagtccatatgggcttacctttttcaggagtgataagtgcaactgtctcggcattttgcaggaaaatgctgtaagtatcatctccaccgttctcctgcagcaagcccatacgccatgaaaatgacaatccatgaatgtacagcaatcatttgaagggagatcattgttagttatgtacctttgcttctacaaggataagaggccttgattcaatcttaacacgaccaacaatcgcagtacgccacaaaccattttgatcaacaactattacttcccgacctgaatgcagctctgagaggtaactagtgcggccaccagggactgcaacatatgcatgacagggccctgaatggagaacacataaattttattagtctaagtttctcttgttgtacagtgatacttgcaatagcttgctgcaacataagttgttgatatcttaccgcattgaccctgaaaggcctgcttgcaatataatttgtctccaggcattcagagtgaacaagaaacattcttcttgcataggagccaacctgaaaatagaacatcatgtagagtcagactggtgaagcttgggacaggtaaaatgctaatgcggttctatttgggggcacaatgacacattcacgtggaacgattttaaccaactctgtactgcaggatatatgttaattatttatttatctacagtgaacaagtgagaaatatacacaaaccagaaggccttcannnnnnnnnnnnnnnnnnnnnnnnnnnnnnnnnnnnnnnnn

SEQ ID NO: 44176 - DNA, 1511 bp, Oryza sativa
ttttttttttttttcttaaaaaaaatgctgtctaatttttcacttgcaaccaataattagaaatctatgtctatttttcagtctttcaaaaacaagttttaatttttgaattactagaaaatcaacgtggctaaagcaaaggcacgctcgtgttatatccggacagattatttcaatgtttatgatgttagtttaattttgcaaatgtttatgatgttagtttaattttcatacattttaaaaatcatcaattatcttttcgtaggtattgcttcgagtctgtttgttgtgtttaattataatcaacaaaacaaataaaacgtctagtaaaataggtgatgttatttttaaggtgttttaggttttgtttgcaaatttatgtttgatgggtggaattcataccacaaaacctaccacccgtcccaaaatatcatttttgcctacttccgtttgtcttaaaataactttattttttaaaataattattgcattgtagtttgtgaaaaacaagagaacgcattgaaaagtatataaagtaaaaatatttgtattaagatttaataaagtggggtatcctagtatttttactttttatttgtatgtgtgtgataggttaaaatatacttattttgaaggagtatttccattacattacttggatcgctccttaattcaaacacttttagctgccatggattcttctagattaatacatagtcattcctataagagggctagcacctcagaacaggagagctgcaacgcagcaacactcaagcctatttttttcctattgtttttttttctttcacataattctaggatttattttgaaagtaaaggccgtcaagtggcccaatcagaactggtaaacactgccagcattagaatattagatatatgaaaactgaaattggaattatgcaaaaaaaaaagtgagagatatgtacatggagatttggacacggccgagttgttggcttgtgctggcattcggcttggagaattggaggcccagatggattccgtcggttggagaattggacacgatttcggagcagtagcgggctggtgcgtgagagctgcgagcctgtgacaacccactgcggaataagtccgctcgacgttcctcatctttttgtcgagtttttttaaatacaaaagtagacgctcacatcacgcgtactcatctatcctataattcaccaactcgtctatctatctatctattctataattcaccaactcgttttactcatgttttactcttacactcttacattcatcattcaacggttcagatcatccgcgtaaaatccgaacggttcagatcgatcccatatccacctccctcaatcagcgcacgacccgcacggcccaccccccttcctatcgctctcccaccacacctgcgtctccgccctccgccggaattccgctcccgcacctccgccatcagcgctccgctccgtatcagccgccgcgccgtcctctgcatcgcctgtctgcca

SEQ ID NO: 44177 - DNA, 738 bp, Oryza sativa
atatcgtttgaatggtagatctgagattttgtaaaaattaatatggtatattataataaatatttagacccttaaatgacctcaaataataaaatagtcaataataaagttgtagatctcatcgagctctacaatgttgaatataaaatttgtcttcatctgattccgtatgaaaaagttatgtatatatacgtgttttttctaaaatttgctcaatgtctgtggatatccgaaaaaaattccggataatttttgaccgtttttcgattccgatggataatacccttactatattcgttttcgtttccgagaaaaaaatatccaaattcgtttcagaatccaagaatttccggataattccgaccgaaactatctaaatccaaaaaatggtccggacggacgaaaactatccgaaccagtttcatccctagtagagataaatatagcatctttgatttctttaatgaaaacatccaagttatgattgaggataaggaaggtcaccaaatcgacagcagcaagccccggtgccacgtcctctcgttctttagatgatttctcctcgtaaaaatagtttatggcgatggcgatcggcagccatgctcctttgcctaaaacagcgatagcttcattgctggcttgctgcattgctcgccgaaagtcaggtgccactactctaaaatcccttctgaaatcaaccattatactctaatagaagattagatgatattctatttc

SEQ ID NO: 44178 - DNA, 784 bp, Oryza sativa
tgatcaagcagtgtccgcctcggcctcctcctcccaccttgcactcccccatatagaagactcacctcaccactccgctccaaaagaacaaactccgtttcgggattcccggccgcggcttgcactactcctcccggagatgacaggccaacgccaacgccgatgagctcatgcggaggagaggagaggagagcgcgagatttttggttggatttcttgaaatcttttcattcgcacaagcgaggcgatgggattggggatagttttaagaaggaaggaaggggggtgaaggtggtggggcccacgaaggagggtggagagccacaagatggatttgtggccgcaggggtgcggttttttgattctctccaccatctctccctctcaacccgccttacttggcaatcaaatccttcattgctgacatgcacacctacgatatgctcctccttttcttttcttttcttttcttccttttctttttgttctttctttatttcatttttcatttttggatctgtgagtaatgagaagcaagtgtattttttttttttgctgctgtgtaaaaaacgcttggctggtagtctttttggtcatcggagtgtttgtctagcatgatcagcgattcggttatgggaattccttttagtagatgataatatgtcgtgattgggctacagtgatacgactgaaactcagcttgtgccgcaagtttagggcatatttggagttcatactttaagatgatcattctttttttccgaggaccaatttggtttaacat

SEQ ID NO: 44179 - DNA, 835 bp, Oryza sativa
  unsure (1)..(835): unsure at all n locations
agtctcattccaaagtttggatataagcttcgccacagagtgaatcacactaatgggttgaaagtcattccccgaggcgggggagtcttcgtttatttttcctcaatgaactagctagtagcatgtatacatttgctagctagtactacctcttttcttagctttcttagatccctttagataagtttatacagatgaaatgaacctagttttttttttaaaaaagaactagcttacatccccttgagttggaggctccaaatgcagcagcaggattgacatggttctgggaattgttgacaaaagaatctgaaagctacattgatgatgatgactgccatgataatttacaaatcatttccaacctgatgatcaaatgatcagtagcgtatctcactcttcatcatagccactgctgccaggtgcaattatggtttacatgcatatgagatgagatgagaagaagtttggagcagcagcaagtatatgtaatagaaagccaagtacaatatatcccttgggaattattgactccaactattcgtgtagtcgaaatctttcctagacacatttattacagaactaggacatccattcatttacggttttggctcatgcagcatggttcaaagcttcaacacttccatcaatttttaggatatcaactactccagtttaatttactcagacaaacaagaaaaaggaccaaacaaactccagtacttaactctcttctggacagttaaacccccaccccccaaccaataaaataaaatatnnnnnnnnnnnnnnnnnnnnnnnnnnnnnnnnnnnnnnnnnnnnnnnnnnnnnnnnn

SEQ ID NO: 44180 - DNA, 919 bp, Oryza sativa
ctgcgcgtgtgcaggttcgagttgactttcggggttggttggttggttctttgcttcgtttgtcgctctgcggatttttttttccggattggtggtcgaggtcgatcgaaacctcgcaaagattggacctttgccgcttgcctgctcggttcttatctcgtttggctgagttttgtgctcatttggagcccctgttcctcttgattccttgcattattggccatcccttgtctcgagagagcttatctgccaaagattcttgggctagaaggtttcttggttcattgcacggttgagtagtagtgcccaagaggatttgcagcagaggcacaaagtttgatgggtggctgatagtttggtggattggatagagaggagaaggagcaagagggagggcaggagagatggggaattgcatggacaccacggcgcgggtggatcacagcatgaacaatggcgcctgtaagtttccttgatactctcttcgtcgaaattccaaatttgtcttgtatgtatttgtcactttcctatcatagctgtaaagctgatattggttgcttgggatgttgggttgtttgtcctactagatcgtggatttattgtgtgttgaattgggtttagtactttggtttgactatgttgaagataaaattttaagatcagagcatgtgttctgcaactagttatacctgttggcctagtttttttttttttttgcatgataattttttttagcctacttgatagttgctgcttttgtgcaacttcacttttgtttttggtcctcttttctacttctatagagtaaacaaacaatagcatggatgcatggataaaatcatgttttctctagtccttggaagcagaggtaatttttcgtgttgatcagactggaataacactatgaggtacatgtaac

SEQ ID NO: 44181 - DNA, 25986 bp, Oryza sativa
  unsure (1)..(25986): unsure at all n locations
nnnnnnnnnnnnnnnnnnnnnnnnnnnnnnnnnnnnnnnnnnnnnnnnnnnnnnnnacataccttttgggacattatgcaaaaaggtgttataactattcaaagtatgaaatgctcttttttcgttaatttatgtttgagaaaattgtttaataccatgcatgtgttcttttaccttagggtgtagggccttgcaagctccacaactaggggaaaagaagtgcaccacggtgagcttatcgctggccaacaggagctgcttgtcaaaatcgtcttgtgattcaatgtttttcatgttgcaggatttcatgttcttttcccaccatttagtcttcattggggtgtgaacagcctaacaccacgacaatatatctcattgacatctcttttgtgcttgagcatgtattgtcaatgcatatttgagttttgttatttgtgtatttcgaatgagaccaacaatttcatcttctgtgcagatttttcaaatacttttggctgtagagaatgttttaccaataaaattctataattttaagcattactaaacatggttagcgaagcaaccaaatctcttaatattaaatgcacttgataaaacagcgatcctgtttcaagaatagttgggctttgatttagtcattattaggccagaaaatggtacctggagcaaatacagtgtgtcagtgattagtgtcatagaacacaaaaaaagggttaccttggattgtgaatggattgtggtgccccttgatatttgaacaacaaaacaaacaaaacatattttattcttgagattaaatagcacttgcaaatttgcaatctaagttaaaatttagcctgttgattttgaaacctgcatattcctttctatttaacataacaaggaaacattctgatttacttgtagaaaaattcagatgaccttctacggaaatgcactgaatatatttttacaaagaaagcatcttagtttgcgcttgtcatagcaagaatggtttttctggaggtaaatgtttttgtttgtaatttaattagttccaaacaagtaatgttcaagattttatactttcatagcgtgtaagactttcttttacttcctccgtttcacaatgtaagtcattctagcatttcccacattcatgttgatgttaatgaatatagatagatatatatgtctaaattcattaacaataatatgaatgtgggaaatgctagaatgacttacattgtgaaacggaggaagtagtgtataaggacaaagtttcatatgcatgctcaattgcaatgtggtaagaaattacattggtggaattttctgttgcagctttggtgatctgccaaccagttgaagcatccttttctcggagcaagaggtgctttctgttgatccgattgtggttccgagctggcaccatgaaggaaccatcagaactattattcttggatccacgctgagatgaacgagaaatagcccaacagttcgtcagagcagaagccattgccatccttcaactgaaaaagaaaggatgaaacagatcagcactcctgaaatgatgtggaaaatgggaaattttaaaagcttacatgccacaacgtatccacacgaacttttcaagagctggaaatgtttgtgatggtgatatgggaatggtccatggtatggtatttatagctgaagaaaagtttgcttcagaagcaaaggatacctcatcctccctaaaacagagcccctttttgcttttttttttcagttcatgttcgtgagttcatcactctaagaagcaaagatgattatccaaaagaagatatggacagccacatttgttgttacctgccatcatatctggactagctaggtgctttatatactcagtttccagttctccagcaaaagctttggtgtttcttacactctgctgatttctatctaaggcggcacggcttgtgccatggactggatgaagccgatgtgtatctggataaaaagattgtcaacatgactcatctcttctgtagtgtgtcaatcctaatgcattgtgtgttctgtgagtcatgggcaaacttttgatctaaatcttaatctactttactcggatgtgtatccatgacatgactggatttcttgtaggagtgcctgatattgcagctatgtggtgtattcttcttggttgtgtatatctaactgttgatataaaggtcagatttttatccattatctaaaaaaatgtggtgtattttacttgtcctctacttgctcttcatctgcttgtgtgtatgctctatccagctattggaatttcagaatctgtcacgcgatgaacacggcctgtttggaacatcctgctcgatctgcgtgcgaatctatctgtgatttttacgttttagtacatactaatactgagttactgactgatcaaactaacatattaaaggggcagtaacacctgctagtcagaaaataatactctatccgttttatattatataaattgttttgactttttccttagtcaacttttttaagtttaaccaagtttatattaaaaatctagaacatcaaattagttttattaaaatgaacatttaatatattttaataatatgttgttttatgttagcaatgttgctatatttttctacaaacttgatcaaactttaaaaaattgactaggacaaaagtcaaaacgatttatagtataaaatggagggagtatttacagtatgctgcttgataattactgtattccttttgaagtaagaagatttaggtaggtgctaaaattgataatagaagaacttgcattgaacccataattccaaaatggatgaactaaaatacttttcttcaataaaaaaggagatccgctggacgaaatcaagaaaacaaagaatctaatgtgaaaattacaccataacatggtcaaaagaaaaaaaaaaggaaattacacccatagctacttaccagcatacttcttttttcccacagaaaccagggactggtttcccatcaaccttccaaggttgacattgctacagaggttacaactaggacatcttttgagtttttccacccttccacttatagatcttccacttacaccataagttgactacccctcgatggctcgaagggtataatgtatatatagtcgtgcaatgtcggtggcatctttgtgtccgacaccatgacctgatatttttcgcagagcttgtcgcttgttgggtcgacgtgtcgtttaagtcatggtatttgtcacgcaatgcatatccttttatgctcttgctctttttcggctacaaggattgtgttttcaaattaattaatgcaaaaatctagatataatataaatttttttgcaagggaaattactaaataaacaaaacagcacattcttaaaatcgttttatcccactgaagagttgtatttagatttagaagacttctttcttgagtgaatagtggagatactcctttgctatagattataattataggggaataattacaatagagggcatggggagtagagaaaacaaaaaaaaactgttaaactgtaaatggattctcgattgaggaatttaagatacacaattgtctccaatataaaaataaaccataatatttgggctgtgaatttattgtataatagaaaaatcaaggacacatggctaatggttgctaagaaaaaaaattgcaaatattctataggttctcagagagaaaagggaaatcattcaatttgattgactccaattacaaagaatttcttttagtgtcttagaaacatatttaatgatatgcagtttggaaaaaaaatagaaaataaataccgggcactatgtttaattaaaaggtaaaaaaaaatttactacttggggtgtggatttacattgtattcctgcacataagaagtttcaaattcaacagatacaattttaatattgaactctgtccactatacagcaatgcagtacaccgtgcatctgataaaaacagtgatatgctttattattcatggttctctttcttctggggagaactggaagatccaccttttggcaaaacaattcacagctttcataatacaattggctgctacagagcaatggcaactgagcgtaagtgcgtaacactttaacaaaattaataaagctcaaaacaattaatattctgcaggcatattgcacaggccagtattggcttcagaatacacagaaattgtaacaaagcaaactgcttttgttcttacccaagaataaccattatattctgtaaaataatatgggtaatttggccatttctttgcaaaggcaaacatgcaatttcgcacagttcagatccttgtccacaatttgttttgatcattgcaatcccttcttgcagaaccatcaacttatgcttatttacaaccatacaggcatcgatgacagcatcactcttttgtcgctcatgtagcttttttcacttgcacaaacacagtgccatactcccattgtacaaatgatgtgcaaactgatgtttggatggattgaagatgtttcacatatttatagccacgatccacgactcattaccttgtttatataattgagttcaggaaagggttgcatctgtactaaaaaggatatcagaagataacacaatggaggatatgtataaccacaagccatggctgcacatcttgttgttacaaattgttcacctttatgtagcttatgcagcttgggctgatgtttatctgcttgactagaaatccaaacaatagcctgtgatgcaacctctctgagtctgacaagattagacccatttcattaatatatcatcataagtactagaattcactattcaggatagcttgttgttcttcgcgcacatacatctgcatcattttctttcccatttcccatatgtgatattcagtttctgatccagaacagagcttcacaactgatatcctcaaccaatgaatccttttctttcagaatgtgatctcgactgtccaaaagactgaattatatccttcacactgccatctacaaacgtttgacctgcttctttgttgacaccactgtcatccattaactttctcattttctctgacccaaaccattctccaacagatgcatagatgtttgagaggagaacataatcaccgctttcatcattccttgcctttagcagttgcctatttgcatgtttagccagttcgatctcaccatgaaccctacaagccgaaagtagtgttctccaaatgacagaattaggctcacatttcatcgtatcaatgaactcaaatgcttcttttagtagcccagcacgacccagcatgtccaccatgcaaccgtagtgcttgatattgggttcaaccctgtacttatgctgcatcaagttgaagaattcacgtcccttgtcaaccatcccgccgtggctgcaggcgataaggacagcaacaaaggtgatctcatctggcctgaccttccccttcagcatcttctcaaacatatctatggattccaggacatgcccatgcagtgccagtcctcctacaattgagttccaagttgagacgtccttgtctcgcattgaccagaacacctcatgtgcacttttcatgctcccacattttgcatacatgtcaatcagtgcatttcctagaacaactggaaacccatttcttgaaaacatatctgaaagagaggaatgcagcctctggccaacgtccagatcaccagagtcagcacaagctgacagcaagctgagcattgtgacaatatctggcttttcacccatgcgctgcatctgctcaaacaactccagtgcatgcaaatgcgagccacatctcacatacccagaaatcatcacgttccaggacacgacatctcgctcgggtacctggtcgaatagctcccttgccaatgccatatctccccgcttcgcatacgcggtgatcatcacattccaggacacgaggtccttcacaggacattcgtcgaacaggtcccgtgcagcaccaatgtcccctcgccttgcacaccccgtgatcatcgccgaccaagccacggcatcctcacgagctctgccatcgaacagagcagccgcaatgcccaaattcccgcagctcgcgtgcatgccaatgagcgcgttcttgacgaacgcgtcggactcgcagccagccttcacaacgtgggcgtgcacctgaaccccggtgtcccccgcgcccatggcggtgcaagcgcggagcacgaacgggaacgtgagcttgtcgggcctcacgccgccgccgccgccgcgccgcagcatgcgcgtgtacagggagacagcgtcccggggcgcggccgtgtgggcggcgccgcggatgagggtgttgtacatgaagcggtccgggcggggtatttggtcgaacacgaggtaggcgtgcgcgatggcgccgcggaccgcgacggcggaggcgaaaaggagctcgcggagctcggagggatcggagaggaagccccggagcgccatcaccgcgtgcatctgcttgatgtgtcgcaggctccggcaccgccgccacgccggcggctgccgccgctgcgtccccgacttccgcaacatctcagagtctcagtccactagccttgtccacgtcgccaatgtttaaatccagtcccattttaaacgcatactaattgaacagttctccatattttttctcaaacattcatgtaaagttttgcaaacatggtgtcatggtacattcaaattcaaaccagattacaggtttaaaaatgtgcaaacatggtgatacggccttgtccacgtcgccaatgtttaaatccagtcccaccatttgtagcgtagaatggaacagctttcgataaaatttctcaaccatttagatgaaattcgcaccgtttcaagcagggtctaggaccaacaaatcctagaatcaaacatggtacattcaaatttcaaattcaaaccagattacataggcttatttactactccggtaagcgatacgggcggcggcggcgcggctgccggcgagcggcggcgggggtcagacggaggtggagacgcggaccttgaggccgtgagccatggagaggatggtcatcatccggtacttgacggggtggtcctcgacgaggtcgaaggtgtagaagcggaagaggatggcgagcgccatcttcatctggaggtaggcggagtccttgccgaggcagatccgcggcccggcctggaacgcggtgaacttgaacggcgacgcgttccggaacgcgccgccgtcgccgctgagccaccgctccggccggaagctcgccgcgtcggggccccagttgtactccatcctccccatggagtagggcacgtacgtcaccatcccgccggcgcgcaccttggtgccgtcggggagcacgtcgtcctccacgatccccttggggtcctgcggcaccgccgggtagaggcggagcgtctccgtcacgcacgcgtgcaggtacaccagcttccccaccgcgtcgtagctcagcagcgacgcgaactgcgccacgcgcgccgcgaacgacgcctcgccggcggcgtcggcgagcgcgacgccctcctcgcgcgcgcgctcatcctcgaacgcggccagctcgcgccggagcttgtcggcgacggccgggtgcgtcatcgccatgtacgtgaaccacgacagcgtcgtcgccgtcgtgtcacgcccggcgatcacgaagttgagcaccacgtcgcggaggctcttgtcgtccccgaagctgccgcccccctcgtcgccgccggcctccccgagctcgatgaaccgcgacagtatgtcgtgcttgatctgctcgccattacaaatcaacgatatcaagaaacaaaaccttttccgatctgatcatcaccattaccatgtcagttcagttctactgattctttgagcaagagaggaaggatcaccttctcttgcttgccgctggctcgagcctgcaagatctcagccttgcggcggcggatcacgctgtaggtgaagtcatcaaccagcttcatgctctgctcgaggagagcctctgatccgacgtgcaagaacttcttcagacgccacagaggatcgatgaaccgcagcgtgacgatgatgttggcagcgtcgaatgcctgggcaaagctgttctccgggagatcaggtgacagcgtcccgatctcaaccccaaacccgaccttgcagatcgagtccagtgtcatcctcatgaacaattcctgaattttggttagttcttgcatcagaattctgaacaatttggtttctcaagaaatgtttaggtattaggcaaggaattcagttggttacctgcatgtctacaactctgccggccttgcatgcttggctcagaatgcttgatagcttcagggagtactccctgaacaccacagtgctgaagtctctcaagttcttggaggcaaactcgaagctcgccgtcttcctttgcttcctccacatctcgccgtcggcattgaatatgccatcaccgagcagcacatccatgtaagacctgtacacttcaccctgcatattttcagacattttttgtgtcagtgttagtactgtgcaaggcacattttacagtacactgaagatcctatggttcttttaccttggggtaattggtgaagttggtcttcaggacatgctcgacgttcaccgggtcggcaatgtaggtgtaggaggtgaaaggcatgtcgacggtcaccgtcctgtccttcgacaagtactcgacaagccagtcatgcatcctgtggtagttcttcagttgctccactgtcgcgccgatgattggccatgatcttggccctttctggttcctcaggctccacttgtggaccaagatccatgagaggacaacaaggaagatagctatgagcttgtggattcctgctactgggaagaatgatgtcactggcattgcatgagcttcctccatggggctcttcatgaagggttcagtctacaagagatgctatgtagcattttggatggcatagttaggtgatatattgggcactgatgctaccaaccttgagacaatctttgtgtgaccaagaattaagattgtctcattcatatggtgtccctaacctaacacccttaggagttggatcttagctttagttttctttttgtgatctgtccacctagaaaagaatcgttactcatgtaaacacaaaatgaatgctacagtatttttttcccctgctcagccaagttcgttgttttgttcagataactgaagcgtttgcagcgactaaaggtatgccaccttctaatatcagaaccatatccatctgaattctgttaaattgtcaccaactgaaaccaggcttaccattttctgtcgatattgtctagtctttgatgacaactaaaatgaaatggggtatcctcaaaagaaatataaattgtgaacccaaagtagttggtttctacttcacctgaattctacttcatctgaataggctattttaatgaagagaaaatccaagaaatgccatttacaaacacccaaatccaagaaatgctatcgacgagtacgagttccataaaatgctattgtagaagcgattttgtcccagaaatcagttgccatctagttaaaacattctcacataaacaagcaatataaaatactattgccaagatatatccaatactttgcatctctaaagcttctagttattgacaactaatttcttttccagtcaatacaaataagccatctatcaaagatttgagaaattgcagggcacaattctacagaaaattaaagaacatcacttgaaaaggaagattttttctatagaacttatcctttgtgatgtaacaacaaatactcgaatgaattgagaaataaccaatgtcaacactgaaacaagtctgaaaccaagatcagaagagcatgaaaatagtgctcttatggattgaccttgattcttgcccacactcttattacaaccttcgagcaaaccggagcatttgctgaataaatctctcatctgttactgaagatactaggtaactaaataaacaatcaatcaagagtatcaaaacctacaggcttttgttactgtcagcatccaatgtaagtctgaagagagctctcattgcctgcctcttcactaccctgccataggtagccctcccaatcctcaccaccttgtcttccacctcgagccgattgccgcagccgttgccattgtcggcacccctcagcattgccctcagcacgctctcgttcccgccgattgcgccggcgacgctctctgcgacggcggcctcaccggggacgcgcctcccccacttcctcaccagcttgtcggagtcgaacagcgcggagtacgcgctccagaacgacgcgcgcaagaacgccttcctcctctccttcaccatggactttctcatcctctactccagcctcaccaccagtgctcccatgtctcctcctcggccattgaccaattcgttctcaagttttgtgagttcttgcccaacaatggcgtcgctggcttcgaacctgcaccgatcgcattggcattcgaggccccacgctctcgctgcctccctgcgcttgctcgccggggtgagcacgtcgaagtaggcgaatgtgatctcctccccggctttgatgtcccttgacgcgtggacaatggcgtggtcgccgacgtgggtgcgccgggcgttggggtggcacgagtggttgatgaacgccggcaagatccacagcccgacgccgcagttgacgacgccattgctgccgagcagattggcggatggcgctgcgtcctcggtcaagcaattgacgtcgagcactttcaagatcttgtccacatcaagagatgccttcggcgccatggccgtgccgtcatcgagctcctccgtttcttgcttgaaatgtgccatgtccgggatggggagctcgtcttctggctcctcgccggtggagagagtgtagatgagagatgccgtcctcgggcacttctcggcggcgtcgagcaccttgtcgacgaggtccttccacaccaccatcttctcgccgctatcggcggcgtccggaattactccccttccgatcgccaccgccttggagatcaccaggttagctcccgcctcgatgttcttcaccgcgaacacccctcggccgccgtgcgcggaccggcgcacctccaccgccccgacgtgctccgcgaggtctgggcacttcccggagaacccggcgagcacccactccgacagatccaccgcgccgctcctcgcctgcgcgtccaggcgcttacactgctcgaccatctcccggacctcgtcggtgccgctcacggcgagcgccgcgcggaagcactcggcggcgcgcgagtaccggccgaggccgcgcaggacggcgcccttggacagcaacgccccggggtgcgccgggtcggccgccagcgcggcgtcgcagtcggcgagcgcgccgggggcgtcgccgaggcgggcgcgggcgtcggcgcggtgggcgagggtggagcagaggacgcggcggtctttgcaggcggcggcggcgtcgaacgcctcgatgatgagggagcacacggcgatgtactccgtccagttctccttgagcagcagctgcgtcgcgcggctgcgcagctgctgcagcgagtcgtcgtcgaggccgggcgtcgccatggctgggcggcggcgtgagatttggctggggagtggtggtggtgcgccgcggggcggcaatgtcggaggtgtttgtttggctcggtttcgaaagctcgcggctttacagcgtaacggtcggatctgatttctgaatagtttttcgaacgaaacaattctgaattttttaaactcactggagtgaatgcagtagcaacggctatgagctgtcacacactcacagtagtactccgtaatatagacgtcataatggtcatcttgtaaaaaacaaatactccgtatgtaggttatattggagtgaaaaaatatgtattggtcatcttgtacaatgcaatggacttgtgctcggtagagaagaagtgatgaatgaaataaatctagggcttgagaccgggtgactctctctctctcgaaccctccctcgcctgctacagtaaaattcccctttctcgacccctcttcctcctcgattccggcggccttgtcgccggtgacgggagggagaggggtcgtccccctcccctagtttagtatagtagtcgggctagtctcgttaggtcgggtttttcccgtttctcgtttctatggcgatggaagtggaagacggtggcggtggcgcgattgaggccggtgacggtggaggcgacaaggttggcgacggcggcggcgcggatccggttcgcggcggcggcggcggcgcggatccagtctgcggcgacggcggtggcgcggaccagctccgcggcaacggcggcggctcgaacgcggcccgtggtgacggcggcgcggatccagtccgcggcagcgccggcggttcggacgctgcccgtggcgacggcggcggcgcggatccagtccgcgccagcgccagccggctcgacgcttgcccgtggcgacggcggcggcgcggatccagtccgcggcagcgccggcggctcgtacgctgcccgtggcgacggcggtggcgcggatcctgtccgcggcggcgccggcggctcggacgctgcctgtggcgtctgcggcggcgcggatccagtccgcagcggcggcagcggctcggtcgcggcccgtggtgacggcggcgtcgccgatccagtctgtagcggcggcgatggtgcggacgtggcctgcggcgacagtggcggcgcgagggctgtctcccacgtcgttgcttccagttgtgtcgttgtttcatggtgcaggccatctctttctcagccatctccatcatctcagcaggacagaagctgatttgcagccattcaagtgcttcttccttgaaggttggctgttcttcggattcatctatcctgttgttccctaacagaagaaaccatgttgggtttgtcattcgggttgagctcggaccacctgatgagccccgtggggatcctttgctgagtccggtgacgcacacaccaaaatctacggctcagcatcaaacctcggtcttgtgccgtttccgtggaggcagccgatggggattaacggtttgtcaagcggactgcacatcttttgaggcccagggtagcagtcgtcgcggcttcgccgcagatccctgtcgacttgctcctttttctgttctgatgttaggttatttcaggaaggttgctttcgtagttcagttaactctcctttcttaaggatggctcttttgcttggatatgtaatggggtttattccctagatctgttcctgcttaataaagttgatgtgttttcaaaaaaaaaaaaataataaatctagggactattgcggtttgcttgggaatggcaaagtatgaatatataaacttattactataaaatcaaaagaaaatgatttataagattttatacaaccttacatacaagtagtagtaaccaggaagaaaaataggagaacatcaaggggtaatatttttcaatacagtcattttgccttcacagttcatgtaatattccccctggcctttgattttccatttaccattgatgagtaatggtaataaaaacgcatagaccagactgcattttgccaaatcttactttgaatttgcaggaacctaggcactcacagttcagagagtttctgagctttggctttgtgttaatgaattgctgtttttcctatatttgaaaagggagctgctatataccggtatcccgttgggatactgtcccaacgggatcgctccctgtccacctccctcagacgctagagaacgaaggtcactatgggagcagcgtagatgaggttgacgtcggcggcgcggacgcggctgccggcgacgagctctagcgtggaggacgcggccaccggcgagctccggcatggagctggtcgcatggacggcggaggatcctgcgtggtgacagagacggcgccggcgacgagctccggcgtggggcgtggacggcggaggatcctgcgtggtgatggcggtggcaccggcgacgagcttcggcgtggaggacgcagccaccggctgaggcgtggacgatggacgtggtcgccggtgtcgaggtcccggcggaggacgcggtcgccggcgacgagctctgatgtggaccatggacgggggaggatgcggctgccggcaacgaggttcgggttcagtgtggagcgtggacgggggaggacgcggccgtcggcgacgatacctcgacgcccaactcctgtatctagtaggtatcatatgatacctcgcaagtatcaccccgatacatcgtagaaatcacgcgatacctgataggtatcacatgatacctcgcgagtatcgcctgatacatgataggaatcgtctgatacctgatacgcggtagaatcacatgatacctggtaggtatcactcgataccggctaggtatcaggacctgatacctcgcaagtatcacgctctacgtggtaagaatcgcatgatacttgataggtatcatctgatatctcgcaagtaatcacctgatacgtggtaagaatcgcatgatacctgataggtatcatctgatacctcataagtatgatacgtggtaggaatcgcctgatacttgatggttatacctgatgcatgttaggatacttgcgaggtatcaggtatctataaggtattaggcgattcctatcacgtattatgtgatacttgtaaggtatcaggtgatacctgtaaggtatcatacgattcttaccacatataggtaatacttacgaggtatcaagtgatacctgtgaggtatcaagtgatacttgagtatggtcatgttatccctaggaggtatcatgtcccccttagtatcatgttcagtctcaccaggtttcataagtgatactttggaaggatcatgtgatacctgggaggtatcatgatcctcatttgtatcatgtctgctatcatcaggtttcacagatgataccctaggaggatctgcacgaccctacttaggtatcatgtctggtaacacaatcgtatgaatttcatagatgatactttagtaggatcgtatgatacctgtgaagtatcacatgatcctacccaggtatcatgatacatgatcctcaaaagtatcattatgtgtgatacttgtgaagtatcacatgatcctatctagtatcatgtctagtacagtggtttcatgcaagtttcacagatgatacttgagtaggatcatgtgaaacctgggaggtataaggaggtaggatcaattggagtataaggagtacatcatcctcctgaggccgcggccggacgccgccaccgtcggcatggacgatgacgacacgtagcagagatagtacttacccttcctccccggcaacaccatcgccgacggcaagccgtggctggtctgctcgtacaatcacgccgttgacggcttcaccgctgtcgccgtgtcaaagaagcccagctccgacgctgcttccaggacggcatcgcttgcttgtattgctggtttaagcaggaaggaggatgtcaaccttgcggatccggccatggcgatgacgcgctgcgcgcagcggcgagagcacccgaggcggagctgctgcggatgcgccggggtagcggcgacggcgacgcgccgcctgcgcggtggaggtcagcgaggtaggaggacgcgagggacgacgtcgccgccattctctctccaagccaatcccttcgtctcgcgctgcagcggtggatgacgcggtggacgaaaggggatcctgtcccgttccgatgggatcccgttgtttagcattcctttccgtattgaggttcgaagacgtatagttgcactctccgctttcaggttccagtctcgcgccatcctatccacccgattaaaactggacggtcagatcagcaagtccttccgctctctagccttgcactcccgccctaacccttcttccccgtaaccccacgggaaggcgatccatggcggcggcggcgggttggctccggcgagcggcagcggcggcggcggcgcctcgcctgccttcaggccttcctatactacctactccccctccagcccctctcacagaggcccaatcgttcgtgctcccgggcataggcaccgccgtcgccggcggcatggacctcatggccgttcccaagaaaaaggtatcctagcttctccccccactgtatctcgtggtttttggtttgttaccttcatagtcatggtctggtcgtgggtcgatggtgcggtatggcgcaccactgcaccgtgcccggtggagtgcactctaggtgttcgtcggattgcctggagagtagaaaggtattatgacctatggaataatggaaatgtcctaacggtggaacacggggtgatagtgcacacagaagattgcctctttttttctcgatccattgcttggtaggttagtgatagatgttttgtgttttgagcccattccatttggagcataatgtcagcgaggtgtggtcttaggggtatgcttgtttaagctatctttgcaactatggcaaacaatatagttctcatgaaattcagttccacttataactgtgacgaaggctgagtttgttctttcaatgtctaaaaagctctttaattgtagagtgtatactgaaagatgttgccaagactagtggtaagttttcacttttgtttgtaattagcaatgcacaagttgtttgttatgtgagtggatttggcagatgagtcaatacatgtgtaactcatcatgatgatatgcaaatgtgataactcaggaaaaatcagaaaacaaagataaccgagcaagtagtcagaaaatgtctggttaaaggcataaatttcttgtcacatttgatatttgagcatttgcagttatctatatgtaaatagtgatagtcttgcggtgagatcaactaattctaactactagcatagttacttttgaatatgtactttttatgtgctctgttgaagcatgtgcttcatctcattgcctcagcagcttcagctgctttttgagatttgagaattattatttgtttgtttcatgttccatgattgttgcttcttgaatgttgcaggtctcaaaatacaagaagggtttgaggaatggaccgaaagcattgaagccggttccagtgattgtccgttgcaggtaaatttgaagctgaaaacaacatgcttgttagttattctgatttgttctgctatgtctaaagacaacttagtattagtaaatatcatttttttatgtaacagcatactttattctgattgtttcactactcatgtggacaattattagactgttcagattgttgtctagcgataccctcactctttacaatctagaatgcaatagtatcaatagccaccaacttaggttttagtggagcccaaagtgcagacacagaaaacatgctatgtgatctagcatcacaaatgctgtagaacaacattttggcgtgcatcagttcttcccagatgattcagaaattgcgcgactcatttcagtttccggatttgtcatcctttgctcattgttgttttttgttccatgaaatttatttacataattgttctggagtacctttccattgtgctgacgctgaaaattgttcatcttgaatggcatgttgcaaagtttatataacctggtatcctttttgtgcctgtcaggtgctgtggccgagtgaagctgccccacttctactgctgtagcggagaaaaagggaaccccggcgactcaagctcataaacctgttctgtttctccccaagttcagtctgcactcagcacatcaagcaatgtctgaacactattccaccatgaacgttttcagatctcattttgtgttcggccgctgttctgttttcaagctttttaatcagtgtacacactttaaacccagcttggatttcaaaactccccttgtcaaaaactcaaatgccactcgtgacatgaatggatgcattctgtctgagacaagaaccaaatgtgtgcatgtgccttgctagaagaaagaaataaagggcctcatcttttttttgcttatgcttatgtttatcagctaaaatttaaattttcaaccttaaatttggagttgattttggggttttttaatcaaagtttatttttcagcccttgtttttagatagctaagaacacgtatataaaacaattaaagttgtattcacgaattatttttcgtttgccaatatgccgtttcgcttattccctggtagagccgaaaagtgtaacaatccagcagcacggacaggggcgaagctagcatcaaaataagaggggtgcactaccattgagaatctagaaaatttcagcacataactgcacattctagtatttttaagtccgaaattaggaatctggcacatagtatagtttcgccactgccgcacggaaggtgggcgaggaagactggaagagagatgccagttcgagatgcggatgctctttcattttcgtgccgtttccggtgcggtgcaggtgcaaaaatgctgcaaccacacgcgcgcagtggtggtgcgggtttggtagaggacgaaaccgcggtcgttggcttggccttggctggctcgcctcagagccgccaccaactaaccaaccaaaaactcctccccaacccaaaaacgcgacgaaattcgctggcccccacgctgcgatttatgtggaccggctgcggcttgggtgcagcagcgagcagataacgaggcgaagcggagccagatttccctctcctctcctctcctcctacgcgacgcctcctagccgccaccgcttcaccaaatcaaaagctctcgctgctcctcgagagggagttggtggagagagaaagagagagagagagatggcgtcgccgtcgtcgtcgtcgtcgctgtgctcgaccttcgcctcgccgcgcgccgcctccctcggccgccgcctcgctttctcctcgcccaggtagttacccccaccgttcgcttccgagattgcgcccccttcttcgctggtatgcgccgcggccgacccgatctttgcgagctctcgcgctgtgcgtattacgtccacatggttaggggtggttgggcttcggggtacctcccggattggacaaaactccattcctgaacgccggatagcatgtcagagtcaaaccttctgggactggatgggttcatgagctttgagctgccggcgcaggttgaacgagctagtattgatgctatttctcccaactgctctcaagctgcaccagttgacttgaggagttcatcaggacggcatttcttagaacctttactgttgctatgatgctatctgttatttgtgttttgtaagtgatgtatgtattgcctagtcatgataaaacatgacaacaaaaggtacaaatgctggttaaacttaaaatcacatgttgaggacttcactgctttcttaccttggttaagtgctgtgatcttaaggttctcattctgtttttcccttgatgctttgcaggaaagcattccgagtgagggcatcatccagggttgacaagttctcgaagaatgacatcatcgtgtccccttccattctttctgcaaacttttccaagcttggcgagcaggtctgtcaagattctaccctccatcaaaccaccatgacatggaaatatatgtaggaggatcatttaggctactatatattggaataatagatcgatatcatgagacaaagaataggttgataatatattgtgtgaataatattactaggtaaaagctgtggaggtggcaggatgtgactggattcatgttgatgtcatggatggacgttttgtgccaaatatcacaatcggacctttggttgttgatgctctgcggccagtcactgatcttccgttggatgtgcatctggtacttcttgagaagccttactgaaattttaggtatttatgtgctgtaatttttctttcacccttgctaatttggcgtttgttatcttatttattgcagatgattgtggaacctgagcaacgagttccagattttatcaaggcaggtgctgatattgttagcgttcactgtgagcaatcgtcaaccatccatctacaccgaacagtcaatcaggtaaagattggcatcttttactagttaatatttgagatagctcatcctcgctctttcagtcattcatgaattagcataccactgtagaagtgtggattcctctccaaattgaatcagtattttgttttatgagttttactggtatgtgaccgggaggaaactggactttcactagtctcctgtcaaaggatcatactgtaatatacttgtatactgtactttaggactacttaccaaattgtttcttggatcctttatatactagataatggttatcgtttgctccttgagctaaccatttccttgacatggtgatcgggactgcaataagttgatttcttacctgtctaattctagttgaacttgagatatactccatattcatttttggcagtaattgcgtttttattctaaggataaaaatctaaaagtgacatagtggtctcacattttttcagatcaaaagtcttggagcaaaggctggagttgttttgaatcctgcaacccctctcactgcgatagattatgtacttgatggtaagactattctcactccaatatttatagggtgttgacacgtgtgtaaatctattgatggattgatgtccaaattctacttggtagtcgtatgaattttgttattattttcaatgtatcaatcctaatattagttgttaagtgtgatgggttgatgttgaaggagcacacatgacatgtttagattatgtttgtaattttgtgaattagacaagtcactcctgttatttagttacctattgcagtttttataagcatagccataatgcaattttagttaagagtcaaaactgtgctatttctggtgaaaatttgatgagtattgactgcattccaatcttgactttcttgactatcctgcctgtagtcacttcgtttccttggattaagcataattattaacagcactcacagtagaaatttacatgtctttctcatcgtacgacactattatttctttagttcatcaatagcccaacaggcatatactccgacaactgacaagctactacatttgtctgcgcagttgttgatctagtattgattatgtcggtgaatcctgggtttggtgggcagagctttattgaaagccaagtgaagaagattgcagagttgagaagattatgtgcagagaaggtatatcctcatttcctgcatgtattctcactgagccagtgctctaagcgtgcatttcattcttttaatagggagtaaacccttggattgaggttgatggtggagttggtcccaaaaacgcctacaaggtcacctgatttctagctttctgttactgttatttttttcactactgaataccaataacagttttggactagaattatggttcagttgggtgttaatttattgtttctttgaataacaggtcattgaagctggggccaacgccattgttgctggttcagccgttttcggggctccagactatgcagaaggcatggcttcttttcagtgacatacacattcaatcatcaaacactaagttcttaaacatgaatttctgacatagtttactaacagatagtaatatgcttatgtttttcctcttgcaattttgcagctatcaagggaatcaagaccagccaaaaacctgtggctgtaccagcatgaggatcctaaagtagtatgctgtgtacgttgtttttgtttaccagtaccgcggtttgtacagatatgtgccaagctgtacgttatattggagaaattgaaggaagaagaaaacgtggagggcgaccgtttttctcactgtccgcgaagatatactacatattctcagtgtcatgtgatactaccgtgctcacgaaattgttcataataaatatcgttctttagcaaatcctataatgatttacacttctagcatttgaaatttatccacaaatatatgcatttttagagtactactttttgccccagtaacaaacatatgctccgcactggagtattgggtaatgtgacagttgaaaatatagtactaccaaaatggtcagggggcaaaaaaaaaaaatcaacacttgcgaatttttttttcatagaaaagcatgtattttgctttggctatcatcatgaattaattgattgtcatgaacacgaacagtaaacaaccagcccaatttacatgctttagaagggcattcatattctgcattcggcaagtgaaaaatgaatcaatcaatcgcaaagcgaaaaggctgacctatacaacaggagatcaggaaaaccggttaaacgatcaagatggactctgcctgctgtgctgctggcttcagtccactgcacgtcgccataataacttggctcggtgaggttacaacttgacttgacgctcaccttacactgattgcatccttggttcggctgcaaaatcttgaattggccaggcattcgtgtgggttagcataaaagtaatcctcttcttttggcttattttcaagtttctgccgacaggacggttgaactacacgatttctatgagtttcctggacagaagatgcaaaattgttccaagagattgtcttattgttgtacagatctataaatccaaccaatttctgtcggtctagtagcacacttctcctgaaacccaggaacctgaaatattgaaatgccaataaaaaactaatgaccacaacatatatctgattgcacgccaacttttggctacatgatcaaatcatactgaactgaacaagaagcttgattttcataaagaggaaatctggctgtgtccatacctccggtgaccttcaacaagttttgccatgttaccatcataagtaggaatgaaaatatcactggctgtggatacaatgaagtcaagtgcagccatctgagaagaatggttctggaattgtcgtagagcttccaagtctagcagcgtctcctttcttacctgaaagatattcaacactgtttatatagcgaagtgagtgaacatttaggcaatgaagtggtatcccaaaacatgtgaaacagtgttggcagacagatagggaaaaaaacacatgcattgaaatttatgaaaactgtactacaattattaccagttaccataacacatggaaaaggcaaaaaaaattggcagcattttgactacaatattgcacttacaagttttggaaatgcagcttgtaatggttctaatcttttttctcccccataaatttcaccggcagcaatgtatatgagagtgtccttctgaaatcccagagctttcagaataaaagatgtctcctcaggtgtaagtgggcatagcccttgcaatctcttagcttgtgaatcaatttccttttctctccaccatggataagcatatctgtttgagagaaaaagttggcctcagttgcttgtggcttgttgtacttttcttacacagaaaacattgagacacttatcttagagacatagacgtgcaattgtgtgtccatactcagcactcaagaataagatagcaattgactaatttgacaatattaagaataaatgagtatttttcctttttcatttcattgaaatgaatccaccataaaaaggagagaaaaactaggtatgaaaatgacgatttaatagactcagagtgatgttttataaactcaaataatcaccaaaaaggtaatacgagaatgttacatagaattgtagaagactgttacacatagtatctatgacatgaacaatcatttctagacgagttaagggggtatagataacatcattaaactattacccctttcattttaaatagatgttgttttgaattgtgtgtagtcaatgacattagtaggtacataggcgaaggaaaaaaggtccaaatcgtcatagctctaatatttttagtgaatatatgactagaaaaagtaatggtcaaaggtgcatattcgaaccatgcaaatgtcctataaacgacataagaaaaaatacaaaaccatggagagtgagagagtgtgtgttttggttgaatagggggatggtgtttgcctcctactacaacaaacgacataagaaaaaacggagggagcaatggagtgtggtatttcctcttatatgcaaggaactacttgggtcaatatctgaaaggctacattttggtatttattaatatatatataagagcacaagatggcttttgacctcattcttttgagctcttcagcttcttcttgagaaagaccatgattgcaaccagaaaaggccagcatgtccatctcatagcgtaaatgcaaggctgcaaatgatcccttggcctgaagtttctgcaccagtttattccccaaggcctcaatttgaggggtgaacttcagtgcatgaaaattaacacggcacctaagtagttgaagctgtgtactgataccattgtttgctaaccgagcatccgtcttgttaaaatggatgacgctatatttgctgaataatggtaagatctgcatagataagataccatgaagagtatataatatatagtaagcatgtgtcaagcaagatatatgtacaaacctgatgcaagtaatatttttcatcagaccagctcacaggtggcatattaagtatattgtttgaatcctctggaccaaacctcttcggaagctgtttaacaatgtgcacttcatctcttaatgtgtcaatgaaatgtttaacatcaaatatatcttcaaaattgctgcaaagtattgcaaaaatatcgcacatttcagatattaacatggtaggtccggtacataacctatcctacaaaatgaaaaatacctttgatcagcccagaatgacctcttgtctagttctgggacaaccattgtaaggtttagcaagcgagcaaccgccaccatgtcacatatctggaatatatggtttcaaaataacagaagtataaaaaagtgagagacaatataatactgagcagcaaaactaactcaagtaaaaaaaaaaacaactgacctctgaacgcatctgattcaaacccccattgcaagataccttcagataaccattactcttatagactcctaaaaacaaaaaaatcaagttaaaactgatatgcccaagtgatgattaatgctgcttcttaagtaaacattcaaaaaaatgaggatgtcaatcagctagtgcatccatttatgttctgccgtgacttctagagtgaaaaccatttttctcatcaatcgcaactgtacttgaagcagccgcttctacaacttcactaacttactatcgatttgggaaagggcaataacaagttcatccacatttgaatccaatacactttcatttgtacaattctactcatccctacagaatgccaccaaatccatacacatcaaaattcaaaactgaacaaaacttaaatcaaactccgcgaagaaataactaaacaaataaacaaataaataagacacggaggagatcacgcacttcgaggcggaagcgcggtgggcggaggcgagggctccgcgtcgccggcgaggccgaacaaggcgaggaggcgtccgacggccacgagctgcccgacgaaggcccacagcagcacggcgctgcaccccgccaggagccaaaccctaggcctcgacctcgccatcgctcccccaccctacatccaccgccccctcctcctcctcctcctcctgatccccgccaccggcattggcaaccgcggcagcagcagctcctcctccgcctcctggttcgagaaggttccagaagattcggg

SEQ ID NO: 44182 - DNA, 60581 bp, Oryza sativa
  unsure (1)..(60581): unsure at all n locations
agcgtgtgtgcgcccccccaccgtttgtgtgttggctttggtttttggtaaaggatctgcttgtctagttgtctttcgtacgagcggcggcgattagtccagtggtggtcaggaggaatccacacatgagacattccagacatctttagggtccagcatgtttatttgtttagtggagttgaataaaaggtcatatttggcattgccacttggagtattaaatctatggactctttgaaacacagtattgtcaaaacaaaatagaagaaataatacatgattgaaatgccctggcaatttaaattctatggattgtgaacatgtagaaaaactacataaatgattgtttcgatggagaaggaaaaacacaagaattataagagatataaacaaaggaaaggaattgtgttttcaaataagttgaacctcatgtcaaaatttttatgttttgagccaatcttaaagaatttcataagatatttggatgcctattttttttgactcaaaggatcgcaaaggaaagttttccactgaattgagttccttcaaattttcttcaaaaaactttgtcccaaaggagtactgtttaagtgaatagtactataaggtaatgtagtagcatggtgagaagtgtaaggatttatgagccgagacagcgggcaacaatagctaatgaaacacatctaagagcgaatgaaaatggagcacactcggtttgttgcactataattacgtcgcaactaactactaaaggaaacaacacagtcgctgtcgagcacaacaggaagcctagctgcagcaaatgcagtcgagcgcctgtgaaaaaagaacattatagagtatttacttaaccgctgtgattgctattggagaacaaggaaaaggagactcaggcatgagaaaagaaactgatagatgcgttagacgttagttctttagactttggtaaagaaagtgtaaggggtttacaagatttaaagagtactgattagatctagatttggtagcctcaaatataaatatttttttcttatttgatttgagataatcatactgtcaaactttccaaattccgagcaatttaatatttgaaattagctagatttgtgttacgaagactatatcgttggatttatattatgacattacaactttattgccaatttttaatatgacacttaaaaaacaatgatccaagggtaagttttatggtggaggtggatgtcacatccaatttagaccatgttatcttctcattaattaagaggtaacacatacttcctccggtttcattttaattgacgttttggacaataacacggtctacaaaatatatgtttgaccttatttttctattataatatatataataaataaatgcatgtttacttttattatagtgttttgaaaaaccaatctatatatgttgttctaatttctttaaactaagtatttttaaagttattgatggtcaaagttataaaagtgtgaccataagcttatctaaaacgtcaattaaaatgaaaccggatggagtacaatatatcacatttaatacacaaactctaatattagtccattaattaagaggtaacacatacaatatatcacatttaatacacaaactctaatattagtccactctcacatcatcttgcacttttcttggagattgtgtagaggttgccccttgcatgaggggtggctcattctctctctctcctaactactctcctccatctcatcatctaatcatatgtggcaaatttaggggtaatatgtacgggcttagggcaacagcaatgtatgtggtccaagcaatctatatgggtgggccttttggttgatccttttgttctctccacatgtactctaaggtgaaagatttctgctgtgcttgattcttgtaccatgtatgggctttctccataatcatgtcttcaaagtactcactagtacatgtatttctgacttgagcataagccccacagaactttgcaatatccctcttgacattatcccagtgtgtcttcatttgcttgactgtccttgtatgtgcatttctaggcatattgctgttgaactcatcagctacatccttccagtaatactctgacttcttatcatttccatctacagaatcaactgagttgttcaaccaagcgctaacaaaccgcaagttttcttcttccttccaattggtgcgtggcgctctcctcactccctcttcgctgctatcactcaactcttcgatgttaagtggctgcttctcttgctgtcttgtagttgtagggcaaggaatggatgactccgacccatgggaagaagtgttggcagcaacttcaactgaggtgactttgatgtggtgcaaagagtactctgttgcttgcagctccaaacacttgatttggtgagttagcttgtatccaatttccttgacgttgagtagcttgaaagcttggaggagaataaccatatggtgggtagttgcctggggcaccaaatgggtagaaattatgtaagaaatttgggttgaagctttgggaaaactgagatgggagaaaacggttggggaattgttggggaggagagttgtagtgcctagaattttctaggcttggagattcttgatttaggagatttttgaaacttctgttggatgaatccatgatgaaatgaggaggtgtactatgaagctctgtctattttgtttttataggcaacatggagctcaagctgtcgagcaagttttgtagccaacatagagctcaaggcaacggtaacttcaacgtccaaccttcaaccagcatatatctgctgcagggtcatggatcaactgcttttgtttttatattcatttccaaacagtgaactcaaaaagtaatatattgtattctcttgtgggcaaacccatagccatatggactactttagccattaatgctttaaaggccacatctacattgtatagaggcagcccatataggtgtttttattgtataatgcccgcttttgattgatattgtggatgccctttcttatagtacttgccctagcccctaagttgtgtcttagattttaaaaaacatggaagaaaaaggagttgaagtggtatattcactaatagaaaaactcaaatgccactaggctcctcatttcggcgactaaactttgggtgtgtttagttcacgctaaaattggaagtttggttgaaattggaacgatgtgacggaaaagttggaagtttgtgtgtgtagaaaagttttaatatgatggaaaagttagaagtttgaagaaataagaatgtgtaaaactttgcagttttggtttataaagtttcagcatgaaattctgaatgtgtgatgctaaccgcctaacttaaccatttgtgtggaatttttcagcgattgttcagcacttcatcagctccgacagttcaaagctctgaaccgatggagcgcagccagactccgcgatgacgccgccgtcgccgtcgatctcgccaggtgatctcgtatccttcgccggcaagtgctcgacgaagcgcaagctccgccttctccacggcgccctctccgccgncgncaccttcttccgaccgccgacgccgtcgcggcactcgccaagctcctccgcttcgccgccgtctcccccgccggcgacctccgccatgccgccgcgttgctctccctccacctcccgttcctctcctcggcctcctcccacctcgccttcttctacaacaccctcatgcgcggcctcgccgcgtcctcctcgcccgccgccgccatcgagctcttctccgcgatgcgccgcgcgggcgccgcccccgacgccttcaccttcacgttcgccctcaagtcttgctcgcgatgcgtgtctcagcggcggttgccttccgacctccacgcccaggcgatcaaacacggctgccttggcgcgggcagctctcacgtgcatgtccacaacgcgctgctccatggctactcgtctcgggctgctgttggggacgcacgcagggtgttcgacgaaatgcctgctcgggatgtgatctccttctcagggctgctgactcttcacctcaaggccaacgatttggatgccgcacgcgtggtgtttgatcagatgcctcaccgggatgttgtttcttggactgccatgatatccgcgtatgccagggcacgacgtccgcagaaggccttggcattgtttgatgcaatgccggtgcagccagatgaagtgaccatgctgagcgttgtgtcagcatgcactgcactcggggaccttgcaactggggagcgtgtgtgtcagtatgttgattccaatggcttcgggtggatggtgtcactccgtaatgcactcatggacatgtatgccaagtgtgggagcctcactgaagcacgtaatttgtttgatggcatgaccgtgaggagcttggcatcttggaatacatttatctcggcatatgcatcgcatggtgatgtggagagcacagttgctttgtttcatcggatgctggctgatggcaaatctgtgaagcctgatgggacgacactgcttgcagttctcaccgcatatgcacacaagggctttgttgaggaggggcgtgccatgttcaatgcaatcttgagtggcaactatggtaaagtggacctcaccattgagcactatggatgcatggtggatttgcttggtcgggctgggcaacttgaggaagcatacaaaatgatagaacaaatgccaattccaagcaatagtgtggtctggggtgctttgcttggtgcatgccggacacatggggatatcaacatggcagagcgggcggtccagaagctaaggagcctgaacccggaggagggtgggtactacattttgctcagcgacatgtacgctgcttctggacgaacaacagaggccatggagatcagacggatcatgaatcaggccggggcccgaaaaactgcaggccagagcagctggagcacaccctgtctgcctcagccgtaatttttcctaggctgcatttcacctgcttttgccctttggatcactagcataatcaggtattgtctcttactgcaggccccctgtttgatgaactgtgaaagtgtgaatcctgaatctgaactgtacaggtgctgtatgctaatgtgctatacttgctatcctacaaaagtgggccagaaacgcaacaatcattgtggagggaattgttttttgaacaaattttggaggggaaagatttcatcatggctctttaagaattcagctccccatgtatgctatcaacttatcctttcaaagttcatatggcaaatttgagtcagtgggtatttatttgcagttgagttattgggacagtggcctgagcatgtagtagcagtctatgtgacagttctctccacaattgccaattccttgggtcgacagtacttagtactacttagcgtcttggttatgtcaacatattatggtttggaaaaaggggttttctttggcactgtaggcatttcatcatatttttcatgtttacttgattctccgaaatattcttacctgaattccttgcggtagattttcagcttaatttggtaacatgtcaattatgcaatctcttagattcaaacttgtcagtctgtcacctctggagacagcatagcagtcatttcatgttacataggactacaacaccacatggggctgatgtcttattatctgtcaaaatccattataatgaatttcattaaattacagttgtcattatttgagttttattaccattttctgcataaaatcatccagggaacctttacaccttttctgaacataggaaaacttgcacttgtactatggaatgcaaagctttgaaaaactgttacatgtaaacctttttctgttctatggggattgtactgacgttttgtagcattgtgatatccacttaaaaccagtataatatttagcaatgtgcacggttgtaaatcttctttgaatggatttttctattcaagttcattctttggaattaactggtcttactgttcaagtgaatttgctactcaccattgttctcactctgtcactgatgtagtaaaacatgttgttcgattaccaaggcctacacttagaatggacaaaataaaaccgcttgctcatatgagtatatataccagtcctctctgttctttgtaaaatctgagtgttaattgggactccatattgcatattatcaattgatcactatattgagtatattcttgttgagctgcttttgtgtcttggcagactcttcatacgttgcatgataatgtgcacaagggcgcttatattggcatattgataggagctctggtacaggatcagcatgttgaagctgaaccagacggctcggtccagagaatcagttgttgatgaagctgtgcccacggccacggctcaaaacaggtatgagaagttcagcttcagcacagtatgctaacttacctcctgcctggacagtaatcaatacatgaataaatatgcacaattaacgagagagaagaaaaggtttgaatcatgtcgagagtgaagaagtattgttccatagcagattctgactcgatatcttctgtgaaacttgaattaacttgcatgctctccaagaaactgatgcatcacagtaacacacagccaccaattcacatgtttccagttcatttttcatcaaatacacactattactatcctatctacagaaaggcatctctatctctaacaatttgctgctgctatcttggcaggaacccgtactgcgagaccggaacctcgaacgccatcatcttctcccctcgagcaaacccgttgcggtcgtaggacgagatctcggtgatgtccagctccttgcacgccctgatgagctcctccccgaccctcccagctgcctcctgtcacaacaagccagccagctcaagatatcaatacaaatgagcagtttatgtctaattactaggtgaaattcttggaggcgtcgtttagaagtcctattcctttagggtgttgtgtgcttattttgttttaagtagtaggatcagacgtagacgcgtggtgtggttgtatattttctttttcctgtctatagtctcccaggactgtaggcttgtattttattccttcaatagaaacatcgcactatcttgtgcgggttgtttcaaagaaattcgtggaggaacggagtgggcggcgtaccacggcgccgcagggcgggtcgccgcagatggccttctgcagcgtgctgccgtagaagaggatcttcctgttgtggtcgtcgacgagcatggcgtagagctgcctgttggagcagaacacggacagcctcggcttcgtcgccgtgccattgaactgcagcgccggcggcaagaaccggtacatgttagcagaagggcaattggtttgtgctgcatggtgagccagatcggaacgagccgtaccttcttctgcagcctgcggttcctgaccttggggttctccttcctcgcgccgtgcctcgccgtggcctcgatcctcgggtacgagcgccggcgcccgactccgccggcgccgcctgcagaagccggagtgaagaactgcacgccaggcgagctgggagggcggcagcacgccgggcgcggcgagaatggcagcccgggggccgcgcggagcgatgccatggcacgcccacgggtggagaccttggctagctgcttggggtgggcaggcaatccgtcgagcaggtgcggcgcggaatcccggtgggagctgctacagtgcccgagattaggatttaggaatgggatttgtcctcacttctggggccccacctgtcacctgacaggtaatacaaggcttaagcaagggtgtaatcgcaaaattccccctcgagtttattctttccgtatccattttgtgctctcatctcaccatctaaacctcgattaatttcaaacccccgtcaaaaactactcacgtagtacaactacaagccaacccgctgcaaagctttgcccaccatttccacacccgcccaaagctgagcaacgcacgcgcgcgcgcatggaggggcagtgggggcggtggcggctcgccgcagcagcagccgcctcctcctcgggggaccagatcgcggcggcgtgggcggtggtgcgggcgcgggcggtggcgccggtgctgcagttcgcggtgtgggcgtgcatggcgatgtcggtgatgctggtgctagaggtggcctacatgagcctcgtcagcctcgtcgccgtcaagctgctgcggcgggtgccggagcggaggtacaagtgggagcccattaccactgggagcggcggcgtcggcggcggcgatggcgaagacgaggaggcggcgacgggcgggcgggaggcggcggcgttcccgatggtgctcgtgcagatccccatgtacaatgagaaggaggtgaggcgttggaactctcccttttccccccttccactgctgaatttcgtgatcgatcagtgtacgatccgcttcggaatcggaagcgtgcatccaaatctcccagcgatggttggacaggcttgcttaatgctctagcgctttttcactttcacatgtgacattttgcgaggcattgcttcagctctcgttcttgttaatccgcaatgcattgcttcgcagctctcgctgttgttaatctcttctaattgtgtggcgcatttgcgctgatattttagtctgttgatttagaatttgttcttccgagcctctgaatcagccgctggaataatggctcgtgggaccctgtctgtgctcagatcaataggacttagttacatgtggggttttgttttatcaatatagcgacatagcgtgcccgctagatgctaccggatgagggcccacattgcgggccttgcaaagcaaaccaggttgcagaactgttttgtagttcagcaatatccaggagctaactaatccaggaaattattgttaagggcaatttacaatcgccatctaatgggtttagcattctgtctatttggtggagatgttaactaagactgcgcgttgaatgttagttgtttttgtctgacaagcatccaagtaatgtttcaaagaatttgctaattggtttccagcatgtgaaaatgtgatgcatctgccattcttgtgcaggtgtacaagctctctattggagctgcatgtgctctcacgtggcctccggaccgtattataatccaagtcttggatgattccactgatccggccattaaggtaagttaaacttctgcatacatgcttagttttctcctttactcgagccaagtattttcagaagtcatgcatggcaaattggcggtgcaaagggcttagatgaagagacggtccatgcaatgttcatgtcaaacaagtagctagttcctcatagttcttgttgcttccttttatggtttacgttgttcagttgtggagtgcagaaggatgatggctcataatcctgtggattaaccaagtacaccccacatatttctgtgagttgaccacgcagaatagaacggttgatgatcttagtgtgacctgtattttgcctatcttagatatatagtacatgcccaaaattattttccctagatactcaattgctggtctactcatgattgctagacatgtaacacaacacagagtagttgacatagctaccacttgtagacctttatttaaccataatatcctaaactgaggtcattgacaggataaccacaggatcataccacttgcaaattaataacaatacaaatgcgtgatgaagttaaacatgctaaaatactgggttcacaaagcttgtgcttactattatttatttgcaatgatatagtttgataattcagcttgacaataaaaattgcagctgtaagctgatcccatcatgtgaagtactggataatctatgttcaacattgcacatgttaattactgcagttatttcctatgcggtaaccaaggaggttctttctctttttataaaataaaagaattcgtcgttctgcttaatagttgcagctgtgcgttgattgcattatgtgaatcaaagtagttcaacatgacatcatgaagttttacttcatgcgctataaggttactttcaggtagatgaagattgatcaagtgtacttatgtactttcactgcttagaaatccacaatccatcattattttctatttagagttagagcttaaaataggatttttgtttctttacttagattttggtcaaatgcaggatctagtggagcttgagtgcaaggattgggcgagaaaagaaattaacataaagtatgaaatcagagataacaggaagggatacaaagcaggagccttgaagaagggcatggaacatatctatacccaacagtgcgattttgttgccattttcgatgcagatttccaacctgaatctgatttccttctaaaaacaataccatttcttgtgcataacccaaagattggtctggttcagacacgttgggagtttggtaagcaagtattttcattgtttcattccaaccttgtgagggtagtcaaattaaataggggtgcttcagttgttggtctgatagtccgatttatgtttctgttgaattggtcactcaactgttatatgtactgtttgtctactaaactctcagatcatgttcatcaagtagactgaactatgaagagcttatagcactaaatgaaaatgaaaggaagtttattggaaaaaagggcacatccaatgttgcaccgttttaagttattaaaagtaaatttggtcgggtcccagaaaacccataatttggatatagatgttaacgctctgacacaatttgttcaagttttcaatgggtaatgtggtgtcatttggttattttaagtgagattttttgttcattctgattacaggctgttctgccctggcctttgctgggcaattttgcagtgaactatgatgtttgccttatgacaaggatacaaaagatgtcactggactatcatttcaaagtagagcaggaatcaggctcatctatgcactcattctttgggttcaacggtaagatccaatatcagaactacttacatgaacttttcatgcctggtcctaacatcgctgatctgcctacaggtactgctggtgtgtggcgggtatcagctattaacgaagcaggaggttggaaggatcgcacaactgtggaagacatggacttggctgtacgggcaagcctcaagggatggcaattcctgtatgttggtgatataagggtatgtctttgtgaggattgtatatgttgatcctttgataagcatatatgaatattttaccctgttttaataatgaatcttgatcaggttaagagtgaactcccaagtaccttcaaagcctaccgacatcagcagcatagatggacttgtggtgctgccaacctcttcagaaaaatggcaacggaaattgccaaaaacaaggcaagccttcttcaatgacagaatggaacatgttacgggattgtcatgcaataatttctttacccggttatatgtgattcagggcgtatctgtatggaaaaaacttcatctactctacagctttttcttcgtaaggagggtcgtcgctcccatcctgaccttcctgttctactgtgttgtgattccgctgtctgtcatggtccctgaagtcagcattcctgtctgggggatggtctacattcccactgccattaccatcatgaacgccatcagaaatcctgggtaagaatgaattctccctgcagagaacgtctatcaatctgcccatcaattttccaagattacagattttatctaatatataccaggtccatccatctgatgcctttttggattctattcgagaatgtcatggccatgcaccggatgcgtgcagctctaaccggcttgctcgagaccatgaatgtcaatcagtgggtggttactgaaaaggttggtgatcatgtgaaggacaagcttgaagtccctcttcttgaaccattgaagccaacagactgcgtcgagaggtaaaaaaaaaattacttacgatcatataccagttaccctctgatatcagagcagtgaaaaactgaaaatccatgcctgaaattacatgtctgtctgatttttcacccttgcaggatttacattcctgagcttatggtcgcgttctacctcctggtatgcgcgtcttacgatttggtgctcggggccaagcactactacctgtacatctacctccaggcatttgctttcattgctctgggattcggtttcgctgggacatctaccccctgttcatagcacagcaatacatcatcttcacttccaaacgatccattcttccccaattcatgattgcatcctgtaactacaagcaattcttttgtaaatgaaaaacaggacaagctctcaccacaaaaatctcacctgtaaacattccagtttttaccattgttgtatgcattttctacagcccctgcagtgcaggtgagcttgatgtgtagatctgaggtatgggcctggaccagagcccatcaggcctaatcacaggtcatgtgaacttgtgaagctcgtatctatgcataatgcaaagaacccatcacccatctatggctagtttctttacacatcgctgtcttccaactgaacagaagcaaactaagctggaagaccaggcaagaactcccaaaccttttgctttcatgccagagagaaaaaatctaactccagttgttggtctatatacgcttggattggatttctctattctttttcttttcttttctttttgcggtttcgatttctatactttgttagttagatcgcagctgtctacttgttacaatcgccacttgttcttgcgatgctaacttttctgcagaggctttcgtctttccacagatgcctgtgatgtaagtgaccctctcgttcttttccttagccattcttttctcttgtgtcttgtcccacgagagcacaagaaaatgggagaaaaaggccgaccagttggggcctggacgtgaccttcctttgtcacggcttgtgaggtacagtgccactgacaagtagctcaatctaaaagtcatcttttattttgttgcacgtatcatcgatacgaaacactcattcatcctctgtttcttacacgtgtattgggcctgtgtgaaattttgccagttaggataatcttttgtattaaggcacctccaatcgatcttggaagtttgctacttccaaaaatctcggctttggtaccaaaagttccccgtcaacgcttgacacgtaggaatcaaaatatgagacaatcccacgtatgctaactgaccgaccaaactaagtttatctcttttttgtcccaaaataatgtatacatatacgtctctatacgcactcacatgcttacccccacctatacctatatgaacacatcgagagagactagaccgtcacctagttattaaccactgaaaaaaaatagatgtgaaatacgagcaaccatcatctcgtgcttcgatgagcaatttccatcacaagaaacctaattgattaagatacgtttagttcgaaccaagagcctgtttatgattgataacattttcaaccataacattatttggtaaaattaataattatgtagtcacgtttagtttattaccaaattttggcaatatgtatataattttggcaatattataagccaatcatatcaaaattttgccaatgttgccaatttccaacatcaagtttttgatactttctctttggtgcatttttttatggaggaactttgacgcaatttatgaagagcatatatatatgagtaggttaacatctaccttcttaggcgcacacgcttcacagtattaacaaaagatatatggttgattttacatgtaagattcactaataagacaaataaatatgtagccgttgcaatactgtctaacagaaagagaaagggacatatttttcatgaaatatatgtactgggattatagaaatttcacaggaatacaacaggttcatataatcagtgaaacagaataatggcttactttcaatagaaacacaacttttaactttgaaaattccgctttcacctgacagctttcagttaaaattaaaaagataggcacctaaagtctatttatcctgaaaatgaggtgcgggcatgactatatatgacgcgctagccattgttaacatgcatggcataggtaaccgtgggcatggctaataatgtaagtgtgataaggtgcaatggtaagtatgaaaccaaaggtgcactaattccatcatgtaaacgtatgcaatctaatttccaaaggaaaaacattacgaccaaaattttctagccaatgaccaacatgaactactaatgaaattaactgaccttccttccaagcagcagcattttttaagtttgaacacaggaattgacaaagcgaaaactagcacctgggttgccaacagaataaaaacttttcacccatcacatcgaatatttggacacatacataaagtattaaatatgaaaaaaaaaccaattacacagtttgcgggtaaaatgcgagacgaatcttttaagcctaattacgccatgatttgataatgtgatgcttcagtaaacatttgctaatgacggattaattaggcttaataaattcatctcgcaattttctggtggaatatataatttgttttgttattggactacgtttaatactttaaatgtgtgtttgtaaatccgatgtgataacaaacctaaaaatttttcccaactaaacaaggcctatgttaagtatagctattctcaaaaggtatttcgaaatgggcacagcaagagggaactatcaaaatgcactttacaagttaaccaaacaagcgtatacaacaaaaacaacgcacacgagcggttcacacaagagcacgtatagcggcacaaagataaatccaggaagactaagcctaactcagcagagtcagattgtactacaccactcaatttaagtaaacttcggtcaattttctgttcttaatttttgctactaaacagaaaaacaataaaagggtagggtgcttattggagggtttaatatttcgttttcagcattctgtatcggggggtgccgagatacggaaatttcaatccaaaagtatttgaattttctaaccaaatttggttgaatttaaacaaaatattgccaaattcaccaaaaatgaaaaagtttaaaaattccagcccaaataatatcatatgggggttcctacagagccgaaattttaaaccctggtttactgtacgatagccctgatctcataacggagatactccctcgttctatattataagtctgtgttcggcagcctgtgttcccaacacatatccctcgtgttccgcgcgcatgcttttcagactgctaaacggtgtgtttttttttaaaaaaaaagtttctatacgaaagctgttttaaaacatcatattaatctatttttcaaaaaaaaaactaatacttaattaatcacgtgctaatgaactgctatgttttacaggcgcaagagatttatcccaactcttaggaatgtcttatctaaaaagacattcctaagttgttttaggtttgtcttacctaaaaagatttataacatgtgagtacataacggagggagtaaatttgcttttgatctttttttccccttaaaggattataaatattagcccattatttcctgtaattagtcataccttgggtttaaatgataaagttaggataaataaagcctgacctgaaaatattagcccattatttccagtaattagtcataccttgggtttaaatgataaagttaggataaataaagcctgacctggagattaacagaaagctgagttggagcagactgtcacccactctggcatccacaggagatgtttggcagcttgttgtacagttgaagtggaaaatagtacgctataactggaatatgttcggtagccacgaaaattagcttattactaaactgaacagttagcatgaaaagacatactagactttcgttagctaaaaagtgcaatcatcccaggatggagctacatatatagacatcaggataacaagtctccacggtccatgcatcccaacatgcatgtttgtctgaagtatacttcagtattgaacttaacatcgaacatttaggatgtattaatagctccagtagcaggtaaactttcacctgaaacaaagaatctctgtctgatactaataattagcctaactaggattaatgagaactcagtatagtcagtgcaacaataacaatcaagttgcaaatattgacaaccacatcacgatcaaattgtccttcccctgaaggcacaaatcaaagcctgaatacacgcaaagaatgaaaagaaaccagctgagataatgccactgcaagctgaaagacattaccaacagtccaacactgtcattttctttgtctgccagcctgaggagagggagctacaccgtcttcagacactcagagccacataataaaagatggacgaattttagcaaacctccgtcctactatcgttttgaatttttgtttgtaacgtctaactattcgtcttattcaaaatattatgaaattattacttttttttacttactttattattaaaagtattttaagtatgacttatcttttttatatttgtactaattctttaaataagataaatagttaaacgttgtaagtaaaaagtcaaaacgatatctaatttgggaccgagggagtactagcatgccccccatagtgttcttttagagcctataaatttcccatgcttcaagccgaaaagaaaatagctgtagcttccctggaaagaaaaataaacctaaactctctctttttctttaatagtagagcacaacatgggaggtccccactaaagtctcaaactctcttagcttaagagcagcagttttctttttttaaaaaggagaatttttagaggaattttgtaggattggattaattattgtaaaaagcatgtgaatttcttgcattcgaagcaagccttcagtttcctggtggtccaatataatacctagataaggtgtatgtagtgaatttattcctaggagaatgttaaaccaaattggtcctcggaaaaaaagaatgatcatcttaaagtatgaactccaaatatgccctaaacttgcggcacaagctgagtttcagtcgtatcactgtagcccaatcacgacatattatcatctactaaaaggaattcccataaccgaatcgctgatcatgctagacaaacactccgatgaccaaaaagactaccagccaagcgttttttacacagcagcaaaaaaaaaaaatacacttgcttctcattactcacagatccaaaaatgaaaaatgaaataaagaaagaacaaaaagaaaaggaagaaaagaaaagaaaagaaaaggaggagcatatcgtaggtgtgcatgtcagcaatgaaggatttgattgccaagtaaggcgggttgagagggagagatggtggagagaatcaaaaaaccgcacccctgcggccacaaatccatcttgtggctctccaccctcctccgtgggccccaccacctccacccccctccctccctccttaaaactatccccaatcccatcgcctcgcttgtgcgaatgaaaagatttcaagaaatccaaccaaaaatctcgcgctctcctctcctcctcctccgcatgagctcatcggcgttggcgttggcctgtcgtctccgggaggagtagtgcaggcggcggcggggaattccgaaacggagtttgttcgttttggagcggagtggtgaggtgagtcgtcgagatgggggagtgcaaggtgggaggaggaggcggaggcggagactgcttgatcaagctgttcgggaagaccatccccgtgccagagcccggcgcctgcgccgccggcgatgttgataaggttggtgtgttttctggcgatcctttttgtgttttgtagtatcgttttgagggcttgagaattcaagcgatgtagtactatgttgtgatctggtgatgtggcgatcggaattagcggtcagttcgggataattcgattggtttgttttgcttggataatggggagtgatttgattgattgattaattttggccatttctttggtttgaacatgataatggtgatcaaccgggagtccatatattggtcgtgacttataaggttgtatattaaattgttaattggtaattaaaacggtataatcttgagtgtacatacatgccttataagtctgaggttggtgtgtttctttgactttcttattatttttcttttcatttttggggatatcaatgtgagtaggcgtgtttagtttccattagcgaaagaatccttcaaaagtatcttgtttttgcttcgtttccatgctttccttagatagtatcagttaataatacaggaattagctatctgaaagatggaaccttcttgatgagtttctagactgtgcagactgtttcaattaggccttttcctcggccttccatgttttttttttcttttttggatgaaagcagagctgcttcttttcttagcctacagtactacaaaagtttagaggcatatgtaactagatttaaccaacacaaattgcacaactttattttcatttcctaagctagagatcagaacatgtggccttacaagctatcagttacataatcatatcctccagtgttttactagatcaactgaacaaactgaaacaatgaacaaactctgtcacagatcttcctggtacaataacctgaacacaaaactgtccatgtgggcttatagtttccaactgaacaaaattgcaaatttaacacccaaaaactcatcaagtttcttcacatgcttgcaggaccttcaacacagtggcagcagcacgactgaaccgaaaactcaagagaacaccgttcaagactccacaagtccacctccgcagccagaggtcgtcgacaccgaggactcttcagctgataagaactcatcagagaatcagcagcagcagggcgatacggccaaccagaaggagaagctgaagaagcctgacaagatcctgccgtgcccccggtgtagcagcatggacaccaagttctgctactacaacaactacaacatcaaccagccgcgccacttctgcaagaactgccagaggtactggacagcgggtggtgccatgcgcaacgtgcctgtgggtgcaggccgacgcaagagcaagagcgtatcggccgcttcccatttcctccagagggtcagggctgctctgcccggtgatcctcctctctatgccccagtgaagactaatggcaccgttctcagcttcggctccgacctgtccaccttagacctcacagaacaaatgaagcatctaaaagataagtttatcccaacaaccggtatcaagaacaccgacgagatgccagtcggtttgtgtgctgaaggattgtcgaaaacagaagaatcgaaccaaacgaacctaaaggagaaagtttcagcagatagatctccaaatgttgcacaacacccatgcatgaacggaggagccatgtggccatttggcgtggcaccaccacctgcttattacacttcaagcattgcaattccattctatccagctgcagcagctgctgttgctgcatactggggctgcatggttccaggagcttggaacgctccatggccaccgcagtcccaatcccaatcggtttcatcatcaagtgctgcttctccagtatccacaatgaccaactgcttcagattaggaaagcaccctagagatggtgatgaggaactggatagcaagggtaatggcaaggtgtgggtgccgaagacggttcggatcgacgatgtcgacgaggtggccaggagctctatctggtcgcttattgggatcaagggtgacaaggtgggagcagatcatggcagaggatgcaagcttgcaaaggtttttgagtcaaaggatgaggcaaaggcatcaactcacacagcgatcagcagcttgccattcatgcaggggaacccggctgccctaacacgctcggtgaccttccaagagggatcttgacttgaacaacgccttggaaatttttatgctgccttctgctgctataaagacatagcgtgatacagctgaaattttgtacattagaggattgtaaagtaggtatgggagatggagtgtcagggtgtataacttaacatagctacaagcaagcccagtagctgtattagataacttgtacatagctatgtgggtttgagaaagatagggagagcaagttccccttataatatgtagataaataatataatgatttgaatatttagatcaaaaggatttccttttgcagtagtatctgaataattcgtcgctgtctgattccagtgtattaaaccagtcccactgtagccctggaaatgtgatacttttctgcatatattcatcttgtttcctatttgtctatttctttcggtatcaggattggcagagacagcagaaacagtatccaaattttctttgttccctttatctatatatccttttgtttctctctctcttttcctgtgtttctttctacttttcaattgagataattggatcgtgaaagtgatgcaaaaagtagggaaggcacgaaagaaagcaagaaagcgatagacaactactggatgtcccactgaccttaaatgtgagagcggaatatatgttatctccttcacacatactgccgactgtcccgcagaaaaaatctaaccaataagagaagacgaacacaaaaaataaagttttaggtccgtgcaaatttccatgtgattatctgattggtgcacttcagtactcagcatgcgatcagaaaaagaaacattatgttctgacaaaagaacaatagtttctgattaagcaaaatgtgataattaccatagaataattaagaacaaaaatgataaaaattccattctccataaaacattaaacttcgaataaacagtatcaaaatatggaaaagctagcatgcagtaattggttcagctagacatgtgtctgtaacatatacaaatttgtttacattatttattattgcttatataaacatattatggatggaaatggacgagaagctctaccaatcatatcaagaaacatattactggtagatactcctaaaataaagtctcacatgcattacagaaaacatctaagctttgaaacgttttcaatacatgcattattaccaccattcgacctgcctttcactcattgacatctggtagtgccacttccacttacacggttttttgaacggaacttccacctacaccattggccagccaacttactaagccagcatgtttgaccttaaatcaaaattccaatgtgcaccttatttctagtctatatattgccagggcacctttttttttgtcaccaactccctcgggaaaaaagaaacaaaatgaaaacttggggacacgtaataaaaatttgaaggaaaaaatatgattaaagattttctgactaagcatacttatgatgattaatctctgacctttattcctatttgagcagccttctaatggtgtgagggcatgttaagtatgcaactatgcatgtcgagaaatatctcatatatgatagaacgtgacaggaaagtaattaatcgtatttttcaagtattgggtatgtatcatctctacccttgtgactttcggcagtggcatgaaacaaatgaaatgaccccttttgacatttgaaggtcaaacccaataagcagttccctttttggtgtctacacaccagtcaccagtggcaacagaaaccttaaggacaatagctttaataataaacttttgtgagtgcactttcccatcaaaggcaagtaacgcaaaggttgcactagagtgctgaagtgacacatggtcactaggagaaacctattttctagttcagattaaattttaaaaactcatcatgcatgcttttgcatacaattatatgtatgaagtcaagcttaataagaaatttttaaaaagacaaaaaggaaaataatatgatagtgagatttcagcctacccaccatcgggagcatgattagagcattgagcacgccatcctcaaaaacagaaaacaaagtatgccgagcaaacaataaccctcttgagtgtttggctgcaagcctgcaactgaacaaacagaagacagtgaatttccatatttctccatgaatgaaccaaaaaaaaaagagctcgtttcgatcttataatattaggttgtatataatcattcgtaaagttcttgtggatctggaggcatcagatgacctacacaagattctagttagttccaagtaatttccactaggttaggcttttgatgatagtacccaaaactacaacagaatttttttgttcacaaaatcgagtggttcatggtttccccatgttttcaaataacatatcaaacaattcaatattcagctgtaaaaaggtgtgacttacatattacttagtcaccttgtctggtttaaaggtggctagtacccaaaccgttaccactggtcttcccaaaactctgtagctaacagttaatgattatggggatgatcatgtgataattctttttaaaagtaaactaaaatttatcacgtgagatttacacctaatttctaaacagtcaaatatatgtggcatgttattattggacagtaaaacaaaaatggtgggtattaaaaaatgatgactactgaaaaataatttaatttaccattaatacataaacatatggagaaaatacgaagcgacttgttgactttcttagtgtacgaagcatggatcttttcacacttagaaaatgacaagaatactgtgggtttttctacagtactgtatttgaaatggtagaaaaatatggcattaattgcaatggtctccatttaagatactgttgacacatcataaccaggtttgaattttcaaggttgaacaacaaaagtaaaaatgtaaagatttctgaaagtaccaaagaagaataaaatatcaagatcttaccaatcattttcgcttcggtggcatcatcatggcttagatctggatattgcatcatttatgtgtagcaaattaagatcatatatccccatgcctcctcatccacacatgtatgagtggatataaatgttagctcaatcaatttgtgtggaaaatttgcagtatatatatgcagaagtgggaagagatggcacgaatgtgatgtcacatttaaaacaaatgcgtcgacacatgtttacactgaccgcacttggaactatggtatgtaatacaaaataaaatatgccttaaatcaggatccgttaagtatgctaagatgacaaaattcataacattcctgatggtcaatccttagaaaatggatgatgaatgcccataaagctgggagtatacatatttggcacaaacatcagctgggatttttcctatcagatttgaggtaggcaggcagccttttgaaactgattatcatcactcttcagacgtacccatcgtcttcattggattctgcaaccacctgaatctggccctcgcctaacattcccatatgcagagagttcaagaagatccatatcacgtcctgcagatatcaaacaagttacttagaaagttgggtgattaattttatgatcaatgatagcttcagtaaaggtggaaaactcaaggtagccatactactcacctgagaccctacaataggcactcttctgtatgagctcagatttggataactctgttttgttccctttagaccggtttacagtagcctgtgggaaagaaccgaccgtgtcaaatgagaaggctgtgcatcacaattcacataggatcacatactactagcaatgttttccaacaagataacacactacagacaaggtttcatcgtaaacaatttacgatttcattatttcatcaatgctcaatagtaacaggaaaatcatgagtaacttctttgtgactgaagagaggcgcaaatgtgcaaacaggtgggccatcggcattacataggaagcttgtttgtatcaattagttagaaccaggtagcactccccattacctcactccgacaaacaataaacttagcacaattctgtgtatgcacaagtacagtggagtgatcgatcagggtatggaactatagagacgcatgtacctgcaaaacctggcagttctccaatgtgctcttcccaccctgtccattcaaaaaaggattagtaatgcaacgcgtcaaataaaatcatgttctaagttctaactaagaacagtacaattaagcgaatgaaaatgcaacatgaagcactgaaatctcccggggctttcacatcatcaattcatcagccatcaaagtaagaaagtagcagcgttacacgaactcattcatcagtgttggagttggggtttgggaccttggagtaggggacgatgtggtcgtagtcgtggcagaggcatccggggcagccgacgagcttgcggaagacgacgttgccgagcgcgtcgcggcgccacctctccgggtcgcgcccggccacccgctccgccttctcccagcaccgctgcttcaccacgtaggggaagctccgcggctccgacgacgacgccgacggccgcggcgccgtgaggagcaggccgtccagctcctccgcgaccgcggccacggaggcggaggaggaccgaggggaggtcggccgaggcgtggccccgaacaacggcggcgagggcggcgcgtcgtgccgccgccggcgcagcggcttcctccccaccattatctccctatctcctcggattcgatggttttttttcttttttctttttttccctctcctatttggatttcatgtgagacttacaggtggggcccaccggataggatcgccgtggaggcatttcgtcgagcaggttgcatgctcgaccaggacggcgccgccgccaatgatctcaaatctaccaagtgagcttcgccgcgttcttcgaggagctctcccgttgcagttcagaagctacaggcaatcgaagatcatgtgagttgatggcgatttttctttgttttcgggccactttggattgatgccaatatatgccatgttaattttttggtagtttgaatagtaaatatgatggtttggttcgaaaccaaatgaatggtaatgcccatatttaatttggtagtataattctagaattttctgcatcataacataaaatttggattcatgtgaaaccatgggtggttttagttctttgtgatgggaaattgacaagtaccggaagtgtaggaaatgtgtgcgtgaactaacattggtcaggttgcgacagctgtgccaagacaacggttgtttggttcatgtgtgtgcaggtgatcggagtccagatggatgcaagggtggaggttgctccttttgtaattcttttgagatgctcggtgagagagtttcagtgtgagtttggagtgtgtttgcccgagaggcttttgtattaggattagtttggagtgtgtttgtccgagagattttaagtttgtgttaatgttcctctgaaggtgtatgtttgctcctagttgagcggttattttgcatcacctatgaatgaaatgatttgaaggatttcgtttttgccttgttcatttaaattccgcttgcaatttgaactttgcgatgatgagttttgctatctcctcctcacctctcttctagtttcgggaattccttttctctttctcttatagtttcgggaattccttctctcttcttttctagatccggcttctctaataaccgcggttctagtaaggattttgagaaatccggcttgatgagtattttcgggggcaagatttgaattgctatattcaccccccctatagccgttcttgatctttcaattccaattggtattaatccaaacatattacttagaagttagaactctgccctaccaaattattgtagtgccaaaatatgtctagattttgacactactaatgttttagtagggcactaaaccaaacaagcccttcatctcattttctctgttactctgtacattctagtgattaaatggaatctgttgaacaagaaagatgatctattttgggcatctctagttaacaacagttctttgactgctgtcctctgtgcttaaacacacactaaattcaagcagaatgttctgcctgaaggctatatagctttctcgtcagtattgcctaatcatgcctactcttctgctaactgaagcattcgacagcccaggctttgatgtttcccaaacaatcattgtacccgtgactaacatatgagcagattttctttggacaagaaactcacagagagctgaagatgatgtaaagcaaattatcttcctgtaggcactgaagcctgaagacaatgtgtagtgaactatcttcctaataattaggtcagacagttctgtcaaattgtccaaactcaaaaagaaagaaagaaaaatcaaccaaagaaccacataaatgacagattttgcagtgttatctccagatgttacaaagaaacgtgatgagtaaacattatatcatctttcttcctcgccccaaaaaaaggcattatatctttcctcgtgatagcagaaacaaatccaaatcaatcatgcctctgcaaccgtacaaaaacacaagatgccatttatccttcaatatattacagctttgcacctcaattcgcaagcaatctgtgccactcataaatagttttgttctctgaatgaccaaaagattaagcatcacgacgaatatattacacatcttgctaggcttgacaaagcccaagaagcctaatctaaaaataagctgagtagtttgcactgtgacacaacagtacagccaatagcagtagttgacagtccttcttcaggccttaatacagcactggaagtagctcagaaacgtcctccttccctgcatcagaagttccagtcagaaactcagaggccactaaaatcagttaatgttacacagaagaatgcagatatctgcggaattagtttttgcgcataagttcatacttgatgctaagttttatttccaaaaaaatgatgctttgaaagtacctgcatctcagagtatgtagaagaattgaattgcaactcagaattttacatgtcaaattgtctcatggaaagaactgtgatactttattaaatacacttattgacaattaatttctccagttccgcaagcaatagcataatcaaatacatattttttctaagacaccaccaacctgtggcagactttacttagttgttagtcactaaatccaagtgttcccgtgggtactttgcatctttttattacgtgttaagagttgcttatctatcaaccgattcaaatcattattagttccttctaatcatctttcggccaccaagatgcttaatatattaattggttgtactctggactatgcataatgcatatcagtacaggcttacagcctttaaaaggcaaacagatatgaggatatcatgcatttgatttacaaaatatgagtatttgtccttgccaatcatttgatcgaagcagtgcactatatatgtatatgcataaagctggaatggccggtgatatgacttcatatatactcctattcgccaacccacctatagctgttgaactgactccactgtgcatgctgatccagtacaaggttataggtcaccacctctaaattgtttaaatatatgtattagttgatcagctaactgcttacccgtgattaattctagtaattcaggagacgttaaaacatggtattttctaaactatatgtccaatagcttctcaaattttctatcgtctgtcattcttctccctgttgacatcttacaagaacaagctagagctgcctaggtaaaataaccaggcaaatgcagttacagaatggctgcatcagcttgtaaccttctcctctcctcggatcctgtcctagccttctcttgttactccagggaaaaaaatgtctagacattaatatttgcatgttgattctacagctccaggacagcagtactactaatctactgtactgcagtaatgcagtctgcacattcaaacgctctccaccgtccacggtaaaaacaattcatgatccatgccttggaataagagtttgaccgacaaagcctcacgcggttgctgttctctagcgtagggattaagaaacatgcaaaattatttacagtattatcttcgaaatctgtttcagtgttaggaaatgaagcttctacagtggtgctgccctctgaaagtgctctgcttgtgctttgtttttacatgccacaatgctagtagtactacatttcaagaactggatttgtccacttgttatttttttatttatcccctttccttttaacaatttgacttgtactactatcagttaaagccaatcttgtactggtcgtatcaaacaaaagaaagatcaaatctttgcactccatgattcagctaaagaccgcacaaatcgaaagacaaagcatttttacgatccagaaatgaaatgggttttaatgagatcatgtaaatcctcattgaccgttagatgacatgacagtaaagtcgtgacttaattccaagaataataaaaaaaagagaatcaaatcaaaaccgggtaggctatcagggcgaatgagccttaccgtcggcgagccgtggcggccatggagttgccggtggcggtggtcgtcggccggccggccgaggttggccttggcgggcttctgctgcggctgcggctgctgctgcttctgctgggcgaggaggtcgtcgtcgccgccgaggctggtgcgggagagctccttcttgttctgcttccgcatctcgcggatcttggagaaatccatggagtagtccggcagcgcgccgttcttcatgtcccagtccccgaacgccggcaccgtcatccacccgttccggccgcccgccgccgccgcgccatgcccctgctcacacacgcgcgcaagaacgcagcgaaagattcagacaagaaacagcaggaacgagaagagaagaagggttcgtttcagggaattgagatggaagccgttcttggcagtttcttacccccttgatgttctccatggtggtttgctggataatgatgatctctctcacgcagcctcgcaaaacgcaactgatctctctagattatctctagaatatcttcttcctcctggatggcaagctgccaagctgagcagtgctcaacttgtcttggaggtggtagcgaagaatgtgtggcgactggagagaagaaagcgatagagctgtacttatatgttgacgaagaatgaggagaagaaaaaaaaattgatgtttgcgcagctcaccagctggtcatgagctaacagtactactaagtgattgcttaagagttaatcactcagcttaacagctgagattagaagctgcattactgctcttcgtacaccacgcgtccccgaaggcccgaaggctacagctggtgatgcattgatgtgtgtgaacagtgaagctggggatactaggatgggcccacttgtcaggtgggcccgtgacctacccacagcttcttctctcttcacatcacacggcattacgctgcgaaaattcagtggatcgcagctctaactccttgctaattgggggcgccagcgaatgcgtctttttcttgcccaactcacaagctttgcagcttgcaaaagaaagaaatgctcatgtccacatcggtttcctaatgcattctccctttcagattcatgtgcaggtttcagacagattcttggttttttcctgtgtcaattctaggagaagagagcactgcgaagcgaattaccaaaagtgtaatggctggtatttatcatcttgatagcctgtcaacagcaaacgtaatgagtgtatatgttctgattggaaagatttccatcatctgaaaatgctggatatgcatgtaagcaatattcttcagcaatcatgcaacagagatggccttgattcgagcatttgtcctgagtcctgacacttcttctcacaaatattggtgatgaattcggttgtaaaggttgtcagccattgtttgttgggaactgaatatgcttagagaacactgtcgttttcagaaatgtatattgggtgtttttacttccataatgacacgtaccgctacaagttagtactacatgaaaaatattgcagaaagatttccctttggttgttaggaatctttttgctcattattgaggagcacttttgcagccctcaaaagtgttcatcttcaacaaactactatggttggcatcaactaaaaagtataacttctcactatatcatatacttatgatgcttatctctcatttcttatttacatgtaagtacattggtgtctcttctcattatttcttattgatctttcttttttttccatttttactatcataagaggggcgagcttctataaacgtggggaactatgatgggagatcatagtgaagctctgaggcattttggtgtgctaagagttgctctggagtaagaaaaacatatagaatgattatacaagttcggttctctagctgcataatatccccactcgtgtgattcattagagagactaactttcaagcatacggtaaattagggttggctcctatgcaagaggaattaatatttcatgttcattgtgattgttgggagataacttaaatgggattgcaagcggacctttcaggtcaatgcggtaatattaaaaaaagtgagattttgactccctccaactattttttaagaataaattgtgagtttgttgttattgaacacgggacacactcattatcgagtgtatctcttggtaatgtatcgataatttatattgcagtatagtagagactagggataaaaacggatcagaaacggacggaaactagctttatcatattcgttttcatattttttttcggaatcggaatcgtaatcgaaaactcggatacgtaaatgaaatcgaatattatcgaatacagatacggagcgaatacgagacggaacgaatacggtaacgaatatttaccggtatataaaaacctctcaaattgagtttcttgattaaggaagagatatcgcttattattttatttcaacatctccaacatttatatcgtcaattttgtagacggtcccacaaccgtatgtgaaaatcgattttcatgattgttcctctaagagagccatatacaaatatgattatcattttctattcccaagaccttttactagatgtataacttacttaccattgtataaattggagatattatttattttacttcacatcttcgaaacttgtaatgtttgtattatactttaaattctttcaaatacaaatgttataaactacaaagtggtagatctcgttgagccctacaattttaatatggaacacatctccatcagatatcgtttgaatggtagatctgagattttgtaaaaattaatatggtatattataataaatatttagacccttaaatgacctcaaataataaaatagtcaataataaagttgtagatctcatcgagctctacaatgttgaatataaaatttgtcttcatctgattccgtatgaaaaagttatgtatatatacgtgttttttctaaaatttgctcaatgtctgtggatatccgaaaaaaattccggataatttttgaccgtttttcgattccgatggataatacccttactatattcgttttcgtttccgagaaaaaaatatccaaattcgtttcagaatccaagaatttccggataattccgaccgaaactatctaaatccaaaaaatggtccggacggacgaaaactatccgaaccagtttcatccctagtagagataaatatagcatctttgatttctttaatgaaaacatccaagttatgattgaggataaggaaggtcaccaaatcgacagcagcaagccccggtgccacgtcctctcgttctttagatgatttctcctcgtaaaaatagtttatggcgatggcgatcggcagccatgctcctttgcctaaaacagcgatagcttcattgctggcttgctgcattgctcgccgaaagtcaggtgccactactctaaaatcccttctgaaatcaaccattatactctaatagaagattagatgatattctatttctgcctgtcaccgttttgtgcgtaaaagttcgattttttgctactgcttctcccatcccataaaaaaaacttatactagatgtgacacatcctattacagtactacgaatttagtcatacatatagggcaagtttggtttgaggccaaaacggaccttaccaatatttggccaaaggtacaatttagcatggccaatatttgacaaggccaaattgtgtttggttaagggccaaaactaaccttgccaatttttggctaaaccaggtttggtttggtgccaacttttgtgtgcagcgtggaatacatatggccgatgtgccactgccaaagcctgcgtaggagttcaaatttcaagcccgcacttcggctcccatcaatgacgttaccgattctttctcttcaggccggccgatatttggatccaaaccaaatttgtgttcctactgtttatgtgtcccataaattggtaagccaaatataggccatgaaccaaactggcccctattcaaattcattgggctagaatacgtcacatacagttttagattttttttttagacatagagtaatactctaatcaaatattagatgtccattctaaagtaaacaaacataatatcgaatgtgacacctactcttagtaggaccacgaatctggatatgatgtgtgatatttggcaccggtttgtttaactgacggtgagtagttgtaaaacttgaaatggaaaatatacttttatagatattaaaatgctttttaaagcccaggtccagcccagcccattgagggctggaaacgtccgatcgaaccggatcactttcactttcctccaagtcccgtcttccttcccgcggccacactcccgccgccccgccgtccgctggagtacgctgtacgccgacgagcccgcggcagaaggcacaggtgaactgccgctactccggccgcgctataaacatttcaccaaaaaaaaatcagtgagctataaacaaatactgatgtcataggctgtttttaggtgttaaaataaataacttcttgcgtcttttgtattctacagctcttaatgtactgattgttatgcatccaagaaggacatgcagttggtctcacattgtaattccggtggcattggaaactgatgttcaccatggggatgatagtaaagacagagttggatcaactacagttaagtgtgatccatgcattcctccactgcttcttagcttccctcaggaccaatgatgggagatcatatccattttagaactactccctctgtttcaaaatgtttgacaccgttgactttttaacatatgtttgacagttcgtcttattcaaaaaaaattatgaaatatgtaaaacaatatgtgtatatgaaagttgtcggtgacatgggaccgggggtatcgtgactagaggcttgggtagccgcggtcacccacatggccagaccccctcgggggggggggggtcgggcccgaggatgacgtggccacccctccctctgtctccccgaggggtcggaccgctcccgtttcggccccgagggctggggcgcccccgtttcggccccgagggctggggcgccccgaccccctgtggttttggcgccacgcgtgtgggttaggtgagcacagcgtggctcacataaccgcatttatagcaggattggacgagcgcaccacgccgcatttaatgcggcgcagcgcacgcttatccggtccgtgaccggtcgcggtgtgtgaccgatcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatggacgtccaccgggaaagcaggcgagcggggcaggaggcgtgtactctgcttgtcagaggtcacttccggctgtagactagccctcattgtaaaaagcatgtttcccttcttagacagctagaggcccatgtggtgacccctgaccagataaaaaggaggcccaggcctaggagagaaaaaaagaaagagggagaaaagaaagaggaagaaaaaaagaggaaggagggttgggactttggggaatgggttctagagcctgaactctctctccctctccggggcgctctgtattccttcacgcacagatccaccagaacacaggagtagggtgttacgcttctcagcggcccgaacctgtctacgtcgcccgtgtcttgtgcacttcctctctcgctgacgttcctcagatcgagggcgaagaacctcacttagctcccccggccgaaccggcaaaggggggcctgcgcggtctcccggtgaggagccccacgctccgtcaaaagtatatttaacaatgaatcaaatgatatgaaaagaataaataattacttaaattttttgaataaaacgaatggtcgaacacgtactaaaaagtaaatggtgtcaaacattttgaatcggagggagtacaacattggactgctcggaagggctcctgaactacgaagccatcatcaatccagaagggtatgtggcactgtagcgttgacactgctgaagatgttaaagcgggcatgaatggaagatagataggcgtgcgaatgctggtaaatttacgcacatcatggtcaggtgtggttgtcgtcagtactggatgtgtttatctagagtaatgctaattttgtaaactgatgatgtgtattgcaccatcagtctgcaatcgttgaagcatagcatttttacttgttccaacttccaagcatccatgtgtacatcaccagtctcactgtacatgataccttgttttcaggttggctcctatgcaagaggaatgcttcttgttcattctcaatgcttggagagaaaacactcctatattgcaagcaggcttatcagggtcaatgtggtgatatatcaactatttatattgcagtacagcgagaaaacgcacatgggtttttcggctagcttcataagatggtgggctagacgacttgggttcaaagcctcaccctttctaattatttgatattaggtcattccctaatattcgcattttttttatattgcagtacaacatagacaaatattatatctttgctttttttaatagaaacatccaagttgttattggggcctaaactaccacaggcagttcagttgggcctaattctggtggccgcctggacaagtgctatattgtgaaatcatattcataccttcaggaaacaatgatacatccagatatcagagatggatgatgattggcaaaggaatatgatcttgcaatcatttgtgaacatgcgggacaaaacaaatgatggacagctgaagataagcaaacaaaataaaataaaacagggtttctctgacatactagcatctgttcgaatcttgaagttcgatgaaaaaacatgtctagtttgatgaataaacagttgaaatggcaggaaacgtgtgtgtgcagttcttgcatagggagtaccctgtcgtgctgggatgtagtatgcagtttttcgtctggtagttaacaattagctcaacgagaaatcatgccaacgaaatggtcaacatgtattcgagttgttggacgtcatgttcagaaacacaaccggttctcgattaaaaaaaaatcagacggtagcatatcttaacagcgcgttttgagctaactaggaattgacgtgttcgcagccgaatttagcgaaaacgaccacaacaatttcttaaactgattggtaattgtatcatgccagcttcgtttggcctgtaacagcgacgtgaatgcacacacgcatagtgagaaaaggagaaaccatgacatcttcagagaactggtaatcttcttcagaaaaaaaaatggcgtaaccaagaaacaaccaaagaaccggacagcaattcaatcaaactacgaatgctttataattcgctatttccattgccaatatcgtctttgtaaagaagatataatcatcattatatatgcacatgattaattaagggggtaataacaaaaaggagaagaaaacaaagaagtgatcaaaaaagaatctgatgaacagaatcatcatcatcaagaatcaggcgtcctgggagtagaagtcgatgatctccttgaggtcgaggtggaggagggaggaggaggagcggtcgtggtggccggcgagccagagtatgtgctcgaagaggatggcgtcgacgtcgacgaagagcgccgccttgctctcctccttcctcaccgccgtctccagcagcagccggaacgggtaggtgtcgagcaccagctggtcgacggagaacacccgccgctccttcccgacgacgaccgtcgtcgtcaccgccgccggagacgggccgtcgtcgccgtcgtcgagggagcggtagccgatgcgggacggcgaggccgacggccaccggaggaacacgcagcagccggccatctcgaacgaactctcctctcttgatgagcttttcttgcggctctaatggcggcgtcgcggggatgggactgtggaaggaagagtggagagggagcgaagtctctcgtttataacaagggggagtggaggttgaatgaaccgttggaggtgtttttttgcagatcagacctgcatcttctcatgatttaccgtataacccatactggaagggagagaattgagagctggtataatagcagattataagctagctataagcacatattgagaagatagatgaggacagaaaatagcagcatgctacaaatttgtagacagccgcaacacaaactataagacgtaatatgtatatgataggtagcccactactacaagactaatactactctctccatcccataaaaaatccaatcctagcatctcaaggtggaattagtggagagtaagaataactaaaatgctcttaatcattaaaaaattagtaagagtgatagatagttaaagggtattgaaggaataaaacttctcgtttttcgtgctaatattaagtaggatggtataagttagttttttatggaacaaaatttaaactctagaagtttagtttttttaagatggagggagtattaagcttgctggagagaaagctaacatcaaggggatatatgtaatttagtgagaaacagaggggttttactgaaaatgtttgcaatgatgtgcgttccatcggatgctactgcgtcgtctcgggatagccgttggacctggacaatagatgatggaaagcgacgtcgtggtggacccggtcacttgagcctccttcttcttctgctccctgcaaatctcacgagtccgtaacattacatgactcggcccgagagtttcaccacggacagtaaacaaacaacagctcaacggagagaggtgaacaaatcaggaacatgtgtgcagcaagcgacaccggcacggaggcgggcacgacgattacgatgccgatcaacttggggtactcacacggttgacggcctgacgcggtgcgctggtgcggctttggctaagcggagagaagcttccgcatccgctatagctgtggccggccaaccaacgcgccgtccgggccgcgcgacgtgacgacggcggaaaaacagtagaaaacgggaggcggaatcaaaaaaaggtggggcgcgagtcgcgcgacacgggatcgcgatgccggggcggcatggctgcttgtcgctgtctgcgtggtagggatacacgcgggctggcctgtgagcacttatagatcgaggctctgtttatattctaacttttttttcttcaaacttttaacttttctatcacatcgaaattttttacacatataaattttcaaccttttcgttacatcgttccaatttttttaaacttttaattttgacgtggaactaattaaatacagcccgaataagtgatagtgaataagttttcgcatcatggttcgacttatcgtatctaaagatacaagtggattgatacataaacctgtttacataccaaattaaaaagtaactcgcaagttaatctacacggtacctgctaagtttgcttattagtaggctcgtgggttgatcggcttacatccctgctgcgtggccgcgtctgttggttacttggttggctcccccatctccaactctccatcaacatgtacgtccacatgcgcgcgaccccgcgagggcgtgagaaatcgccaaaggcctcatcccaccccatacgaagcagtgggtggataaatccactttgtcatctctcatattttcatcgagtttaaatcgtatccctgaatcacatactgaattacaaaactcgatctatgaaatagctggggttctctgacgtggcaccctaatttaacccagtttttgcaagttgagggtactatgatttaaacttgacaggaagcaaagtaaacgtatctcaactggttatgtttctgtagtagaaccaactcatccgggttcaagtcctagacttgacacgggtgctctcatttacggctaactattattttagtgataggcaacgtacctgagtgtgtgtatatttataggactagttacatgcccgtgctaacgctacggtgaaacaacaaaaagatatacaatatattgtttgggctatcaaggatagattcaagacattaattaagacttacagatgagcgagttcagttaagaagcttattagaagttcctcagttattatatattcgaaagggataaacaagccaaataaactacatccaggacaaggttcaaaatttgcaaaacaagccataaggtcgacccattcagtcgacgatgtattatgtcttcaacgtcttttctccacgtcacagaaaaaccagtaaccaaagaacaaaagtctgattgatatattaagttctaaaccgattccaggacacattcagtcaattaagttcaaatacataatcatgcgtttcaacattaattaaagtatcacattcatatatcattacatggcttggcaaaccacaaagctgaggctgccttaatctaagctacaacaaaatttcttttttttttttgcattttagaataaacagtaaaagagaatggataaatcacatgtcctgaagctgtaaatttctacgaagtcctgagcagctcaattttggagagggtagtagtgttgttccctttatggttcatctgatgcatgaagaaggcaagttcaatttctggttcagtaactcttgttgttcctactgcttccaggaagcagaaccgccaaggattttcttgcttgatgactgtaaagagatgaaagttcaaactggtcattaaaaaaattgtgtgcagataagagtggtgttgagaagtcaagttatcaaagtagcattttgtcttcgttccaaaggagctaactctgtttttaaatatctgatctttttttcataaactcactaatacatatcactaatacgagggaaattgtaagtgaatagtgaatgaagataaataatggtttgagagagagatagagggtgaactcaccaatatatcccaactgcatacaatcatcaagggcaatgcgtgcatgagtgatagaaatcatggcagcaagtatcattattgtaatcacattctgcatggagaaatgtattttttccaagaatataagcctattcctctgctagtaaagttcccatgtcaacctattttactttaaaaccaaagaaactgtaaacaaaaaaaaacgagatagagatttgcaattcactgggtacaaaagttagatgcacttctttaacattttagcagattgcttccaacatatgacatcaacttcccagtcagttggttattttacaatcttgaaaagcaatatttttctatcagtccaactaatttgagaaaaaaaaattctgaatgagatatgtcaagagcagttgtgaggctgaattgttcagggatgtatggaaagcaagcttgtgtttgacgcaacaaatatgtgtatatgtaagattgatggagtatggattctgagcgatagcagtagacaattcaatcaatattttatcacctaaagatcatgcatagtattttgacgaaacaacggcagatgtgcaccttcaagatgaagctttactgacgatccaagtcgttgaggggatctaagatccagaatccataaacactctccagaacacatgcattgcaggtgaggagccggacgggacatttcgccgagcaccccgcgttcattgtactctgaggaaaagcggcaagcgctggatgatgggttttgtttcagaatgcatgatgaatccggatgaacctccacgatgccaagtttcggactagtcacctgctgatgaactgcatgatgagttttgttcaactactcacctctcacgggattcacctgctgctcccccaccggcgaggaactccatagctgcagctcacccctgcgatgcagaggggatcggtggagaaggcgatgcagaggacggcgcggtggctacctagcgacgggagcacctcgtgcggcggggatcggtggagcagaacggcggcgacgacctggtgacgggaggacctcgtgcatcggggaggcggaggatcgtggagagcgagctggcggcggggatcggtggcagacaggcgatgcagaggacggcgcggcggctgatacggagcggagcgctgatggcggaggtgcgggagcggaattccggcggagggcggagacgcaggtgtggtgggagagcgataggaaggggggtgggccgtgcgggtcgtgcgctgattgagggaggtggatatgggatcgatctgaaccgttcggattttacgcggatgatctgaaccgttgaatgatgaatgtaagagtgtaagagtaaaacatgagtaaaacgagttggtgaattatagaatagatagatagatagacgagttggtgaattataggatagatgagtacgcgtgatgtgagcgtctacttttgtatttaaaaaaactcgacaaaaagatgaggaacgtcgagcggacttattccgcagtgggttgtcacaggctcgcagctctcacgcaccagcccgctactgctccgaaatcgtgtccaattctccaaccgacggaatccatgtgggcctccaattctccaagccgaatgccagcacaagccaacaactcggccgtgtccaaatctccatgtacatatctctcacttttttttttgcataattccaatttcagttttcatatatctaatattctaatgctggcagtgtttaccagttctgattgggccacttgacggcctttactttcaaaataaatcctagaattatgtgaaagaaaaaaaaacaataggaaaaaaataggcttgagtgttgctgcgttgcagctctcctgttctgaggtgctagccctcttataggaatgactatgtattaatctagaagaatccatggcagctaaaagtgtttgaattaaggagcgatccaagtaatgtaatggaaatactccttcaaaataagtatattttaacctatcacacacatacaaataaaaagtaaaaatactaggataccccactttattaaatcttaatacaaatatttttactttatatacttttcaatgcgttctcttgtttttcacaaactacaatgcaataattattttaaaaaataaagttattttaagacaaacggaagtaggcaaaaatgatattttgggacgggtggtaggttttgtggtatgaattccacccatcaaacataaatttgcaaacaaaacctaaaacaccttaaaaataacatcacctattttactagacgttttatttgttttgttgattataattaaacacaacaaacagactcgaagcaatacctacgaaaagataattgatgatttttaaaatgtatgaaaattaaactaacatcataaacatttgcaaaattaaactaacatcataaacattgaaataatctgtccgggatataacacgagcgtgcctttgccttagccacgttgattttctagtaattcaaaaattaaaacttgcttctgaaagactgaaaaatagacatagatttctaattattgtttgcaagtgaaaatttagacagcatcttttttagaaaaagaaaaaaaaaggggaatacagcaggaactaggaacagagaagaaaagatagaggggaacattttttttttcttagaagagaagagtggggaatagaaacgcaaaggcatccgtatccaatggcagtctcctctttggccttcgctagagtcctcgtcccgccatctccaagaacaggtaaaccatcccaaatcttccccatctttctatccctttgcacaagatagattcttgctgctgctcatctgtagatgactagattcctcaatccatctcttcggtccttgctccatttcggattaaaagtagtccttgcgatactatttgcattacaaaatcgagatccacggatttcagtctggtcgaaatttcccagcttttgttgctaggggagtgtggtgtcggtacctaaccctagcccaaaacccaaaacccaagaattcatgattgatttcttgagatttattcgacagacaatcagtgaatatccccaacctgctgtgaagtttttttttttttttttttgcaatattgactctgtaatggggattctttgatgcagcattagcttcggcttgctcccattctatcaagatgtgcgcttcttcagcctcaccgtcggagtcaaagaagaccgtctgggtgtggacaacaaatcggcaggtgatgacggcagccgtggagaggggctggagcactttcctctttggatccaaagatcttggcaaggattggtcatgtgagagcatttcttttttcttacagcgatgttaggttacataattgtttctttatttttggtagataaggcacaatttagctattttgcttacctctaaatacaaaaccagctcggctggcttagatttcaaaaaaaaaaaaaacaatttagctattttagaagaaacgacagacatttcactgatgatttgccataagaagaaacaactatgtctaggcattgctctcctttaaactaatgcaatataatcatatacttgatagtatgcatcagtgagtgcatgccattttcttggaattctgaaatcgacagtttgttatctctttggcattgcagctactgctcgcatcaatcctctttttatcgatggcctggagatattcgatgagaaaaaacaaaagattgctgtaatttctgaagtctcttccccaggagagctggaactcatacaaccagacaatgtggaagtggaaaacatcgtgatagacttccgaggtggatggcaggttagatattcgaatattggactatcagcaaattacttccatgacatatgaattaatttcaattgtcatagtgagataagtcatcatacttgcatttttgtaatgcattctatgctgtttagtcatcttgagtgtctttttgtttgtgtgaatagcttatttgaattccatcaatggtttgaatgagtgtccagtatacgttttttctgtgttgttaggatcattggcttgacatgctgtactgtttcatatttgagccgcaacttgcaaagtacacttgacaaaacccaacaagcgttaacaggtgcctcctttgtcctcctgaatttcgtaggttataccagcagaaaatatagttgctgcattccagggatgtagaggaactgtattggctgtttcaacaaactcaactgaggctcaggtttttcttgaggtaactgtcaagatgtttcaacatacaatagaagttcctgtgtataatgatgtatcgtgttcctatcaattatcttttgtgaagttgttcccccagttacttagttactttacaggccttggagcaagggcttgatggagttatacttaaagtagaggacatggatgatattatcaaactcaaggtatgtttatcacaactctttgaaatttctttggttttaaattattaaaacactgtgggactacaatggtcttgtgtatagaggcaagtaccgtggtgtgtatatatatacatatatatagatatctaaatctaagtgtgaaagtacagctcctgttattgttactgattatcatttgtctgattgtacgattcaccagatgtttgtttgttctctcctcctttaatcactcaggattattttgacagaaggaacgaggcaaagagccagttaatgttgacaaaggctactgtgtcaaaggttgaagttgttggtatgggtgatcgtgtttgtgtggatctttgcagtatgatgcgacctggtgaaggccttctggtttgtgtatatttctcacttgttcactgtagataaataaataattaacatatatcctgcagtacagagttggttaaaatcgttccacgtgaatgtgtcattgtgcccccaaatagaaccgcattagcattttacctgtcccaagcttcaccagtctgcctctacatgatgttctattttcaggttggctcctatgcaagaggaatgtttcttgttcactctgaatgcctggagacaaattatattgcaagcaggcctttcagggtcaatgcggtaagatatcaacaacttatgttgcagcaagctattgcaggtatcactgtacaacaagagaaactaagactaataaaatttatgtgttctccattcagggccctgttcatgcatatgttgcagtccctggtggccgaactagttacctctcagagctgcaatcaggtcgggaagtaatagttgttgatcaaaatggtttgtggcgtactgcgattgttggtcgtgttaagattgaatcaaggcctctaatccttgtagaagcaaaggtacataactaacaatgatctcccttcaaatgattgctgtacattcatggattgtcaatttcatggcgtatgggcttgctgcaggagaacggtggagatgatacttacagcattttcctgcaaaatgccgagacagttgcacttatcactcctgaaaaaggtaagcccatatggacaacttttgaagataggactgtaagttttgagctgcaactataataagccataaatttcagttatgtttgaatgatgctaatcaccatgtgattagtacacatattcaatcaactcattctggaaccatatgattgttttatgtaggatctagtggaagaactgctatacctgtgacttcactgaaagttggtgatgaggttttggtgaggaaacagggcggtgcccgtcacactggaatagagattcaggagtttattgttgagaaatgagactgcgtcagttattcagttacctgctagcaggccagtctttgttcttcccaaacaattcttttgctaattcatgggagtgaaaattcacaccaacttatgataggggactatctgaatcatcattgaattcgagccatgtacatctgtatatactatagtactagtaacttttaagtcaaggaggaaatttccatttggatgtgaaacgatctgatgggtctcattctctgataggatcataacattacgctatgggtaatcagtccttttcagctggttatgtctgtctcaaccccgtaatctggcaatctctttctgaaaaacagttccgtcagaatgtgttcaaagggagctgtcagatgtgaatagagaagtgcatgaacttgctatctcaaatcaactgctgagaaaacctgggaaaaatatccaattcacagtttgtcacctttcatagtgagataatccttttgactgagatcaataaagcttccattatataaaaaaatatccctccgtggaaaaataatataaggaattctggttgaatgtgacatatcctaatactataaatctggacaaactctttgtcaaacctattcagattcatagtactggaatatgtccaatcaaactaaaatccattatattttagaacggatgaagtataacacagtgagtacggttctctgcatcatgatcccagcatggcagagagcagcgtgaagcaaaatcaaggagaagaaatgcaaagggagtatcatagcagcaacccaggcaccagaattcggcacccattatctcggcaaacaatttacattataatggacgtcagattctcgtgtcacacagataaaagaaatatcactagaaacagaaagttcctcgagaaaaaaaggacaaaaaaacactgcttacataacaaactatacagccgtgcagataaaagacctcttctatgttgcacttctagtgcactttggcagtcctatatcctggcaatggggatgctgctgctccaagtgagcgccgtggcgatggctggattctcatcggcgacttagggacggcgtttgaggttctccggatgtcaacctgtggtgaagccatattatatttggagtcctgcagctgctccagctcttccaagacctcagacatccgcgggcgcatcttggcatcattgcagatgcattgcaaggcgatgttcgcaatggcgtgggcgcctttcttcggatattggcctcccagctttgtatccatgacacggtacagcctacgcttgtcgcccaagtggggtttggcccagtcaactaggttctgctctatgcctggtttcgatttgtccagggcccgtcttcctgtgagcaactcaagcaacaccacaccaaagctgtagacatctgcctttgcagagaggcgacctataaagttttaggttaagtaacatgagaactggttgctccagatataaaccatacaatatctatttaattgctacgcagagtggtacatttcctcaatgaaaagattagtttgacttggcatttgacaatgtgccaggaattcagaaaatgaagacaaaataaaaggaaaggtatgactgactctcctgcgctggaattaagggaaaaaacatacaaaatatgatcctttgaaaaatggtaacatgataataattttttttctaacttaactaatatagtgatatgccttctgttatgtatctgggcatttggcaatatgcataagatgctttatgcagcaagataaattccagtgagcttgggaaatgtaaagcaatgacaccaagcttcattagcaatatttttagataattcaaagcttcagtagcacctggcagtcatatgtctgatcctagtttaaaccgatgctatataacagaaaagacttcccatgatttattcaaagcaaagaattaaaatttaacctgtcgcaatgtactccggagctgcatatccgtgagtacccatgacctgtgtggaaacatgggtcttatccccagtaggacctgcttttgctaaaccaaaatctgagagcttggaattaaattcctgcaattaaccaaggggaaaaatgttgatagaacatctcaacaagctatacaagcttgatgattagagtcaacattaattatcaaccataccgagtcaaggagaatgtttgatgccttgaaatcacgatatataacttggttctcagcgtcatgcaaaaacgacaagcccctagcagcacctatagctaccttgagccttattgcccatgacaaaggatcagcacctcctacaagaatagaaaaaaaatgttatttgaactatgtgaacatttaagacatgagaaaccaggaaatcaagaaggcataaatatttttaatagagaacatacttctgaacagatgattctccaaacttccctttggcatgaactcatacaccagaagtcggttgtcgccatcagagcaatagccaatcagcttaacaagatttttgtggtgaagttggccaaggtagttaacctctgtctgcagcgtaaaaataggaataaggtatcgtgaaatatgtcttaagagaacagcagaaaacagcggtgggtaacattctgaacctaccagccattccttgtgtccttggaaaccttctggtttaagcttcttgacggcaacaaccataccacttcctggttttgaaggagcaagcgtgtgttcatcaatccaacctttgtagacatgtccaaatcctccttcaccaagaagactgtccggtcggaagttctttgtcgcattccttagatcattgaacgagaaggccttcaaatttgaagatgacaaaatttcaccttccgtccgaggagtaggaagctcacttctgtccttcatagatggcagagtcaaagtcgagcgacttgaattgctcttaaacgtggaagggacagatgataaacttgttttgctggtcacttttgatgggtctgctatctcaacaagaaattaatgaaatgtgcataagaacaacttgttattaacaaagcaatgtgaaattcaaaatgtatccaaaagcaccgcttctgttcaaattcaatcagaactctgcatatgtatggtcaggtcgtcaggactaccaagtcagattttcctgccattcatttaaagaaaatatccgactccctttttacaacaatagaagcttatgatatttcaatgaaccctatttctatgttctatcagagtcttcctttggtccttgggaggtattgagagttacatgtacctcatagtgttaatccagtctgatcaacacgaaaaattacctctgcctcccaaggactagagaaaacatgattttatccatgcatccatgctattgtttgtttactctatagaagtaagaaagaggaacaaaaacaaaagtgaagctgcacaaaagcagcaactaacaagctaggctaaaaaaaattatcatgcaaaaaaaaaaaaaaaactaggccaacaggtataactagttgcagaacacatgctctgatcttaaaattttatcttcaacatagtcaaaccaaagtactaaacccaattcaacacacaataaatccacgatctagtaggacaaacaacccaacatcccaagcaaccaatatcagctttacagctatgataggaaagtgacaaatacatacaagacaaatttggaatttcgacgaagagagtatcaaggaaacttacaggcgccattgttcatgctgtgatccacccgcgccgtggtgtccatgcaattccccatctctcctgccctccctcttgctccttctcctctctatccaatccaccaaactatcagccacccatcaaactttgtgcctctgctgcaaatcctcttgggcactactactcaaccgtgcaatgaaccaagaaaccttctagcccaagaatctttggcagataagctctctcgagacaagggatggccaataatgcaaggaatcaagaggaacaggggctccaaatgagcacaaaactcagccaaacgagataagaaccgagcaggcaagcggcaaaggtccaatctttgcgaggtttcgatcgacctcgaccaccaatccggaaaaaaaaatccgcagagcgacaaacgaagcaaagaaccaaccaaccaaccccgaaagtcaactcgaacctgcacacgcgcagctcctcctcctcctcctcctcccaagctaaaaaaagatccggcctttcgatcgattcccgcgtgtcactggctcactgcctcacacgcgggaaggaaggaaagaaacaaacgaacccacccccaatccgcaagaaagaaacgaggccacagaaactctactcgctcatcctgaagagtcgtcgcagctgaggtcaaccagcgaggatttgagctaatagcggctgctgtggtagctgcctgccacgccgtggctgcacgcggaggaggaggagagggacgcacgacacgaaggcggcagaggcagcgaggtggatggctcggagaccgcagggagatgggagggagggaagggagcgagaagagacggagaaaagcggcggaagcaaaatcagctggctggctggctacagaccgacctaccataccacctcagtactagaaaagaaggcaagcgtgtgatgtgtagatggggctaaaactttttaagcccatgtcatatcagatgtttggacgctaatttagagtattaaatatggactaataaaaaaactaatttcataaatgagagctaatccgtgagacggattttttaagcctaattaatccataattatcaaaagtttactgtagcatcacattgtcaaaatcatggcgtaattagactcaaaagattcgtctcgcgaattagtccaaacttatgaaatggattttataattactgtatgtttaatactcttaattagtgtccaaatatccgatttgacagggacttagaataagtccctggaaaccaaacagccccttaatgcatggagaggcggtgcctttttctcctcctttctcacttgaacacacctcttgctcctccattgggaagatttacatataaaccctcacaatattcaatattcagttattttatatactagctgtagacccgtgcgtcgtaacggtctttttattcagtttagtggaagaatttgagccgattatgctgtttgggttttatactagtctttttaaaaagaatcagtttttttaagagtgaatggtttttatgggagagaaaatgtttctatggaagtggagaacgagatagaaatagttagtttttagggctgtgtttagttcacgttaaaattgtaagtttggttaaaattggaacgatgtgacggaaaagttgaaagtttatgtgtgtaggaaagttttgatgtgatggaaaagttgaaagtttaaagaaatattttgaaaactaaacacggcgtagatgtaagtgaggaatggagagaatgaagaaggccgactttctcttctagtttttttaagtagtagagagaagagatactcatatttagtcaataatccatcaaatactcttttactgcgcccgctactagcgtgagcttataacaattattttagggtagaaacgaattagttaaagatttaaaagaaattttaattttaaagttttttcaggaatactaatgaagaatttttttaaaaaaatgtattatgatattttatatatactcctgcttggttaataatctagcggattctcttggctcggtccagtaataatgtgccgatggatgatacatggaattgagtgtataatacttcttgcgtcctaaaatataataatttttagcctctaatatctatcccaaaatatgataaattattctcttctcaaccaatcacaatatttcacctcttaatttcctcccatactttctcttctcaactaatcacaaccttcacacatttaatttcacttatttttttaatacatgtgtccaacccaaaacttcttatattttgggatggatgtagtaataatttataggcgaaaattgaaaaatctaatttaaatatgttatctaagaaatacagataaaggaagttttatttagaaatcatattatttaggagcttaagaatcgtgcctgtgacaatccgtcaccccttagcataaaaagaatgggtgcttactagtgaacatttcatggttgccgaagcaaggtggtgttctctttttgcgaaatcaagcaatcagcaaatgtgtccccttggctcttagtattatatttcaccatgattatcatcaaaaaagtttactattgtactatcctaaacttttaaaatgcagacttgcactcggaattagtgagctagaagtactaaaacacaagaaagagatgagcaatgaccaaacaatcacgctgaaacctatgttagctggttaagcaagagaaataagaagttgctccagtgagcagattcctgcacttgtagcaagtagacgtggacttcatggtttcttatccctccttgaaaataaataatcagaaatgcaaacgtatgcgaatttcaatagctttagcttattctttcctaaaccgttttctattcaacaaccttatcgcatcgcttaaatactagccctagtctcctatactaattaggaaatcgagaatctgactctgccactttatttttccttttctttccccagtttcctgtccttgttctttgtctgtcttgcaagtaatccccagttttctgcagctcttggttgcttcatactcccaatcttccattcatcaattcattagtcagacacatgcttgattagctggaaatgcgtaagcgagtttaacgcttccattctgagaaaaagaacagcaaacttgtttgctttggaatacttttcagaggtgtcgttcagttgtttgttgatactatcagatttgctgtgaaggcaagatatttagcggcgtctgttctcgtgtgatccggatgctgacttcccagctaacatctgtctctacaattattcgactgattgataactgttttgaagtggcatctaccggtttttatctgtatcccgatgtgttcagactttcagagatgcaccccggatcagtcagcgtcagattagagtacttatgtgcagaaaaaactccttgcttctgtcgccgcctgacactgacaggagagtcaatgtaacagtttagataatcctcacctcaattttactacagatcgtcaaagcatttacactcgaaatagatttgtttattgtcagggttgacctgatttatggctgatgcacgttgttggacctcactgacctttttttggttgcagcagcctcagttttgttttcacagatgcattgcatccgtacttctaatactcgtcttatccaccattggaggaagaccaatctactgctattatatgaaccagattttgctgttagtgttgatgatctgaatgcagcctgaacatgcatcctacagatttcatcaaagaaaaacatagatcccacagacaggtagtccattctcataatcgcatagattatatattaataacccactgaaaattgcagggcacaaagaaagttgcatagctagagtgctagtagaaatgattctacccaaaagggacaagaatcacaaacatgatgcttcttcttctttttttcagagagagagagcaacaaaattatcttttgtttgcagccacaaacaaatcagtattcagtactgatctatttctgcatccaaccttttattcttctaggtgatgctctgtcattttttataaaaaaaataatggaagcattattacactcagcctgagaacactcccgtcctctgcagactgcaatgcgctgtgcactcaagggaatgacagaaacagacgcagatcctgctgctttgatccttctttcgtctcgatctcgtagtgtcacatggtagcagttcagtacagttattgtgggatcatatgatctcatcagcagttatcctggtgcatgaataaaacctgaaatctgtggctgacatagacgtacgtgtttggtctgttcttcaggaatggtctgtcagtttcttgaaagaagttttcttcagaagattgcactgaacctgaagaacaaaacaaattggctgcgttccatggacttggtaaagcctttggcttgattcatgtcgagtcacggggagcagcaggaatcaattccaactcccagctacggcctgatccgttcattgagcgatatgtcagccagcaattcaaagcctgaaattcccccattcctcatccactacaagacggagccaacgaaaagaaacagttctgcacgagtgcacgggtgaaggagaggatacgaacgagaatccgtcaagttctagaagatggaggttgcagaattctgcttgcaagaactttcttaagcttgtcatctctctttcttgcagcaattgccgataaacagttggcttcttgttgtttaactcgtattattactactattacagtttcactgtcactgtttccagattggatgatggatgagatcgagttgagttaggcagcgttgcactacttacatggctttgctatgctgagagaaaattttatatgaacggcaattaaacccaaaggtgctttgctttgcttagtcaaatccataaaaggaaaagattaaacaaagcgtcagagatatgctaaacaactcaccaatttaacagccattaaacaagtcgacatggagccattagctcataggaagcattaatccaaaagcttttcgacacaccgcaccatgcagttgacattgctgaacgaccacacgagaaggggcaaaaatgcagagaaaaaaagaaggaatcgaagaaagcgagagctttgatctagctgagctactatacccatggttagaccgttccactaccaccggcgtggcagcgactgacacccaatcatctggagcatcttcacttgccaattgccatcgccagtagaattgccacaaacacacacatacatttttctagattgtgcgagaagaatcagccttttaaaagtggtttaaagtttaaaggtagacatttttaattacaaatcgtggcaggaatcaaatactgttaggtgttctcctcgaaaagaagagagatcaagtggtacgggcggccatattccggcctggcccataaacattcgcagaaaaggaagtatggctcggtccacgaaatcatggggccgcacgttaagccacactccccgttttccggcccaacaaaattaggccgcacgtaagtgacagtccgttctgggccgcacgtaagtcacagctccgttatggacttacggcccaagttcccaacaactatgcccggaacggcgagtgttttctcatttcagaaagtatgcatcatcttttagcttatgcttatcggacaacatttaaattttcaattttaaatttgaaactaattttaaggttttgcatcaagtttacttttcagtctttactttagatcgctaagaacacatgatataaaatttttattcacaaattattttttgtttccatgaaaaaaccaaacgatagagctgacagatgctcacaaggtgcactcagtggcagatccaaggcccaacgatcccaactacggatcacgccgttataataccttaaatttttagtgattaacagtgtatataattgttcacatatgtgtttgttccggctttaaaaagtaacaagatgtgtcaatgcactcatctttacgaactcacgcacactttactttatcaacatctccaaaaggctagacatcagattcgtcaagattgggaaaaaaatcaaaatatattcgacttttttcacagttcttcaataattagattcatcacgattaaaaaaaagaagaagaagaagaagaagaagaagaagaagaagaaggaagtgtacacttgagcagagcaatcgcctcccagctgacctcacgtgctggcggcgagggagccctcggcggcggccatggagcggcagtagtcggcgacctcgcggaacctgggcacgctcctgaggtcgaccttggtgccgtccttgagggtgatgacgatgtcgccccactcgccgatgaaccgtggcaccaccaccacggacgtcaccgacgagtaggggaagtcggtgcggtcggcgccggagagcccggagatgacgctcacgcggcgggaggtgaagcggtaccggaggatgaaggcgcgggacaccgccgccagcgtcagcggtagccacagcagcgtcagcccgagggccaggttcgccgccaggtcgccgtagtgcgcgccgccgtcgaagaacaccgtctcggcgccgccgccgtcggccgcggcacgcgccgcgaccagacggcgccacggcgagcgcctgaggcacgcgacggcgttgggcggggcgaaggcgcttcctggatgcgcgctcgctgacggccggagaaacgcagcggaagcggtggcggcggcggcggtggacggcagcgacgacggcggcggcatggtgttcgtccggtgcgttatctctcgctggtggtggaggggagcgtgaggctctcgttctttttggtggctacttgtgtgtgcaggagtgagacacgtggcagaatcgatttgctacacgtaggcttcatatgtgctcatggtcatggcctcgtttggtgtcgtagtgagttctcttctgtgggctgtgtttgctcatccgctagcggcaatattctatatacagttttgggcctcaatttcatccataaaagctcccaatttcgtccaaaagtttggcccgaaaaagatttcagaatggaaactgaatgtagcgtagctctaaagatcagcagaagaaatgtcccaagaaaagatcaaaatagatgaacaatgaagggagaaactactatcatcaactccaactccaactccaactgattgtcattcagaaaggaagcacctcacacaaggaaaaagcagaactgctgacccagatcgattacaacaatttcggagaatattggttcactttttataatagtttcgtttgtttttttagataataatagtttcgtttgtacccacatgatacagagcaatacccatacatagcaatacatagtggcctgtccgtcctataccatcatctacactattccagatatcacattatcatcatacagtgaaactgtgaaagtgaagtgaagcagtagacgtaagccagctagtctgcccccaacttactttccatcacagatcattcgtaaactgacaaaagttcaccaacagtatcatcgcaagattgtcagagaccgatcgatctgcagaaaaaggaaaccaactttttttccctggaccctgacgacgagtcgacgacgaccaaagctcaagtagtctccttaccgtttttgatgcggttaccacacccccacggtaaggtggttaccacagtaaccgcgtgattaccacgagacataccgtagtttcaaaaattgaaaaggttaccgtgtatagtaaccgtgtggtgaccgtgcggtttcgtaaaccctgccccaactgcagccaggtagtatccgcgactcagacgcatcacagcttacaattgtgaggcgacatcgccctgcacgcgcatgtgcgccacacctgtcgatctccccgtcctcctctcccccgttgcgtttggtgtgacaccaccaacccaacgcgacgacgccgacgccggagagatcccctggaaacacttgtgttcgtggacacggatcctctacagtattacacctacgatagcagtattgataggacaatcttggttagttgttcgtgcgtatttcctccgccatcgcgccgatgatgcatcgtttacagcgttgggttgatgagaagagagatttttttttctttaacgcaaggttgcgagagagacatgattcagcagcagcaatggtactatggctaactgctttactactagtactaataaccgacctgaagtttcagaactgctgtaaaaaaaataaatgcagagttattacagaggagacactgttccgactcttgtttaatctgccattagcccattacctcgtactaccatatataaccgtaaatgatcgatctgagtatcagatcatgcgcatgtgataattaagtcgatggaaaaatttatacaccaccacgatgtctcccgttgctttcttgttttgcctggcctgtgctgtgcgtgcgccgtactgcgagtattatcagttgtcacagttggccacacatgcttctgaatctcctcctcctcctactattattcccctgaggcgacgacctaaaatactcgtactcgcgcgaccgaattgcgatactttcttcttcttctttcttttttttctagcgagatggtggtgggcaccggggctgactttagacgcagattcatgtgcggcatccgatcggctaactacccctactgctgcctgcttgttgctacaccacacacatccttttgggattatcctatgcgatctcatctgattccactcttaatttagtgtccctgatctgattaaattagcttatagcctcatctctgatgctgaatctatctcaggaacgaacattcattttcatggtgatcattcacattggctatgtaataattaactcctccattcgatcggtccacgtgtaactcgtcttccgagtatgtaaagatctactctctccgtcttaaaataacacaatctaatatgggatgtgactcatcctaagtaattttggaacggagggagtaaggttaaaccgtaactcaaacaaatggacttaccatgtgttgttgacatgatttcagtggtctcatccaaggttgtcaatatcccggttcgtatcctagtatcttacgatactacgatcctaccaagccaaaacgataccgatcccacctagtatcctaattttcatagtatctcgattctactattcattactatacgatcctacgaaatcttaggtggtatcccgattctacgatccctacgatactacaaaatattatttaaaataacatggtttgaaaataatataaataattatgctcaaatttatataaaaatcagttaaatatatcaaaccaacatggtttctcttgataaatgtctctatttgtatgacatatatcattactatattttttaatatataatggctatatataattaatataaatattaattaaacttaaaaaaaatcgatacgatcctacgatacgatattactttgaggaaaacgatattgtctaatatcccgatcatgacaaccttggtctcatctcatgacttggccccaaggacatttgcagagagggtgcacggtcagttgggcactgtgctgccacatggagatggaagagcagtaataaggtggagggccaatgggcacagaaggactgaaccgatgcaacggtttggactatacatgcccggtccttttgctgagctcattggggagcatctcgtctgcgtttcgatggggacactggagacccacgcctactcactggtcagtactactcagtactcggcatcctctcatcttttttgttttttcactttgagttgttggaataacttgtatggtatgtcggtcttagaaaggactagcataattctccgcacaaccacctaggattagagttaagtctctcaaacgtacaacatttgttatatactccatctatcccataaaaaatcaacgtccatattcgtagccagaagttgattttttatgggacggagggagtataattttatactagtaactcttatgtgtatatagttgaaagcctgaattaacaattttaaaaatacaattatatttctcagaaagtttccaataaccaaaaagaaagatcatctaattaacccaatgcatgttattttcatatttttttagctggttccacccttagaatctaaaaacactaaattttacttattggagaagaacaataatactgatattttaaattttcacaaaagccactgtaaacatagattgagggaggccgggcctctgctcgtccctctttctccatccctggtagttaatttctattaacttttgttataggatctacagatttatattttctatttttagctagatattatcattaggagggagatgagaatttttcgcataacatcgaatctttttatcttttgggacttttttttatgtgtgttttatgggcggaagcctgaaatatgaaccatttttattattttaaaaatatttatctcattcatctttagcagtgctctagcatatacggatatacccaatccatctaaactgctataatctgaacccatctgattaatgtgatcccacgaataaataagcagtgcacttctcttagagcaagttcaatagcatagcccactactagctccaattcatctatagccaatttaatagccaattcatacaatagttgcttactatattattagtatatatagtcccacctatcatacacacactgtgtcttgaagtccgtgctgcagctggctacatatctgtagcccgctgctcttctatctcatcttttatctcattaatatatatttatagctggctaatagtctgctattgtacatggtcttactataattagcaaggtcaagttccaaaaagaaataccgctagcaaccattgacatggcgttatcaaattcagtgataatta

SEQ ID NO: 44183 - DNA, 24682 bp, Oryza sativa
ttaatagaaaaaggcgaagtgagttcaggctcaactagctaggtattttgtgatgtagatttgatacgagtgtttgtattaacggttaattattctttcaatgacaaatgatgcactgttcggaaagtaagacaaataagatgacttaacctttaaggtatgcctcgacagcaataccatcgacagcgagatgattaaggtggtcttattaattttaagttatgtcggttccgtctttatgtctgtgtttgtatcgtgattaaataaaattaacgagagaggaggctataatgcaaaaggatcaatgcatgtacacgtaaagattgtgaggatgtacttgagggagtgacgtcgtaaaaaggcagtggtttttggtgccacggtggaccacagagggggggttggaggggaggatagggccggggcgcgtacggggccagaccggacacggtcctttggtttttctgcctgcgatgtgtgcacggcccctccactgctgatccacccacaagcgattgttcttccatgagctagctcagctgtggacctgacctgctgagctgaggtgacctaccctgccaatccaacaaatttttgttgtaataaaaaaaagagttaagtccctcgtcgtttgcttattaattgcattttaaaactaaattttggaactacatttaatttaattctacagttatttcttagtagtttattttttaagaattgatgctaaaccgctaacgtcacagatataaaacatttactcataaattattcagtaattacatttattttttcatgatttatcatccgtagcacgaacgatgtcacctctgaaatgatatgatatttttaccgccacaagcatatatgtacatttttttccccaatcgctatagttggtaggccaaccgtttcatatgaaattccccgtgatccaattccaaaatgtactggcgaatcaattcagttggaacatcaatggtctctgatccccctaaactcctcatatgccgtaaatttttgtagtacgaaatgatccacggtgacaaatttgagagacagatctgatccacaacgaaatcgaaaacgtaccctcgaggtacgaataaactcccggttttactggcactgttttgtgccttagctgccatctcgccaatcactttcagacaggcaaactagccaagcccggttcagtcaactgtagctgccagtgaggtgataaggccgatgcagatggcgacgtagatgtactgatgtccagtacgtacgacacactgagccaatagcaggtagaagaggaaaatatatacccatatataacttcactacaatagaaaatatataatgcaaagtttatatacagtgtaaaccctaaaaagtattgtaggataaaaagtaaaatatatatatatatatatatatcgtaggataaaaataaacgcttaagatttacgctgcatatggagtccttatttcaatatttttgttcactaagcctagttcttttcaactgagattcaccagtttattgttatggattatttactttacacccctaaaaattatgttatctaaaggaaaaaaaactactgcattgcttggaccaattgtttcgagctactatttgttaagtttatttcttaggttatttaatttattcctataattatcactataactagataattcatgaccatattctcgtcaagtaatgaaatctacaaagttttgacattaacggagagacaacttctgaataactatactagatctacatgcacaagccagctgcgtgaatcttgtagtcactagtcacgaaccaaatagtagctagacatggtaaaaattaacctaactttgttgtgtgacaaactgtggcgatgtaacaaaaaacttaatttcaaagatgaagggggccaacaagatatgtagacagagctgccaaatttaaatattgctggtgtccatgcttttctgttctttctaaatggccttgattgcattgtagggttgcatgcatgcacgagctaggattaatgcacggatcaaccacacaccgcttaatttaactgttgaaaactttggtccatttcttttccttttctaccaaaaaaagaagaagaaaagtttcttccagaaacatgtacatgtgttcttgccttcacacaagtacgtactgttcagtatgtttgcacgagcttatgtgtcaaaaacctagccaaacatcaatggaattaattatagggtacaactcaattgtgtgattgctagagcgaaatttaatgaacatttttctcaacacagggacatgatccacacagattaggggaagaaagaagaatcaccatgcacctatacacaacaaacactgcctcacaaagttcacaaatttatgtatgtaaagaaaaaggggaaaaaataagaacccaataaataaaaaaaataaataaaaagtgacagaatatactactactgaactccaaaatctaaccctacgtacgtcgttccatctcactcgcttattcatctacaagttccttcgattcgatatcctcttcaaacccaagagaaaaattcaatgcattcatcacctcaatactcgtagctagcatcatcatcatacacaaccttctcattgttcttcccaattaagcttgctcgatctctccaagaattaatccaaatgcatgcgtctgaatcttccacacacgtgcatgcgcttgcgttggtgtgtgatcatcgttaattcatcaccccgtacatactgtcgatcgcttcatcactgcaagatagtttgttgttgccaatggttgtttggttggttggttggatccatggatcgatcgatcagtggaagtgctggtgatcgggccatggccagaacggcggcggctcgtcgacgccgcagagcaggttgccgaagctggccgtgtcgacggacgccgcctgcacattgccgccgccgccgtggtgctccatcttgggtccgccggcgccgcccgacgagctgtggaggagctggtcgatgtcgacgccgccgccgctggcggggcgggcgatggaggtgtagaacgggatcatgccgccaccgccgccgccgccgccgccgccgccatggtggtggtggtgcgcggtcggggcggtgtcgagcgcggcggcgtcgggcggcggcgtgcgcgagatgtcgaggttgatctcggagctattctcgctgcggttgctgcacgacgcctccgtctccttgttcaggtttatcagctccgacgccgcctccctccccttcagcgccactatctgcattttatcacatttccttcttaatcattcagtaaaacagtactaattaacaaaagcaacacgaactagtactattagttacaaggtatatctagctagctatacttctactagtacgttttttgcaccgatcatctatcgatgcccaatcatagaagtactaattgtgctttttttttctctttctctccgggtacacaaacacgcatcattgcaaatctgattgttgagaagaagaagaagtgatctcaggaaaaaggcagcagcacatgcaacactgcgaccaggcacagagagatgcgatgcatgcccggccccaagagctggtagtactagctagtactactacacttgccaacgaggctggccgtgtgatgaggccattgactccaccacagcaaaagcaccagcagctaccacccaaacctgcactgcctccgacgatcaatccacccatcgatcgatcgatacatcgatctcaccagcttgatgacgacgacgagcacgagcaaacgctgcatattctgctgaacttttcgcgagaaaaagctatagctactgctgccgtcgtcgacgtactcgtggtggtgagaaaggcaccgattccaacaacctttctgccaacactgaaacccacatggatctccgttcctgccaacgcaggcagcagcagcagcagcagcagggaagatcgacatcaccaaccaatcattgagcttggaaagccccgggaaaattaatcatggacaaattaaacacaacacgcatcatccacgatcacgcagatctatggatcaaacgctcgaatgcgtaattggattgattttgattagttagttacctcggcttggagcttcttgttgtggttgaggagcgcgtcgttctcggccttgacggcgtcgagctggcgcttgagcgcgtcgtagtccttctccagctgcttcgtcttccacctcgcgcggcggttctggaaccagatggccacctgacgcggctgcagcccgagcgcgcgggcgagctgcatcttccgctccggctccagcttgttcccgagctcgaagttcttctccagcgtccgcacctgctccacgttcagccgccgcttcttctccccggcctgcgacccgtcgtccgacagctcgtcctcgccgccgccgttcacctcgtcgccgccgccgccgccgtcgccgtacgacatcggccgcttccccagcattggcgccatgcctcggaattcttggagggacgggcattgagcggaggacggcaagaacgggttgtgcgggtgcggtggcggcggcggaggaggacccaggtggtggtgatgctgctgctgctgctgctgctcatggtggtggccatggtggccatggtggtggtggtggtggtgttcttgcgggtcgtgaggcggcgccgcttgctgctgcgccatgtggaggaggaagttcggagggaagaaggaggaaggggaggacgccatgccattgctggccattgtcctcaactcgatctccttagctcatcaagcgaggaaggcgaggcgcatcgcgagtatttgagagtgagaactttgtgttgtgtgtgtgtgtgtgtgtgtgtgagagagagagagagagagatggctatagatgagggaatggaaatttaacaagatgttgtttatcaaaaagaaaaaataataataatattggggaattttagttttgcaaaaaaaaaatctggaataaatttattatttttgagagtatcaaaaaagaaaattgctctaataactagcagacaatattgcttaagatatatgatatgccagcaaagagtaccacaaaggaccatgcttcctaaaaggtaacccctcaagatgagtaggatggtagcttctactgttccttttttttttttgaaaccttagccagcttagctggttttatatttcagaagataagcactgtacaaatgccaccaatggtgacaaggggaaagacagggggaggagagcagaaaaaaaggaaaattacaacaaaggatgagaggttaaggcgctattctcgcaagattttttgccccacatgcggaccgaccatgtatttcgtccattattcttgccgttagttgagggatttgaagttcttttatctttgaaaactcgtctgttcctctcgcaccagatttcccaactcaagagcatgtgcagtgactgcatccccttactttgacatttgctttgttgctttgttcttgattcccaccagtcaactaggctctcgtccggattgtgcaccgggaagggttggttgtggttcatcctagccattattttgtcccaaatttctcgcgtgaatggacaattcttgaataaatgttgcgccgtttccaagttcctgtagcagagttggcaaaagtagttattgggccattgtcggagttgcaagcggtcggatgtccatatcctgttttgcaggacaagccatgcaaagtttttgcatttggatggcgcccatgtcttccaaatcaaggtggcggcccttgagtcttctctaccggcgaattgggctaagccgattttgctgtgtatttaccggtatttgtccatctccaggtgatggtgtcttcaactccttcctccaggtttgtctcattatcccagataaggcggaacactgcgaagaattctcggatcagtggcatggacagctcatgcctaatatcctcaatccatttgtcattggttaacgcatcctgaactaagcgttgctttcctttagagtggttgaaaagcgctggcgctaggtatttcagcggctggtgtccaatccagttggatgtccaaaattttgccttctgcccattaccgattgttacctttgttgcggccacgaagatttgctcatctaactcatcgtagtggggtgttgtcccaacccaaggtttgtcagggcactcccactcaaaccatagccaacggagtctcaaagctctcgcgaatttatcaaggtccaacacgcctagtcctcccatctttattggggagcatactttttccaattcactttgcacttccccccgctaatctcttgatcgccggcccagaggaatttcttcctaatcttgtccatgtctgtgaggaactgtttaggcggctttaaggcggtaaggaagtaggttggtatggagctgagaacagacgtgactagcgtcttccgccctgattgctggattaacttccctttccatcccactaaccttgattgcaacttgtccatcaccggttgcaggtgtattctcttgatgcggcctggggtgagcggcaatcccaaatatgttatgggaaaattgccccgctgtccattgaaattttccaacacctcagacaggttctgctctgcgcatttgatggacacgaccgagctcttgtgcagattcacttgaaggcctgtggcctcgccgaagaattgaggatgctaatcaagttgttggcatcattcctgatcgggtttataaagatcgctgcatcatcagcatataaggatattctgaaccgcgctgctcggtttgataacggagatagaagcccctcttgcgtggccttattgagtagtcgttgaatcgggtcaattgctaggatgaagaggtagggcaagaggggatcaccctgccggaggcctcgcctgtgtgtagttggttcttccgctatcccattgagtaaaattctggatgatgcagtcgataggagaagcacaatccaatttctccagcgctgactaaagcctctccactgcagaatttcgacaaggtattcccaagatactgaatcaaatgcctttgttatgtccaacttgaagaagagggatggtttccgttgcatgtgcaaggaccggaccatgttgcgcacatagaggaagttatcttgtatgcatatcttcttgatgaaagcactttgggcatgcgagaccaaatcaccaagccgtgctgccagtctcattgccaaagttttggatataagcttcgccacagagtggatcagactaatgggtctgaagtcattcaccgagcgtggcgagtcttcctttatttttcctttatgaactagctagtagcatgtatacatttgctagctagtactacctcttttcttagctttcttagatccctttagataagtttatacagatgaaatgaacctagttttttttttaaaaaagaactagcttacatccccttgagttggaggctccaaatgcagcagcaggattgacatggttctgggaattgttgacaaaagaatctgaaagctacattgatgatgatgactgccatgataatttacaaatcatttccaacctgatgatcaaatgatcagtagcgtatctcactcttcatcatagccactgctgccaggtgcaattatggtttacatgcatatgagatgagatgagaagaagtttggagcagcagcaagtatatgtaatagaaagccaagtacaatatatccccttgggaattattgactccaactattcgtgtagtcgaaatctttcctagacacatttattacagaactaggacatccattcatttacggttttggctcatgcagcatggttcaaagcttcaacacttccatcaatttttaggatatcaactactccagtttaatttactcagacaaacaagaaaaaggaccaaacaaactccagtacttaactctcttctggacagttatacccccaccccccaaaaaataaaataaaatatagaatggcattttggtttcactcatgatctttccttcaaaagatgctattattaaccatgcatttctcatactctaaatgaaaccataaaagttcaacgttgaaaaatgaaacaacaaggccacacgcttcatacgcaaattgcagatcgatcaacccatgatgccaatctggagtcgcatatggatgatgctggccagattgtggcttgcgttagcaaaaataaaacgattttgctatatctcacacgaaagattttttcttatctctcactcgattttctcactcaaatttacagtgcattttcttgtaagttacagtgtaatttatgaaacttacactgtaacttttgtaagttatactgtaatttttgaatcttcgcatataaattttaaattttgtattggatttggtctttttcttgaggatatggtaatttagtgtccattatggtgtttcttaattgctttttgctttttattatatctatcggattttaatctaaagattaaaaatctgtgtgatacgatcataaaaatctttcgaaagatgtataggtactcccaaaataaaataaaaaattaaaaataaaaggaaaaaaaaggacacggagaaatggatgccagagagagggagagagagagagaaagagatgtgcggtacgagccctgcaccgcgtgttgcatgtggctggatccagcccatgtcaatgtcgcgactacgtggccccctccccaccgttgatctccttgatcttttctctccgtgccagcatcagcatttgcacgctacataagctcagtttttgcgcacaaacacgcacagatttgtcaaattttatctttgggagaggttaattaattaacactagtgggagaagctttgcatttgctatggccatagtatatatcaacacatgtgcaatgcagggggctgcaaaacagcggggccccacgcacagcgagacgtgcaatgtacgtgggcttggggggtgtgtggggcccaccatttcccctgccccctgctaatgctaaccatggtggccctggggactagttggcctttgtgttgggaggccagcccggcacatggccttgttagttagaggagagatcccattgcccatccatctccttccccttggacccttcccctcctctcatgccatgctcaaatgcctcctccccctccattttccacccccctctccctctccacctccaccaccatcaccaaatatctctctcccaaaatgcctatgctaaaatcgaatcttttggttcggtctcatgcgtcgcggtgtaaaatcaatcgggttaaccgcatcgcgcgtcggctgtagatgtttgacgagaatgtttgtgcgcacggtaaaattttgcccggtaccgattgacgttattgaagatatgtcgtggtagtatatctagagtaagttttcgtgcgagacgtgtgcgtgtagccgacaggatcggttactcttaggccccgtttagttccccaaatttttttcctaaaaacatcacatcgaatctttagacacatgcatgaagcattaaatataaataaataaaaaaactaattgcacagttagggaggaaattgcgagatgaatcttttgagtctaattagaccatgattagccataagtgctatagtaacccacatgtgctaatgacggattaattaggctcaaaagattcatctcgcggtttccaggccagttataaaattagtttttttattcgtgtctgaaaagcccttccgacatctggtcaaacattctatgtgacacccaaaaattttctttttgcgaactaaacgagccttactctacaatttgtttttgagggttttatttgcgtggtggtgggtgtgtacacaccaagccgtttggaaccttcccatcctcccactctcacgtgccaaccacatcttccgttttgcaaaaccatgttcacctcctctcgaggtccatttttctatgcgatccacttggatccgtccatgatcctctgctccttttttcttctccttttcccatgatagccggcgcggttgttagctgtgtgtgtgatgtgaagaacgttgttgctgctactatacatgtgtgcgtgtgcggtgacagatggtggaatgtttctgcaggtggtaaataaataaataaaattatgcgcacaactcactatttatctatcgttgttactcacgtcgtccagatggttgtcaagtgtcaacgcaacaaaacaattggatccgtaccaacaaggcaacaagccaactgtgtacattcatcatcttctttcgtactccctctgatgtttgtatttattactacatccatcctataatagttacatttctaccatttaaattttttccaacaaaaatatatttttataagatgtgacacaacaaaggaaatgtgtgacccaatcttccttttaattaagtttgcatatggaatatgttcttcaaccttcattttaatcaagtatacatatgaattatacacatgtagtgtagttattaaatagggttattgtggtaaattatgtttgttgttaatttgtttctaattatttccaaattttagtaaggctttaaattgaacatgtcgaacgctacccaaaatttggtcaaaatgtgttagggttaaaagtggtgaacaagcctgtaatagtaaattttctttggcaaaattggttatatagcatcaaaagtttacttttttattttatagcaccgaaagataccggttcactttaattgcacccaaagttcactttgtttccatttttaacacttccgtcaattctcgatcgttttccatccgccttaatcgctattgacccagccacgcacatgatatgacgtttctacctctcacaaatacaagtagaatccatggcaatgaggggtagaaatatcatattgtgtgcgtggctatgtcaatagcgattaaggcggacggaaaacgatcgagaatcgactctagtggatcccctgaaaattgggtgaaatttaggtgctattaaagtgaaccggtatctttcggtactataaaaaaacatgaaatttcgatgctatttaaccaattttgccttttctttccctgaacaaatgaactccattatcctgaccttttatagaattgagagaagttgggtgaaccacttaaaaaacagaagttgggctgagcccgaaaggtatggtctttgtgtagcctgaaaagctgagaatatttttgctgggctgagcctggaactaagcaatgtgagcatagcagctcaacagctagagactatggaccaaaggaaagtgtccccttgttgggcctggcttaaactaatagtactgttttctctgttattcctaagagtaatattacctctaatttcatgcataccatgtaatagtaaattaagaggtagcatgtattacaggttgtctctaacacacaatccctaataactttaactcaaaatttttattggagtttgtgtatggactgtttcttgcatgagggatagcactttcttctcttcacacttttctcttccaactcaccatttagtcttatgtgatatcttggagttttagtttcgatgttcattgctctaagatttccaatggcatcgtagtcctattatgtactgaatgtgcagtatctacaggctacatatcagcttgacaatggatgaaattaccgtttctgtttgacactttaccagctcccaatctcccatcaactcatattattactgcttgctgacactttacagtctgtattatacagaagttgaacttgttgtgtgcctaaagttgcatgcgtatatctatcgatgtgcaagtgcaacaaaaaggaagctccaaagccagtgccctgcgaacagggtcctagaatcaagggggacaggtgaagcaaacgaagaaaagatgcaacaaaaaggaagcgtgatatttgactaagaaaaccacaaacattgctgaaaaggagttatcttcagccacagtagttctcactactcactaggttaccaagcaaccgaattaagcaactttgcagcattttgatctcaaactaattaaagccgctcatacttacaagatgatctagtaacatttgatttttttccctccaaaacccaggctcccaagtgagtgtgaatgttccaaaaccattcatttcagaacaagaatgttccaaaaactatttatttgttatgctttttaggtcaagtaattgacaaattcaatcataccacccttatcacctcactagttttatctccccaaaaatactaaaccccatgaaccccaatccccatagattagtatccagctcatccatccactacttaaattaggaatacttgacagaatgtttctagctaattaaccacactcccattgccagtccagagcttaggagcttcctcacattgccattgccatggggtgcaccacctccaggcaagcccggcacgacctccgccattgcccgtcgccgctcgcgctgccccggtgccagtcgttccccgcccggtgcgccggtgacgccggcgtccatgtcgtgcggctcacgtcgaccacgcttggctccctcgaggtcgacaagggcgcgccgcgggcggcggaggcgccgccgatgaggaggatggtgccgcgcacgccgaccatgacgccgccgaacgagcccgaggccatcgacgcgtgggcgctcatggccggcctcgaggagcactcgccgctcctggtcccgccgttcgcgcgccactccttctcgttcccgatcacggcggtgcccccggagctcgccgctgcgtcgcgcaaggtcacgccgctgccgctggtggagaagaagaaggcgtcgccggtggcgcgtccgcgcaagcccgtgctctacttcacgtcgctccgcggcgtgcgcgcgacgcacgaggactgctgcctggcgcgcgccatcctcgggggctacggcgtgcgcgtcgacgagcgcgacgtgtcgatgcaccggggattccgcgacgagctccacggcctgctcggcctcggccgtggcgccgccctcgccaagtgctgggcgccggcggcggcgcccgccctgccgagcctgttcgtggacggcgagctcgtgggcaacgccgacgagctgaagcggctgcacgaggccggggagctcgcggcgaggctcgccgggtgcgagagcgcggcgcccggcgaggccgccggcgcgtgcgaggcctgcgccgacgtccggttcgtgctctgcggcgcgtgctcgggcagctgcaaggtgtacgtagacgacggcgacgacgacgacgagaacccattggacggcggcggcggcgggggattccggcgatgcacggagtgcaacgagaacggcatcgtgaggtgccccgtctgctgctgctgagacgtgacggtgcaacgtggcgccacttgggtgtggtgctcgtgattttgtgaatgatggtgtgcgtgcgtgcgtgtgtgtgtgatcgacggtgtacgatgatgatgattgttgaaattccgtttgtagccaacggctgtgatcgatgcaaccaatgcttggtgattcatgtgatgttcctgagcacaagtgatttctccatgagacagaaccaaaattcagacgagtttgcctcaaaaagaggcagaattcagatgatttttgggctagatcttgccggccacgacggcggcgaactgcttcctttacgcgtgaaccggttgcctgcgtagcgggttagagttgttggcaatcatcgtagcaagctagcactagcagcagcagacagtagtagcatagtagccttcgttcaaagccggcgccgtcaacaacggcgttttaaatggcaaagcgagccacaagaacaggacagttggagcaaaacaaggctctccaatcaaaatttcaaaacggacccaccctaatctctagaccaatcatcatcgtctactcatctactactagtgctacattcttttgattggagtactgctcaacatctccaaatttggatagaagaatttatagctgaaattaactagaactccctccgtcccaaaaaaaggcaagccctgatttccgtgctcaatgtttaatcgtccgtattatttgaaaaaaatataaaaaaaattaaaaagacaagtcacgcatgaaatattaatcatgttttatcatctaacaacaatgaaaatacgaattataaaaaaatttcatataagacggacagtcaaagttggacacggaaacccatggtttgtctttttttaggacggagggaatactacaaagtttaatgttttctttaaaaaatattttaagaaaagatttatattttttttgtgaaaatcaccgtttagaagcttaccaagcacgcaaacaaaaatccaaaatccataataaagaagaacatggccataatgtaattggctagagttgagcagctcatctattaatccattcatcttcagctctttacacataccttgagtttgctagagcaacctgtagaatcatgtgatgattaatcttagtgatgaataaattgtcaaaggtgaatgttttgaaaaatacggtgaatactgaatagtgtttcctgtcaatgaaccgtgcatgttggtactaggttgtcgtttacactcggtgaggcacgccggtcagtctggaggtgtccgggtagcccgacggtcagaccggtagactccaggagggagtcaatttcaagttgttttcgtggaacttctagattgctttatctttattacttttagatggtttatattcgtatatggatcaggactagacttgcgagaagttaaggtctataaggtccatgatatcacgcgggatactcaggctagagaacaatacacgtgcatgtgaatgtttccatatagcatatacgtggtgttgtgtgtgtatgtaaagaggagtcaaatttaaatttgagttcaagtttggaaagattgaagtgtggagttgtatgaggatgttatttcgttggtttgttaaatttcctatgtttaagagtctagttatggttggattcgtggatatggacagccacattgtgggtataaatcgaagagagattgatgctagaaggatatcgattttttgggagaaaaaaaaaggtttgctttgaggttttaatcctagttctaagttgagagagagagagagagagagaggtgatttagatacattttgtaaacacatattgatgcaacaaaattgatttaccttcaagagtttcatcgatatgtgtttttctagatcctgacgagttggccagggttcattgtgcggtctaaccggcgggtggtcacaccgacagcagggaggcggtccaaccggcggcaaggctgcggtcagaccggtggcaatatggcggtgcgattggcgcaatttcatcaagtttgagggtaatcttttaattttgctaaaagttttaatttttagtgttcgaaccattcacccttctctgattggtttggttgtagtatttgattctacatacacaaaagtattacacaacacaagatgatgatgatgatgatggaagctcactttcacttagttcactgcacttctcctgaccattcattacacactaattaccaagcacactgcacacacacacaacacaaaacagttttacagttccatattatctgcatgatctgcttattctcttctaccgaggtggcaacaaagcgtgggccccagctgcagggccacctcaccccttcctaattaacagccttaattaattaattaccctatgtaaaaaaaaagagggggctcctttgatccattgcaaacgagaactacaaagctcaccacttccggcggcgctgctccggccgccgccgccgccgcagccggcggcgagagcggggcggtcagtgaccgccgcccatgctgaccgaccggaactggcgcttggagatcttgggcagcaggaatattccggcgacgccgccgatgagcgcgaatcccgaggcgaggccgaacgccgggatgttccccttcccgaacagctcgtcccacggcccggctcccagcgcgatgaccacctgagggaagaacaccacgcaaccatgaatccatgagcattcaaattctaataatccatgaagtatatctgattcggtttcaagggaaacggattagaatttggcagctaattaacctgagggatgacgatggagatgttgaggacgccggtgcagagccctgcagatcgccatggattagaccagcatccaaacaacaccgaattatgtcaagaaaagctgcaagaatgttgggattcataccttggccaccccctctagtggccgctaattgcgccgtcactgcgaagggaacactgtacagaacctgcatcgcgcaaattttcagacagttcatcaggataaggcattcttgaggaaataattttttttagcaatgtgtttaagttgaagtgtcagtgattcttacggcgagagggactccaagaaacgcaaagaggacgaggcagacagccttgatgctcttgtctgcagtgatggctttctgaacagttccatggaagtccttgagtgaccagaagctgatcagtgcagttgcagccatggcgatgcagacgaggaaattgctcgtcacccacaccacccttggcccgactttccggcacattggttcaatcaagaatgagctgaatcctagcacaatctgcacgatcagaagcccatggttagttgctgccaaagaacatggcttgagtgttaaagatttgacagtagttgtggcaatcagaattcagaaaccaatcagatcttaccgaattcagtagcaggccaaatgcacctgccctgacaccctggttgaaagcctcgatctgaggatcagttccctttgggtcaccgtggtagatctcacggcccatccagtcagtgtcgtagaggatgaatgggaaccaagacaactacaaggacaatcatatcatagaaaaggtaaggtactataagatataactaagatatgatctagtagcaattttttcaataatctgaaaagttctttttctgatgtatattgcatacccaggtaaggccagtcacaataagcacagaaggcatcccagtaggtaagttcctgaagcctttcaacactgctagtggaccagtgccttcaggctcagctggctcgtttgattttgttgggagggctgcatttcctttgaatggaacttccttggcaaatatcagagttataaccaagcacagggacaggaaaatctgaaaacaggggaaaatgaccaaacaagagcatgttaggctgtgaaaaaaagcaaccaatatgacagggttgaaaaaagaggaacagcaatacaatatgtaagttaaattactcatactcgctaaaatattttcagtatagtactatcttattacaaagactaatattagcacattgttaaagtattatcagcaggcagtttatgaggtaataacagaacttaccacagccaccagaaatgcacctttcaaatttgcacaagcttcacagcaagctcttgttttaaggaatggaaaccacctgcgcaattaattagggagaatgcaactcaatacttgtaaacaaatttcaccttctctactaatgtaatatgaatttcacttgccttctttcagaaaagaatgcaactgaatagactgtgctaaacagaaaatctgtatgaaactgatacataagagtaacttacttgtgccaattgtttgtggaaccagaggagtatcctaggatgtttcccattgccatccaagaacagaagatggagttagctgtgccaggtccatgacgtcctacagaacgaaaattaggagatcaaatccaaaatcccactgataccagaagcccagaacacaagggcaacttttttttttctggaatcaatcaagtgttagtgaactgtggaaaccaataaaaatttggtagttaactctgaaagacaaggctatgaaaaattacctgataaatcagccattagagcacgtgctggaccctagaaattgcattgcaaaattaagatttttgttatgattctttgtacaaatttctttaacatgattattatatagtaggcactaacctgcacagtgttgttggaaaaatcaagaagccagaatcccaggacatatacaatagcagcatgccaccgtgatccatggtagacactgcattacatggtgtatcagataactgttatctgctaattatgatacgcaaaatgttcagttacctgcagtcttcctttgtatcacccatggcgtatccaatgtcagctgaaaatccaataactacgacctacatacataaagtgcaatgtcaatatgagagaaaatttggggacttcaacttaaggaataagagttccaaggttcagtggttcttacagccaagcatatcaacacacatcctgtaagaatatatggccttcgtcttccccattttgaggtgcacctatcactgtatagacccacgcatggttgaacctgcaggattgggagatgataatggatcaagaattaaaaaaaatatgacttgtacacaaacattttttatgaaagcttatgaattatgacagtatgatctacattacacatatcagaagctacagaaaatgcagcttcaaactctgatagatacaggagttcaggatacccaagtttttgttgtagtgaagacactaaagtaacttgaatttacattgcagaaagtacagattccataacatgaattaatttgatttattttttttaaaagagggcaaaagctttgtctcgtatatatcgatagagcagataatttggtattgttacttaccaccatgccagcaataggaccacagagccacatgaatgaagtaagagcatgcgacagtccgagtgtctgtaaataacagaggttagaaaatcagttgttttggcttataaaaaaactttgactgtaatctactctgacaatagatgatcatgcttcattccttaaaaaaatgactatgtttgttgagtttgctgtgtcaacaagatctgcatcactgtggaagatattcagaaacatcagagagcgtgtaccagttgcaaagagtgaacacatattgattaccacacaataaattttcccagaaatttagcagatgaaatatccccagctctgttggtctgttggttccaggatgcattgccttgcatgctacaactaacagctatctatccaataacttcagatcacacttctctttcccccatggcatgaataaacatacaaagactgttcatcgttctatatatgttcagtcactaaatttatttcacttgtcaaatataagaagaagaatcttaatagttaaaatggcaatgcttggatgctaacatagcaccaacaggctatgggtacatgatgatctgccctcatttgcctatgcaattgctctgttgcaactgtgccacagtccacaggacatatatatctgacctagaatttccttgttttacccctttatttttcatgtgcgcggttaaagtgggttggagttgcctctacagcaaccatctttatggcacttggctcgagaaggctaaggtaaggataaacttcgccagaaatacttcaatacaacagtaggtagctagacctgatgcatggaccatcaggggtgatgaactgcatataatgttctacagaaaaagtacagaacattttggaacactttgttaattagtatggactgatacaaagaggaagtgaggagctgtttattcctgtcccctgctgttttttggttttccctgtacagaccctttttattccccttaatacaaaagtgccctccttacgtatttccgaaaaaaaaggagctgtttatctccgctataaatccttcaaataaacgcctggaaggactgagatttaagtttaaccactaagaagatcgtctttgtttagaatatttgacgacagagaggcaaataaccaatactctatctctccggtaataaatatttgatgcttacgataaaattcggtcaaaattttaaatttctgaccattaattttgtactatagtaaagttataaaatcgctccacttgctctgtcttaaaataaaagtgatgtttttcatggagactaggctgtgttcttttgtaatgattgagaaccctttctcccggtacacaaaattgagcggtagtttagcacataattaattaaatattagctaaaaagacaaaaaaaaatatattaatatgttttttaaaccatataaatttttagtagaaacacatcgtttggcagtttaggaaatatgtgtacgtcaaacgaagggagtagaagttaggaaatggaagaaaagaacacatcttaaggagggagatgaagctaaatgaaggatgatttatatatctagcagtaagaatattagtttcatcttgcggttagtatggaatagaggggagggacccgtcatctgcctacctttaactgcgcgcggaggaacgacagattaattctccattattaccgctcacttttgcccttgtctgcttatttttgtttacatctctagctattagtagctattaacctaatacgtggttattacaagaaggataaggtgagttggagcagatgtatatttttttatggcactgtacagcatctgaggtaaaatggaattttaaaaaaaggagtgtcatatctgagataaaacggaatcaaacagtctaattgaggtaaaatggaatcaaacaaggagttgagaaacgtgtcaagcgtaaagtgaatctcggtacagtagaccggtactgatgctaagtgtcatgctggctagcctgattgatccaaagtgcacaaaaagaacttataaaagattttgattcttatataggtatacagattcttcagaaaagaggcagaaaacgccgacgtttcatagaggaatcgagaggatatgaatcctctagtgacaacaaaaagaaaaaggaaaaaaaaaggaaaggaaaaggaataactacaaaatgacaaaaatgatagctagtgcatcaaatgcatatttggccacatgtatataaacacatgagcaaaaaaaattacaaaaggcatgcagattgaatttattacggtacttttagacactagtcaaatctaccgttcaaacaaaaaaaaataaatctctccccacacatgaagaaaaattccccaatctttcaagatatatatttttttaacgactcacaccagacagtgcgaagtaaatattgacaaagcagaaaaaaattacaagattataaccttgaaaagattgtaaccaggacatatataatctactaccatgaaaccttgcagattagaacagctagcacgagcaaaaactcgcgaacaaaatcaaatccacacgtgagatacttgtatatattttttgcaggattattcagagtttcagatgcatgcatgagagtgtgcaaaatacacaggagtacagtatatatatatatatacctggacgtagggggtgaggagggagagctggagcgcccacccgtactgcacgccgccggcgaccatcccggagaggatgagcctcccgaggctgatcggcgccgccgtctccaccgccgccgccgcctcaccgccttccccaccacgcgcgccgccgccgccgccgaccccgaccgacagctccagccccccgccaccaccgccgccgcctcctccggccccgctgccgcgagccatggcggacgcgccacgcacaaacacaaacctgcacacccctgtgtcagaggaggagaggccaagaaaggaaatcgagtggaggaagtgaggagcggcggaaacgtacgaggaggagggggagatggaaatggaaagccgcgcgagagaggaggcgcgtgctggatgggaggaggaggagaaggtggtgggtttgtgtttggagagacgagcgagagaggcgaagcatttaaagggaggaagagggggagagagagagagagagagagagagagagagagagagagagaaaggaggaatataataaagggtggtgcacctgccaactgctatgctcaccaacactttgtacacacccagttacacccccctgcctttattatttccagtgcagtaataacttcaacaattattgaaatgaaaatggaattaatggagttagtatcggattagcgacacgcttgccgagcttctagacggtgcgattatttcagcgggaacgactttctgtaggtgaatttaatagaggagtgttttaaatccactcgacgttgtaatagctggtttaattcgtttgtactgtcgagtagttatccaaaatcaattttggatatttaaaagaaaaaaaaacagatccgaagtattggacctactggcaaataggaattttgctatatataggtgtgcgttcatttataatggagtagcatggagttttattaatccagtaaatgttttcattgatttaattaatataacgaatttcgcttgaggccatatttgttaaacgcttttatctctatcatcattcatcctaccagtaaagagcaccggagatcgcacttcatttaaatatatgtccatgttggataaaccatagtttattatagtgttcttttatatgttttgtggggaatttagattgtttaatatggcatacatatccatccatcattattatattctaacacaactggataagtgttctaaactattgtagaataactttgtagtatgatcgatcttgtggaataaaaaaagtctgacaataacctttcataaaggaatatgaatacccgtaatcaacgcatcaaatcattcacggtgtacgcctagcgaattcgttggcgagtgctcgtgcggccgtgggctcgctgtgatgcatgcatggctctctggctacgtcgagatagcgattagtagcaaaattaagcaagccacttattaattaatctttggagatatcatatgattaaggcattaattcgtacgtactcgtcgtcagcgttttctgcaaagtccactacagttttttctttctttgctgaaaatgctgatgtgttggagatggagtgacgtgcacaacctgccgccacgtggatggttgctggagcctacgtgtcatcttaatttgaacaaaaaaaaaagaggaataatacatcaatacattttcgaatttcagttctgccattgaccagtaatacacatgtcggcctcacattttaccctgatcttagtaacgggtggtcgcctggtcggtcactgaaaaaagttcaggaaattatagtcaaactgaaacgaacatattcactccttaaaaaaactaaatctttttatatatttgtgatattgtaaaatagctacgggataatgatatagatatatatagtgataagggatagatggatcgagatatggagttgtgctttctttaatttccactacttgggctaccatattatggtagttggtatgaaaagatacacagcagtatagtgatgtgatcaatgacatgtatatctcacatgctcccatgttggagtcaaattttgctagactaaaatccaattccaagcagtccctagccaagaacaaacaaaattcagtgaggtcactgctgcaccaaggactgcatgcatgcaggagaagggcattttctcttttttcttttggagactcgattcaattcggtcggtcggtcgcaatggtcagcttaattaaacgctacttttagacagtttgcatcgggttaatacagtgttcatttcgtcgtttttgtcccaattaatatttcttggcatttgcagtagagtctataattcgtactactgaacatgcatgtttttttttctctggaaaaagagaaaaccacgtcaatggagatatgatgccgcggttttgacattgaagttttcggaaaaggtgtgagatatgatattgttcttgttgcacacacctcctagctagctagatgtctgacggagttgtagctagatgcaaatatatgtgcatggtaaagtgttgtgcagatatagagctatacatgggctatcagataagagagaaatatccaagtccatgcatgcagatataaggctatgcttctcgatatctacatctacaaatctgcagtatggacattcaattccttctgaagcattcagctggaactctatgggagcctgcacattgattccctaaagcgatactcctatataggagtatgcagcaaacctacacataacccatactactggaaaaaaggtggcttgtctaactgatgctgtaaaatgaggagatgcagccagattgtctgaataattcagtaccgcgacagtgacaatttgttctgtgcccggccggtgcagtgcaagcgaggaatgtctcttgcttaattaaacaattcactcagatagctgcatgacatgatccaagtcaacggggattggaaggtaaagaaagacggaaagtctctttctttctccgatgcgtatgatcaatgaacaactgacgacgggttggtcaaccacatcatccatgcatcc

SEQ ID NO: 44184 - DNA, 4396 bp, Oryza sativa
ttgaagtttgagagtggctttataggtgtcaaagtaatatctgcaagccacgtgaaggcccaaagaaattaaagtaggtggtccaaaagggagatggagaaagagcgtggcgtctcaggaaattcacaaacgagcatgctgcaatcgaccatggcccaccaccgacagatccggtaggcatttcgtggagccactgcaacagaaaacctggtgccatagtcagatctggagaacacttgagaaatacgtcatcgttaaggagaataaggtcatggccatggggaagctgccacgaggacgaggacttggcagtggacgaatccgatgagcacttggggatgccaacgcagccaaggacgtgtcaattgaggtggacaaagattagtggaggcgatgatgaccggagataccaaagacattggagaggacgaagacaatagtgctggtgagggtgaggagccactgattatgggttgggatggtcggcgaagactggggggctatggagattgggttgcgatgtttggcggcaacaggctgggacatatgacggtgttggggccgaggtggcacgatcgcgatggggtcatggatatatagggaatggggaaatgaggaagggaaagtgtgtttgagttgtttataaattatttctttccattaaggggctagctacataattttagacgattgtgtaacaaagcaacttacgagataaataaattgcatgattattcccattacctacccaatgaaagatatatattgtaaattggaagatggtcgtctaccatatagttatctagttgagaatatgtttatttctcatgtttatcccgctttatctacacatggaactttgtatgaatcctcgtagtactaagtagtgccttacaagctagccctactccttatttgcacaagatctatatggtttaccaaaccggcatagatatcatatcattttctatcaaccatgaccatctttaaaagccctagggcataggtatacagtgaaataactgggagacaacccattcggttcttgtcaccaactacgagaagcttttgtacctacgtgtaatgtttacacgtgtcgcacacacgagaaccgaaaaatattcgataaccgcaaagagatggagggctatgaagttttactagtttattattccttattaataagaatttgatacacgtgatacgacgacgatgacttactactaagatttgtggatgtcgtattttttttctcatagaaatacaaaaacgtatcacccactttctacaatcggtcttaaccgtacctttggatccgaacctaatttttttttctttatgaacagaaaagattcattgtatctcaagttggaggtcttctcaggagaaattcgaaacgaaacgtttattgtgttgaagcgtgtaaccctagagttccgcaaaagtatgatcgattcttaccatcaaaaagtcctttaatttgaatgtctctgataggtccagatcctatacacccttggatcttttttcctttgagaactatacacccttggatcgaattggttttggccgaagcatatcgaaccagtgaggcagcctatacctgtatggcctgtattatgagcacagtgcagtgatgttggcttgatgtgctttttgaccgcgtggaatgtggatgttgggagggcactgattgatggaaagccaaaggatgctgtaagaagtgctcttaggatcggatgctgcaatcatacagaagactttatatattatcatatacatatatatgcgtcgtgtacatgcacctgccacagggtaggtgttgtcaacttcagacacgcccctatatcccactggcctagatccatccacgattgatataccctgccaggtgatcgtgttaccccattcttctcttgaacatattcgtatggtcgatcgatggatgtgtacgcagacgcagagtgtgtgggggcgcggcctttattcctgcaaatctcctaatcgcttcgtacgtcgtcaccgtgcggtgtgtgtgacaaatatgacatgcctggtactagctggtgcctctcctgccacggcgcgagatacgtacgtacgcaggcgggcgaccggggacgcgcgcgcgcggcggactcgccgaccaggaaggccacacgtagccacgtttcttcgtacgcgcgccgcgcgcggccggttgggtacgtaggcgcgcggtgggcttcactttcactgcaccggccggcctcgctcgcttcgtcaccccgacccaaaatctcccgtggccgggcagccggcccgtgatcccgcgcgcaccgttccggcgtttcggccgatcgacgcgggagcgggagcgggcgcgcgcgtggtcggtggtcgcgcgggcgcggaaccgcggagcccagattttctcccgtgacgggccgtgtaccgctcgggagtgcgggcagaccgaattttttattcataataattaataatgcagaaattaaatatataataaaacaaagtcaatttttacgaaaataggaaggacgctattgcatagggcgtccaggtgtggacgctgttgtagacaacatccagatggggacgcttcttacaagggcgtccataatgctgcagttgaagacctcaaagagccatccaattcaccggactaagattggactttgaatccaatcacacaatggtcgaactctacctcgttactcctatgcagactattgtctctcgttgattgcttgcttgccgagcaggcaccgctctctacctaatctgccagacagggtcgccatcccccggccctccttcaatgcttccgctgttccgcatgacggacactctactcggggtcatatgtgaacagccaccacttttattttgagatatttgattagtttggtttttgttctggtccattgtttactacgcatcgagctctctgctgactgaatcttgagaagcgactgactgaatcttgagaagcggccgccagatgaactgcatgcgaggtcttcgatcgatgcttttttttttccttttgcaacaggccagagattggaagtcatcgggcaatagatgatctgatagaaggaggatgtttgcgtcctacccttcgtaattttgcattctttgtaagctttctattgcagaacatatacacctgaataccaagatctatgaactgagcatacttgctcggccagccacctggagtgaggcgatgcctggacttgctgttaggaaccaagaggggcggacagacgacgcaacacaagccggcacgagtgggttattgttccagcatgactcaaccagaacgtggatagcggctacgacctcccggcgtgaaggcagaaagcggcggtgtcctctccggattcgagagccttcgaggtgagttgaggtgaactgcaacggcagattcctgacgttgtggaggcggaagccggaaggcggctgttgcagtctcccagagtcgaggtgaacggcgggcatggcagcaccttgcccgagccctgcaccaacattgggcccgaggagaggagagtccacaatggcacctctccgcatggcggcatgggcgccccaaaccgagcctggacgtgcttcggtacagcgtccacctctggacacttcttagaacaccgtccaagtctggacgccctttgaaacaacgttcatgctatttttacaaattcaatttaaaatttaccacttatttaattcaagacttattaattactataaataaaaaattcgggcgggcagataagggtccaatttaatttatccctcaaccataaatataagatatctttgttcccaactattaaaaaccattataaaatgatttcctcggtgattttcacattcattgatctagttcaactgtctaaagtcggcatatggggcccatatgttgaatatttttaaaatgatttcctcggtgattttcactgacgtggctcattggcctagtcaaaccggttaagtcagcatatgagccccacatgtcagtgtgagtattttcaaaatgacttcctcggtggttttcactaacgtggctcattaacctagtccaaccagctaagtcagcacatggggcctacatggcatcgatcgtgagtaaatggcatgcggcggaagccactgacgatagaggcagtggggcgagccaaggacgacggggacttcaacaacgccctccatcgtgccacgtctctcaacggcggcagtgtctgggcacagcaagtcgccgtctcgcctctaggccggtccatcgtcactccatctccaagccgcaacgttgcttcgcctcaaaagctgagccaccgctgctccactcgaggccaggccaccaccacgcgtcaggagcacccaaccacca

SEQ ID NO: 44185 - DNA, 756 bp, Oryza sativa
  unsure (1)..(756): unsure at all n locations
nnnnnnnnnnnnnnnnnnnnnnnnnnnnnnnnnnnnnnnnnnnnnnnnnnnnnttcccatatgtgatattcagtttctgatccagaacagagcttcacaactgatatcctcaaccaatgaatccttttctttcagaatgtgatctcgactgtccaaaagactgaattatatccttcacactgccatctacaaacgtttgacctgcttctttgttgacaccactgtcatccattaactttctcattttctctgacccaaaccattctccaacagatgcatagatgtttgagaggagaacataatcaccgctttcatcattccttgcctttagcagttgcctatttgcatgtttagccagttcgatctcaccatgaaccctacaagccgaaagtagtgttctccaaatgacagaattaggctcacatttcatcgtatcaatgaactcaaatgcttcttttagtagcccagcacgacccagcatgtccaccatgcaaccgtagtgcttgatattgggttcaaccctgtacttatgctgcatcaagttgaagaattcacgtcccttgtcaaccatcccgccgtggctgcaggcgataaggacagcaacaaaggtgatctcatctggcctgaccttccccttcagcatcttctcaaacatatctatggattccaggacatgcccatgcagtgccagtcctcctacaattgagttccaagttgagacgtccttgtctcgcattgaccagaacacctcatgtg

SEQ ID NO: 44186 - DNA, 1333 bp, Oryza sativa
atacatattttttgtatcttgcagaaaagacgtgttgtcggagttgtccctcaagccggagtggaagagctagccctagaaggaattcgtgcaggcaagtgatgtaataatataaatgattgttatatttgtaatgcaattaaaaatattagacttgtaattagacttagcatataagattgtgtagtgttctaatattatttgagttttaatataagattattttattgcaaattagacttagtatgtaattattgactacggaattggtgcgactcctagcaattgactattgtagtcttaattagacttagcatatacgcatgaaacacttagcatacatgactattttggtcttagcatgtaatattatttgagttttaatataagattattttatttgtaattagacttactatataattattgactacggaattggtgcgattcctagcaattgacaattttagtcttaattagacttagcatatacgacagttacacttagcatacatgactctttcagtcttagcatataatattatttgagttttaatataagattactttatttgtaattagacttagtatgtaattattgactacggaattggtgcgactcctagcaattgactattgtagtcttaattagacttagtatatacgcacgaaacacttagcatatacatgactattttagtcttagcatgtaatattatttgagttttaatagaagattattttatttgtaattagacttagtatataattatttactagctagggttgtataatatacgtcatctagacttagcttatatcacgatttgtaattagacttagcatgtaaggttgtgtagggttctaatgtacgacatttacacttagcatgcataacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaatgtcacaccctgaaaattcaaaatatataaattgttgtttaaatggaatttttagaaataattttaaaaagtcttgaagagaagatctaagtttaattaataaattccaatataaaattgggccagataaaatttcattaaatactttgcttaattctataattcctagatttttctgggatttatttgagctaaggaagtatttttaataatggaattgcattcaagaaataatttaaattgaaaaggttttaaaaagtcttcttttggctttgggccgaaa

SEQ ID NO: 44187 - DNA, 8153 bp, Oryza sativa
ctccctttccaattgcatatttgctttccaattgcatcttataaaataaaaacaacataaaaatttgcaaaataaaaaatacccaaaaagaaaggatatgtttgagtcatgctaggtaagacaagctagttctctttgttgaaatgatgaatagttgctctgttttatatttcttatatatgggttcttggtaaatactctctcaaaggttaaatataagtagccaacaattatctgggaacctgaggtaaatgagctgcacttgctgatctgagtctaagttgttgtaagatatgagatggtaaataagagttgctatgatcctgatactagtttgacttgaattctggatgttttgtttttcaaaatgataaaactgagagttcctcatttaatgaaaattcctaccaaagcaaaaaatgtgctatcatgattaaaccatatacattttggttacttgccattccattaaactttgtcaaactcttgtgacttgtgtagatacatttcatgctctatgatcaagatcatacacccacatttatgcacatgctaaactcctacactgggagctaagcaatattccatttcatttccctattaccacaaaaataaattctccatgctttcatgtgctttcttctcctaaaaagaaaagtccttttgaaaaaaaaagagaggagggaaagggcatggttctgaaaaaaaataaagttatgctccttcaagcatgagcatgatgctaaaaaaaatgcaatcatgccctctcctaatcaataaaagaaggatttttgggagaagaaagtaagcacaaaggagaagcatttttctttatttttcctcatataccacttccatcatacaccacacacattgcacgatcttgatcttgagtatgtttagttatttgttttagtctaagtttttgacttagtaataaatgtgaatgcaagtatgccatgtttgatccctaccgagatccacatattaaaaccttagagtgaatcattcgaggaactaggttttctttttcaaaatcatttgaaaacttccggaataagagttaaataaaggttaggtgattggtgctctcattgctgttctgtctttcaactgcctaagtcaaggagaggtagtgtctcgtgggaatcatggggtaagggtaagccaccgtgccaaagattatttaatctgatagagagtacacaaaccttgcacctgtatttttgagatatgcagcatggtagcaactcttgatcaacaaccaagtcttggttcctttacgtccttcactggggacgagcaaaggttcaagattagggggttttgttgatgatcgttatcgattagttttgaccgtcaatcctaccaacataggagaaatctagtgatgcttccaatgcataaaaatgttagagtaataatattccactagtgttaggttaactatccttttgcagagaataccaataaattgaaggagaaccgacgtcaacactttctatatatcaatcgggcgatgtcgacaatcaaacttatgtatgaatgggccaagaactcaaaattgacgcgatgaattgggccgaaattcacaagtctgcggagtggagcaatagagtaggccaccagccaaaattgggctggattggccagccccaggttcggccaaacctggttgtttgtccgatccaatcctggcgccgctggatccaggttttcgtgtgaacgtacaggattgcatcccaatggcggttagagggcacttcggacaattccccttccacaaccatcataactacatctatataagaacttcactttctcacttcactcacacacctcaagcaataactctctcatttctctcaagtttagtttagtagtatctagctggtggaataggaatagagtagaaatcaggagtccggaagccttcggaagagttcgggtatggctctagcagcttttctcttctcttttgtaagcttttgtacttttattagaatactcttctaaatacatttatggtattgaaacactttccaagtatatgagtacctactttacattatgtccatgttatactaaatatacggctagcttatctgggagatgctttggtgcgggtataatgtttgcttatgcaattactctatgtcatgatgatgatattagagtagtatctagtagtttagacatggtgtctagattacgagatatcattatttggggttatatattgcggatgagaggtgggcccctgatggtgacagctcagtacgggtattcctcctcgccggtatataatccaaagttaatttcctgggaagggtattcctccgtatttagccccggttgtatagtcatgacaggctgtcgtaaggaactcggcagtcagaggtggcttctcgaagtaccaggagggcatcggatagagggtattaggtagaatattagttaactaggatgtatgtatactatgtatattataagtataggaatagattatcttcctcttttctttccacttagcttagataatatattatgagaatgagtagtttatgcttgtgtgtcactctatccttggattatcttaacccctatttagaatatgattaccacaagcaatatataaattattagtcacgttctctctacatgatcttcccacgggataaaataaatacgatacccttggaatactctcgggtgaaatgctacaatggtatatgtcacatcctgattttcgtttcaggatttataaattatttaataaattaataatagaatttatattaaatgttctttaattttcaagtgaagtaaaatgtgggaaataaaatttcttaaatctaaagcatggatggatttaatttttgttaaattctccatggttaagtcaactctctgaaattttctcggatttttcagagctcaactcttaataatacaaagaacagttcagtaattatttgatcattaatgatctaattataattgttaagagcttttcttgtttaaaaatccttaaattataaattgttgtttaaaaggaattattagaaatgattttaaaagcttataagagaagatctaattttaatttgttaaatctcaatataaaattgggctagataaaatttcattaaatactttgcttaattctataattcctagatttttctgggatttatttgagctaaggaagtatttttagtaaatggaattgcatttaagaaataatttaaattgaaaaaggttttaaaagtcttcttttggctttgggccgaaagtcggcccaaaacctctcttctctccctcctcggcccagccggcccagtccgcagccgcgcgcgcgcgttcggtcgctgacaggtggggcccgcttgtcggatccgtcttcctcgcgtcgccgccgccgcccgaaaccctagcgcaagccgccgccgtctccttccaaattcggccgcgtctttccttatccggccgaatcgtttgagggaaaatgatcctcgggatctcctctacctcttcttctttggaagcttcgcctaaatcggtttggaaatcgatggattcgagttcgaatcggatcggttttcctctctccaagccgagctttccttcgccgtctccgccgccgtgggccttcgccgccgcctccttgcacctatttaaggacccccgagctctcctctacccgtcgccaccctcgccttcgcctctcgtcgtcggaagagctctagcgccttgtgccctagcttcgccgtcgccgccgccgctccagccgtgcgccgccgtcgtttcagccgtcgccgtcgctcgggaagaccgccgtcgggttcgcaaggtcgtcgccgtcctcgtccgccccttcgccgtcgccggagaccgccggagcttcatcgccgtcgtcaacccgaaggtttccgccacttcctcctcgtcgccgtcgccgtccgttgcttctccgccgcttctttggtcaccggtgagttcaccgcgtcgcgctctacgtcctggtgctctccgttcgcgtcgccgcgccgtcgttcgccggcgagcatgcgagcccgagccgccgagccgccgccgccggtggtgacgtcatcgctgacgtcatcggagtcgtccgccgtgagccgccgtggacccgatcgatctcggccgtccgttttggattggttcgatctcggccgtccgttcccgtgaaccgtcacccgtgcgcccggtccaccgaaaccctagccgctgacgcaataatcttcttttccttttcaaaaataattcattattgcgtcataattcaattaaaatcagtttaaaggttttaatccgatttaatctttaaaaattcatatctaattcatcttaactcagtttaatgtggttcaagttgcaaaagttgtataaaataaagatctacatattaaaattgtccataaattgaattaaatttatttaattcttttttaaatgggctttaaatagatttaatcttgtaaaattcttaataaattcatttgaagtcagaatgaggccgttcaagtctcataattcatctaaaaatatgatctacatgtttgtttactttttatgtattgtttatttggtttttattagtctttttcctcgttttgcgtgatagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggtgattataattggactagttgagctttatatatattggttcaactagatattagatatgattgcttagccatgcttagaaacattagcacacatttgggataactaatgtttcactatcacttatggttatatttaatggtagctcacgatggtcaatcgtgattggttaattaattacttgccaactaaaacttgataatggtgggtcgtgagcacatgattttgagagtcgtgctcatgacaattaaggaccggttcgcgagctactgttgtgaaacattaaccgtgccaaccacaagccagcgtgggcaacggctttatcttttgtatagcatggttcattgcggggcaccagactgagaagtggcggagataagcccacgggggtcgctggggagtccatgccttgttttataagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagcaatgtttttcgtgattagtctcacacctctcacaatagttaaggatgttataactggtaataatttgcttagctcctggtttggagttagatctgttcagccgggtatggttgttcagaatggttgggcctgtgcagcatgggtgtgctgttcagtgttgattaaaatttctgattaattactccactgttttacttctcttaaatgttttgctaaatgctgcttttgcaaatgagccgatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacagtatatccgtgcgcttgcggatgaactctgtaaccacaatataccagaagtatttctgcgccattgctgggaattatatttctagtaatgtcgttaagaaataccaacacctgcctcgccaccgcctcgtctaccttctctaccgcctccgccgccacgctcctccgccgcctccactcctccgccgccacgcagctccgccggcacgctcctccgctgcctccgcctccgtgccgatgtcctgagcgctgccgtccgtgccgttcacgccgccgcgcttgcctcacctcgccgaccgcccacgcccaccgggcccaagggcggaaggaagagtgcgctgccgccgcgctcgcctcacctcgccgaccgcccacgccgactaccctccccacgatcgtcctcaccatgcgtgctgcgcgagagagaaaagagtgagagagagaatagagagagagtaagaagtgtatgacaagcgggtcctacaattttttaattaaaaaagtgttaactggactgccacatgtacgccacgtagaccaaaaccaccgtggattgggttgaggggggtaattcatccggtttgcatagttgggggtgaagaatgtccggttttgtggttcagggtggtaattcagacgaccgcgatagttcggggaggggggtaattcgtactttttccttttttatttcacatcatattttagggtgtcaaatatcggacttgacgaatatacaaccctaatttaaatttacatatgtaaaattcaaaacaacacaatttagttgttttattttacaccattatattagatttatgatttaaaataatacatttctcctatatacggatacatgagaaatataaattattgactagaaaaggtattttgtacgtacatgtgatttaaaaaaaataatgcttacgtatcgtttgaagaaagaatagaaaacgtagttatgataaagccaaaaaatatcgacagtccttaaaatagaattatctacaattcaaagataaaatataataatcttcaaatttacacaaatataattataaaatatccggtcaatgctttttaagcgttctatcttttaaattattttaaaattatatattcaatttgtgatcgtattgtattcctttaaataaataaactattaatgtgtctataggctaaatacatcacaacatatggagccaaaatgtaatactccctccgtttcactatgtaagttattctagcatttcccacatttatatggatgttagtgtatatgactagattcactagcatccatatgaatgtgggaaatgctagaatgacttacattatgaaacggagggagtaattaattttatggtaatcatttcacatcatattttcggtgtaaaaaacactcgacgaatatacaacgctaatgtacatatgtattctccaaattactaaaggtgtctcatgtgaaacagtaggtattgaaaacaagctagacactgaactaacatgcactacactattgatatctgtcaaaatataatatggtactttggagattatcgtggtagtatttaaaaaaatcactttgtcttgttacatataaattcttctattgttttggaataaaatccaatttctttgatttatgtgatggaaggaatataagtaatataatttatctttagttagatgaagtagtatcattagctatatttttaatagaaaatatctttcattaatatataataaaattaaaatgttacttaaagtcatctatagcatacaaaataaaaaaaatgttatataaagtttggaaactccaaaaattttaaagaaagaatcacacataatacaaatagatatgaaccaactccattattgtgacacattttttaaaataaatttgaggatatacagtatcaagtaatatgcccaaaccaattattaacgaacacatgattaaaatagagtcaaaaaatatttcaaaaatatcatccacgcataaaagtttgtaataaaa

SEQ ID NO: 44188 - DNA, 1664 bp, Oryza sativa
tcaaatcgtattttaaatttgctagtatacaatcgtggggccaatacctgttaaaagtgcccttctggtgttgacggtcgttatcgatcagtttcgaccatcaatattactaaaatagaggagaactagtgatgcttgcaatgcataaatatgttagaataataatattccactagcagtaggtatactaacctttttggagagaatgacactaaagtggaggagaatcgacatcaactcaaacgataaatcaatcggacgatgtcgagaatcagatttatgtatgaatgggccaagaactcagaattgacacgatgaattgggccaaaattcacaagtctacaaagtgaagcaattgaggaggtcgccagccgaagatgggctggtttgggccagcccatggttcggccgaactagggggttcggccaaacccccatctccaccgttgaggctatggttcagcatggacatccaataatgcaccctaatgacagttggagggtagttcggacaattccgcttccacaaccgtcataaccatctctatataaaggcttcactctcttcactttaacacacacctcaagcaatagctctctcatttatctcaaccttagtttagtaatatctacctgatggaataggaatagagtagaaatcaggaatccggaagcctttggaagagttcgggtatggctctagtagcttttctcttcttttttgtaagctttgtacttttattagaatacttttctaaatacatttattgtattgaaatactttccaagtatatgagtacctactttacattatgttcatgttatactaaatatacggctagcttatctaggagatgctttggtgcgggtataatgtttgcttatgcaattactctatgtcatgacgatgatattagagtagtatctagtagtttagacgtggtgtcttgattatgagatatcattatttggggttatatattgcggatgagaggtgggccgctgatggtgacagctcagtacaggtattcctccgcgccgatatataatcgtaagttaattccctggggagggtattcctccgtatttagccccggttgtatggtcatgacgggctgtcgtaatgaactcggcagtcaggggtggcttctcaaagtaccaggagggcatcggatagtgggtattagctagtatatcggttaacttgaatgtatgtatagtatgtatattagaagtataggaatagattttctttctcttttctttgcacttagcttagatgatatattatgagaatgagtagttaatgcttgtgtgtcactctaccctggattatcttaacccctgcttagaatatgattatcacaagtaatatataaattattagtcgagttctctctacatgatcttcccacgggataaaataaatactatacccttgtaatactctcgggtgaaatgctacaatggtatatccgtgcgcttgcggatgaactctgtaaccataatatatcagaagtatttctgcgccattgctgggaattatatttctagtaatgtcgttaagaaataccaacacctggtacttccagagatcaccccgggttgtcgagttccttacgaaaacctatcatgaccgtataaccggcgctaaatatggagaa

SEQ ID NO: 44189 - DNA, 2994 bp, Oryza sativa
  unsure (1)..(2994): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggattgcaaacggataactgatgccgggatgcgcttgcttgccaatagttcatctttggttaacctcacattgcaggattgtcgcggttttaccgatgatggagtcagtgaggtcgtacgtgcacggaatttggattctctgattgttcaaggctgtcgcgtttcttggaaagctgtgaagggggctgccaaatctgttcgctatgatcgtaattgcccggtctatggccgtctaagtagatcgagcatgatatccactctggattaggtgcccctcaagattttcagttgggctcttttagatcccctgttgaattggttgagtacttgagttgttgccaggttcacatcattgattgttgtcggtttcatttttcatatacctgaatctgctttgatttgttactgttgatgctgatctgttgtagcttattatggtgagccttgaattttcgtgagccatctgttctgtgaaaaatcatggtattggtcactagtatggtacactgcagctactgatatatttcttggtactttcatctttgtttacctttccaaatccatctatacaactagttcttttgttagtgaggttaccctgtttgaattctgattgttttttagagtgttctaatttgcatttcctctcacaaaaatagcatgaatacttagcttttcgtagaattatcaatctgaaccaccttttttttctggaaaaaaatctctactctgttcaacattgtgggcatataagcatatcgcataggaaattatatcttaactattttaaaactactttaaaagcacaatcgtcttccttcctctctttaaaagaaccttcctccctacaaaaaaaccgcttcctcaccttcccaaataaaccggtccagaaaaaaaccccaaaacccaaatcactgtgaaaaaaccagcatataaagaaatttaatcatatttctctcttccaatctcgttatgattcacgggcatatatatgtaactaacatcgagaaaacttcattttatgtgattccatctatatatatatgcctaagcttaagtattagtaggattgcggctgctgtgactattttcacatattttagcagttttgaaactgctctcagatttagaacttatccacgcctttttgttcaattggttaaagcatttaccatgttgaactgcggtcatacacactgtttgaagactatgaaaaccttgtatggttaaccggataagtttgagcgactaaatattatttttctacaaacgaagtgtcttttttttaataatgcatagatattcagcctctatatccgcaaggggacatacacagtcaaataacatgactgaaaatttgacgaacttgtggatatcgaagcattggctacaaattgtcatgtctatgcttgctgactactactctccgtttcatattataagacgttttggtatatgtatttcttgtaatctctattatatatgcagtaataaataaaattcgtcatcttaaacataataaatactccctccatctacttttgatagttatatttccaaatctgaaaaatctatttttgataggcatatttcaatccaacaacctatcatcttaatgtctttctcgaatttaatgcgtgattctctattcctccacacaagattggctacatggacatcgagaaatataaatattaatgaatcgcttgttcacgaggaatgactagtagcatgtttaaatggatgataagtagaatcacttatcgttggtctgtgtgtcaagatgaaatatgactatcaaaagtagatagagggagtaataagttgctgttcttatgaatcgatttgctccatcccatcccaagaacccaaatagggagtagtacttgctgaggaaattcaccatcctttgctgctcgatgcaaaagcattggatcttctctcagcctgtgaacgagtacatcatctcagtctatgaagatcaacatgtcaatcatacacgcaagtatatgaagatcaacatgtcaaccatacacgcaagtatatgacaagaagaaagcaagaaacctggccagctgcatcgattagggtcaaaattaccaactagtgttcactgcatgagtatgtaaacctatttgcacctttcaacactgggctagtatatatatcatgagaaaaagtgttgccgctttttttttttttgacacgccgccaaacacaattccacgaatcacctaaaactttgcggtagtacggagtcgtcaactatcttgacctcgagaaaccctttgattaagatggatttagagatcaaaaatgggctagaggaaccgatttagataaatagggataaacactcatctcgtggacggaacggaatgttttcgggacaaacctacaaagaggattcgcactttcgcagcgagggcagacggcttgcaacgcaaaccgacgaagatggatggaacctggtagatacgatattgaaagaatgatttaattggctatggtgttggttgtagattgtgtctcaattgaactggtcatagctcttataaagagactggtcttgccttcttcaggaccttctctacgttcaattaggtgtagaaaccaattaggactcgaaaaatctcagctcaagcaagaaaaccagagaaccgataaaactggacttggagtcggactccgccgatttgaccggccacatgctcaacctcac

SEQ ID NO: 44190 - DNA, 5798 bp, Oryza sativa
taccccgagagccatacctaatggacaaaacaatgtgaaaattatagattaaatctatgattttttttttttggggggggggggggcatgtactctgagtactctcaatgaagccagcagcttagattatacatttgtctacttcaattcttcaacatagcacatctacttgtacatctgtacatatattcaacatacctgccaatattattaacgtacaaaaagagagatttatttatatgaccttcaacatagcaaagcattcacaagaatgggcaacatttggacgggttactgcatctaacggatagtcaagaacaatatcatgaaagatctcagcaggattgaaaagctgatcaatagttcagaaatgtgtcaatattgctgaaacatatatggttactaccaagagaaattttgtagtacttaaggatcactctgttatattttgtagtactctgttcctaacttttaatttgatgttatcttcaaattgccacatgcaaggattgaagaatgttcttgagaatttaagagtacaaagttttgtcaactctgtgtataatgaatttgaatatacaatttttctcaataatttttggtgatatttattaatcggtgtgcacggtcaactcaagtcggtcgttatagatccatgcatttggttctcgaacttggtcatcttaacaatctaaacacgttaagagaaggaaagcatgtgtgatgtgatggtgtaatcctaggtattacgcacacatgactgcgctttcaatacaaattagtagggcagtgatatgttattggtctccgtcttttatgcatacattagagatccactcgtggttacgtgagtgtagtgttcgtgcgtgctggtgtgttttccctgtaatctgaaaaaaaatacactaggagcataaaatatggtgggctagtgtcaagctttatgcagtggtatattttttctttttcctggttatgaccttcacgggatgtaattttgttttttttttcttgctatatcaatagaacttcgcacctcgcaccgtctcgtgcgagtagttaaaaaaatgctttatgtagttgtggctcatgattagccattaagatccagacatatctccctttgcttagcataagggcacccgcaatggttatctatagactctctataagagatccatgtcagcatattttcctacttggaagagattaaatgaagagagagagagcaaagctatctactaacctggagacagtctatagagaaaaacgaggcaatatattagagagctatagatacccatgtagacaaaccattaaagtggtttactattaatatagtctattgctgagatgtacatgttttatagatagcacattactttaccattgcgggtgctctaaggaggtctagatctatagatttggttgaacttaggctgtttttgagaaaggggagattgagaagatacgcaaaacgaggtaggctattagtgcatgattaattgagtattaattatttcaaatttcaaaaatagactaatatgattttttaaaacaactttcttatagaattttttttgcaaaaaacgcatcgtttagttgtttggaaagcgtgcgcggggaaaacgatgtgcattctatctccaatctcccggaacgaacgctgccttaggctgcgttcgtttggagaataaagggagtgagtttgtttcgtattccgcgcgcacgcttcctgaactactaaacctttcgttttttgcaaaaattttctataggaaagttactttaaaaaatcatattaatccatttttgaagtttaaaatagttaatactcaattaatcacacgctaagggctcacctcgttttacgtatcttcccaatcttctctatctcattctcctcaaacatagccttagtcatcctaacaatcgaaatacactaaaagtaggtgaagcacatatagtatggtgataaaacgtgggtgcatgactctatccatcgagatttaaatccttatgtccacagttagtgtgtgcgctctcaatagaattttagtaagaacagggatatgctaccggtctctgtctttttagcgtgtattagacggctcactcatgagtgtgagtgtggcatgcgtgcatgtgtaatagtaaaaaagaaaataaaatacgctggggagtaggaaaaaaatgggccagtgtcaagcccagatgcggtggtggcccatcattagcccatccagcccaattactcttgctgtccccctggcccctccatctccatggcacaaaacctccgcctctccatggcttcccggatcaatcccctttttcctcccgaggcgagggttttggcgaggagatcgagcagaggatctctttagcctcccgttcggcccaatccaccgtagcccaggcccatttagttgtccgtccagccgcgcgccgccgtgcctttttattggttgctgcggttccaagaaacccccgccatggcctccgatggtagtttcttccgatacggtggttagtcagtgcccttcttgcgtgtgcggttcttggaatttcttgttttctttgtctctcctagcgattgtttgttggagggataattttttgcttcttgtcaatggcggtcgccggatggatcagtggctcgttcgctccgtgtttcttgtaggttcggtggttgcagatgtcttaaggtgcaattcttgttcggttttgttaatgatagttagttcttggtcggagaggcagcaatctgtagatgaataattaggttgccactcaatcgacacaggaaaatgttgcggaagttcatgaccatatatatatgcttcttgatgagtttctctactgtcgatggcggataattctgcagctccttgttaatggaggttgctggatcggtggatatgaccattttatgcttcttgaatgttcaggttgcagatatctaggtttaattcatgttcgatttagttgatactagttagtttttgctcggagaggcagcagtctgtagacaaatagtcaggtctccaccttaattaatatttcagttgacataaaaatattgggaagttcatgaccgtatatatgcttcttgaagaatgtcttgtctatactgtatttcgatcacctttgatatgcatccttctgatccgattaatttcggtccagagcgccagatagcagctaaacctgaagattgcccagcaatgtcatcaatgttgtcattggaggatctcccggatgcattgctcgcagagattgtaaagaggattaccaacacaagtgacctgaagtccatttcccttgtgtcaaagcgtctgtacactatcgaggcggagcaaagaagttctatccgtgttggctctgacctttgtccagcgatagatgccttgtcagcactctgttcccgattccccaatttgttggaagtagagatggactactctggttggaaatttcactggaatctgctagaaaaacatattttctcattgcacttccctgtcctgcgtgatctcaccttatacattgatgatattcgtatgggttgtctagcttcttgcaaaaatttgatgtccctcaggttgaactctgtatcagcgataggctcatgtggacttctctcggtggctgttggttgcaagaatttaacttctctccacattattaagtgcaaccatattgttggcagtgataagtggctggagtacattggcagtgctgggtcactggaagaacttgtagtgaagaactgcaagagaatcagccagtatgatctcctaaaatttggccctggatggatgaagctcaagaagttcgagttcaagttcaagagaagtttcaacacatatgaacctcgtgacccctgttatgtggataactatcagtatggatatgatttctgctgtgaaagtttgagggatgtcactttggctacgattgtaactaaaccagagataggacttcgctgtctcctgacaaagtgcaaagcattagagagactctgccttcactatgtaattggcataagtgatcatgacatcattacaatctcccagaactgcagcaaccttagaagcatctcactttctcaagagatgctgctctgtgaaatacctggaggcacaggcgtaatggctaggacaccactgactgatgacagcctcaatgctctagccctgagatctcatatgcttgaagctgttgagcttatgttttatggttgtgctcctgattggccatctgagatagccttcacacaggatggccttgtgacactcctccagtcctgtccgattcgtcatctcgtgctacgtggtgctaacttctttgatgatgaagggatggaggctctctcatgtgcacaattcctggagacactggagcttatgcaatgtgttgcggtaactgatgtcgggatgcgctttcttgcacaaagcccatgtttgaagaatctcacgctgcagatgtgttacgaggttactgatgatggagtgtgtgaggtggctcatgcacgggatttggagtctctcactgttgaaagctgtaatcagatttctgtagaagctttgcatggggccgccaaatccgttcactacaaagttgattgcccaagctactacgatcgatataaagattaggtcattgctgactgtacatcatttgtagttgctttttcagttttacctttccaccatctttctgtacttgctgttgccacgtccttataccgcttattgttctcaattaaaccagtgtttaatggttatcttttgatttatgcaggtactacgtgtgatgagtgaaaactgggatcatttactgcaactgtgctgtataccatattatatgatcttgccaataacaatctcaatttggcctgtaagcagtactactgtttagctttgggagtgtctgcaactatcaactcttttgtcgacgaagcgctacagaaaggtggaagtggaactactgccaatcgtctcagactttcaacattttccttttgtgtatgccaccttcattgttatggcttacaagaaacgtttcaggatataattgtgcctacatctttaacagacgattatatgtttctatcacgttttgtttctgtgcctactctaacctctgtgaactgatcttttcgcttcctacaaaactggtccgaaaggcattggatcattgggtgtagtcaacaatgtacactgcattacctgcttatagtacaatataagatgtttattcatatggtttcttcgtatgaaaagctggtctgttattgttaaattatgatttcatgaaatatgtagtcttgagatttacaggcagtgtttcaatttcaggtcgaaatttctgaaattttgggtttacagtcgatcctggtttctctcgttgaatttttttttctgaattagctaaagtttgctaaaatttagccaaaatcctctatagtttcaattgaaacttctgaaatttcggtctcgcccggaataattatgcatcccagaacattgaatctttcaggtataactggagtaagttttcaggacatgcctgcgtaacttgctacctgtgaaattggagacaaaactccataactccgatgcataattcttatcagtatctgcaaattctttgcattttaacaggttattaggcgtggtctttttcttgcacgcgtatgtcagtggctaactccatactactattcattaaatcttgaaaaatttcaagttgtaatttgctttccacaggcatatgtaccattttagctggaa

SEQ ID NO: 44191 - DNA, 14005 bp, Oryza sativa
aatttttctacacacacaaacttccaaccttttgtcacatcattccaatttcaaccaaactttcaattttggcgtgaactaaacacactctgagattgaagaaaaaactgacgcatttgtgagcatttatttcagggcacttattttagctaggggaatttatttcagggcattgcttttgttcttgtcagttagatcctatgcacaaatcacaatatcttttgattttgatttatgatatggcttgaaaacttcatcatactttgccgtgaatgatgctagttgaaactcatgaattgcctgatggaatgcattgctttgtttgctgcatggccaaatcgaatacatgcattgctatgttcattgcaattgtaataaagttccaaatcccaggcagaaagcatgctgagttgttgctgattgttgcatccattatgcgaagcccaaggcggcagtaggaattaacccatggatggcagcgacgcgtaccggcgagaatttagcatggtgcctcaacatttttaccacctaatgcacatacctctatactactccctccgtgttttaacgtatgacgccgttgacttttcgacaaacgtttgactattcgtcttattcaaaaattttatgcaaatatgaaaatatttatgtcatgcttaaagaatatttgataatgaatcaagtcacgataaaataaatgataattacataaattttttgaataagatgaatggtcaaacattggacaaaaagtcaacagcgtcatacattaaaatacggagggagtaccatatattattaggacggttaattagtctatttagtactccctccatctatttttgatagtcatattttcaaatctgaaaaatttatttttgataggcatatttcaatctaacaacatatcctcttaatgactttctcggatttaatgcgtgactctccattcttccacacaagattggctacatgggcatcgagaaatgtaaatattaatgaatcgcttgtttataaggaatgactagtagtatgttttaatagatgataagtagaattacttatccttggtttatgtgccaagatgaaatatgacaatcaaaagtagatggagggagtatattagtagtcctaatgatatacttcgtattatagagtgcatgtagattgggtggtaaaaaagtcgagccacgtcaatttgatggtaaattcgctgcttcatcaaactttgcaggtacacgtgctgccagttgctgggctttcatgggctgtgatgggctggtttccgtgggctgttgagtgggtgtgcgcacgagccgttggatcggcttggacgatggatattacacttgactgcacgctggtatctgaggatcctactcccccagtcccccgcgagcgagcagaggcggcgccgtcgctcgtcctccgccaccgccgccggcgccgatacccatccatcccgcgccgcgagcgagtgcttccgccgcatccatcctggttagcacaccctctttcccatctctctctctctactcacgcacctaccgaattcgcgttaaccctagcttctgttctagaaattttgccttaaccttagtactaatttcttcccaaaaaggtttggggtgtcccatgttagatccgtccatgaattaagctgcctgtcgaaccggttattctctggtataactcctgtcaatgtactctgcctcagttcttgattgggaaacctttccttgctagttgctacctaattttcagtttttcatcattgtacttcagcttgtgacttactggattaatcagttgggatggagtatatgttggatgaactcgtataaattggtagtatgcaaattttggagactcataattgtgagagttatctagctttatttgttgccgttcacttgtttctctagtcaaagatgcttgtcttgaagttgatgatgttagcctttttaagattcaatcaatgatgctaaagtatttattcaatatactaattgcaattagggttgttcgcccatttacaactggtgtaaacgagcttagcttagctgtcgcgtgcttgctgaaaatgaatacagccagttgttcggtcaaaacctccgatgaacagcccttattgcaacatagttgtatctgtcataagattatcttctctatttttgttatgccgtgggcttattgactgaggttgtaatcgtgcaaaacaggaggacagggtactgggtgtgggcaggcaggcactgaaactggactacactctagcttcttagtgattacctctagatcagctcagcaaatagatgctattaaccactttgtttacaactttacatgcatgataatcgtttttgtatcctgaacatgagaatttgaaatttgtagtaggtgtcaattacttcaccaagtaaagtagctggaaacatatactagtagccatgcgggagtctggtcttccaaatcaatcaaacaatctgtgactgggtatcatattgcacattaatatgtatgctaaaggtcctatgtttaaactgttactagaagtgcttatatttgtttgccttcctgctgctcttgtactatattctagattcaaatgtacaacatcttattgctcatgtaaacattaaatactaattgtaactgtctaaatttcttcagagtttttagtgcttactaaatttcttcagattttccgtttgctgtctaaaactcttaaaagcatcatgttttcatgagaaagctaacgtttacagtctcctggtgtgaagggcatttgcaatcagtgacaaaagttcctcagctgtggagccatggccgccaagatacgcatagtgatgaaatcttttatgagccaagctaacaaagttgaaggggttattccatacgcgcagaaggttggattgcctgaatcacgatccttgtataccgtgctacgatcgcctcacatagacaagaagtcgagggagcagttctcgatgcatgtcaagaaacaatttctggtacagaaggcggagacgcacgagctgcagaagaagctgttctggttgaagcgcctgcgcctgcttggtgctcagtatgaactccagatcagtttcaagacccgtttggacaagaagctgctccaagctgctttgtcgtcaggttgctagagcacttcacttaccaccattcacccttgaacaagactgcttttgcttctatgatgtcttcatgatgagattgtcaaacagtacttgcatccattaagcatttcatatgatgaaactacaccatttggaagagtttgaaggaatgtagtagtaatccatccaaaacgttcagatgctctgaattatgaagatgtggcatgatatgaaacagatatccttccgtttccgggcttctctttggttttgttccgaatgccgtttaacaagtcatgacattcctatactttgctccctgtgttaagatgttttagggttgtctgtaagtcaaactttttcaagtttgcttaaatttatagaaaaaagatttttacacaaaataattataccaggaaaatatattccatggtagatctaatgtaaccaatttggtgttatagatgttactacatttttctataaatttgattaaatttaaagaagtttgatttagagcaaaacctaaatatcttgcaaagtatctttcttcgtttgttcttgattctaataatgcacatgaatctatgagaaaaaccgggtacagtggatggaaatggagatgagctgtcaatttgtattttatatggaaataagccgctttagaccccctttgattcaaaggaaattcataggaattttaaaggatttcattcctataggaatttttcctatatagccctttgaatcaaaggaatgaatactatggaaatttagcatgaggtggaatctcatgttaagaatcctttgagtcttttatctctcctcaaattcctgtgtttttcctacggctcaatcaaacggtcatttctatgtttttcctgtgttttgtaatcctctgttttacacttgtattcctgtgagaatcctatgtttttcctattcctccgttttttcattcttgtgattcaaagggagccttagcttgagttgggcactccactttctcgacatacacttccttatttttcgcatgcatatgcctcctaaattgttcaatgaaacttttttttttcacaaaaagaattatatatcaaagttactttgaaaatattaatctatttttcaaaatattttaactaatacttaatttatcatgtgctaattttaatcatgcgctagtgagtaacttttttttgtcatagagagagagatggttctgaatcatcactgtagaacaaagcctaaagtagtctatcacattgttggtcaagagttattattattttctaaatcatttgaatttgaattttttaaaaaataaactcttccaaaacttgttttcatatatgatgtttgggataattgcatctatatccccgcttttaatcccaactgttgttttacccttactttttatggtttgaaattttaccctcactacgaaccaaccgtttgcccccacttgtaacgcccacttggtgggtcccacatttatgtgttaaagaaacacaaatggaaattaaaaagagtattatggaatataatttaccattctacccctgaatgaatggatagggatgaaatccctctcttccccactgagtgtggctgtgcctgtggacacccgaaaccctagacctatagacggcggcagcagttcgggcatgtgcgcggcggcagcgagcgtgggacggcgctccggcgagtctccggtggggcggcggttgtggggcttcccacggtggccgctcctaggcgcggcgagtggtggccaagcgcaatgaggtagggcgcgatgaaggcaggcgtcaggcgacgaccatggggcgtgacgaggcaagcgatggctgcaggcaggcggaatggaggaaggtgaggggcgggaggaaatgcttaagtggaggaaatcctatcaatggagcaaattttcatggaagaggttaacaagtgaattgattcttgtcattgtgggaggcctcagtctaccggacgaggggggccagcacggatgcggggcagcttgcaccggacaaggagcgacatgggctgggccaaagaaaaggaagggagagtggagtgggtggagaaaagaacttatttttgcaacaaaaaacccacatattttggaaactctctattaagggaatttggtttattttttgttccataaaaaatgtttcacctaatgaaacattccattacaataaaaaaaaaaccactgtaacatacccgaattctaggattaaggaatttccatcaaaactagttgaagggaaagttcttcaattttgtaaaccaaaaagtttcatatttaaacctaggtgaagttgatttaactcttgcatgaataaaatttgagaacaaattaaaactttttcatctttaacctaggacaaaaatataaacccaagtgaaagcatgcattactcgcataaatcatattttgacttgagtccttcatgtgcatttgaatctttgatttgcatttcataataggtctcatgaatattaactaagatctaaataaacaactaaaccattagggcgtagtgatagctagaggaagttaaaatagaaaccatacaccttaaaatatatcaacatggctaatgtcaaacctcacaaaactaatttggacatccatctgaagacttgtcatgaacatgaaagtgaacaaataaattatatcatatagggtatattctatcttaatcatctctataagcattctcttaatttaatactaaagtaaacttatgcattaaataggtaaggagcttatgacatgtgtaaggtaaactgtaattctaacatatcaatatcacctcaggttaatgagagtccaaatataacttttataaacatttagatgcatttaggaaagggaagcacatataagacataagtcttgctaattatctaaaataattcgtgcaagataaaatcatgggaaaattcatgtaggctctactcgacacatacaactcactgtaattttggtataatttaataactaaatttggtacctcaaataaatcagtcaaactaataaaaactagattaactgtagttcttaatcggctaaaatcatactttgtctaaaagtgcatttaactgcataaaagtgtataagtaaaataatttattcaaatactaggtcatttatcatgaataaaaataatttttccagaatttatcttctctgtttaggtctcctaaaaattcgaactaatttccaaagaacctatattcctctaatttctgtgagtaatctatccataaattttaagtgcaaccaaagaaaatggaatctaggtatcttcatctactttcaaaaaaatccacaccaaattattctacccacaaattaaataattgaattactaaagtgggagagagaaataatcctgaaaatcattcaaaccttttgttcacccacgtttctgcccaaccctctcaccctagcttagtttgccatgacctggacccacttggcagccactctggctcatcctcaccctgtgcaaatcttccagccaaccagagacagccgagagagagagattggcgccggctgtgtacgacgcgtgggctcgcgtggcagcgccgaaccgaggcttcacctccacccagctgcgtcgccactcttcacccaccatcccagtgccgatccaaccgagggaggaagctccagctctccctctccacctctcttttgtcgccggccgccaagaagagggacatcgccaaccatcgtcgagctctctccatctctaactcatactcgttccattctcatctcaccatgccgaacaactttagttttgatcccattccatttcatcttctacagcaacgggaacgccgccatgtcatggtcgctctagagcgtgctctgtgcaccgccgcagcgacatcatcgccgttcccgcttatctggaccaagccgggccaagctgtcgcgccagcgttttcgccttgacctcctctccatttcccgtcaagaatctcgaaggatggtgctacgagtgcggagatcggctaccgtcttcttcacctccggttgccgtcgccattgtcgattccgcctcctccggtgagccattgtccgattcttcgcgtatacaccatccctgggacctcactaacccaatgaaaacacatgcatgtcaattcgatgattggatcgagccgttgccgtcttcccggagctctacaccgtcgccggaccatcttcttcaccgctgccgctgtccagactttcccgcgcctcattcaaggttcggtgagcacccttgagccataggattgcattcatgcatttcattcacttagaatcgagcacgaactcaacatgcagtagcagcctaagcacagccgccgctcggactcgccgccggcgttactccgatgtccactgaccgagaaaagtagaggaatggaatcgaaatagcaagatcttcattttgtcttttggtcgcaccctcaaacgagccaccgtttgccgctggcaagcttgagatcgagctcagccatggcttgatctgcttcagctcgaaccagggacctcctcacaagaatttaggttaatatagggtcctttctgcaaaagatcaagacacacagaacagtcataggactgcgggttgatttcctgaaactctaggggccttcttgcatattggcctgggactgacaatccacccctaggaacaaaatctgaaattataaaagaacagtaactaaaacttgtaaaatcatataaaattaaatctagctcattttaagatgattcaaatttctgtgaactcatcaaattgggaaatttgatgctatggaataaaaacttgaattcacagtacaaatttagcctctaaaatttatccaaattaaatcacacattaagcatgcacaaacttataaaatgcatacaaaattcatttcaaataatttcagagcaaacttagtttctacagatccaccaacatgttctctaaaaaaaagtaaaataaaacatctacacattttgcatcaaatgcctctaaaactattatctttaaaaataactagttttatataagctgaactttagaagttcatataaaattcatcttagatccttttttagtaaacccaagttctgtagaatcaccaaaacatatacttccaaattataaaataaaattatatacttactgtatgataaaagcctctaaatgcttatgtaagtaataaccaacatagagcaaccttaaattgtaaaatttgtagaaatttcatctttagtctaaatgaagtgaaccaaatatctatagaaccagcaaacagtggacttcaacatagtagaataaaatatggaaccttctgtacaggttatagctctaaactttaaatttataggaggtactaatcacatagtatcgattgagcaatatgtatatatataaatgtatatagaaatacactctagctataatgaaacccaaataaaacttgttagaccagtgaatgcatagttccatccccttccaccaaaacttagcaaacttaactcatataacaatttctaggttgatgtgttaagtaactaacatagaacatccctaattataaaatgtgtagtaaaataatataaactctaaaattatgaactaagattagattagttaactaaaatactcattttatacatcactagctagatgaggcaagttctggacctaaacctctaaagccatgaacctatataacactatacacctgtaacacgttataacttgtaaaatacataaagaattcatattaactccaaaaattatgaaaccaaatgtgttagtcttagaaaacacatatgttcactcagcaaacataaacttaataaaaatcaccttacaacagcatttcacaatagtacctaaataaatcctatactataacaatgaaacttgtaaaattcataactcctaaataaaaagagataaaatagaaattcttccacctaaattcattttagaccagtacctattcactgtgcacaaataatccattttagagcattttggattttacgcatatttcggtgtttaattgcataacgtgtactttgtagagacgattgcttaaacggtgaagaagtgatttaggtgctgacattttcctgattcaaggcaagtcccacctccctctctttgatcactttgaaccgttttggaggttattgaaaatatttgcaaatcttgcatgtcgattgcacactaataaattaaaattttgttaaacttgttagataaactcctattatttgcattatcaccttaactccacatatatccatattcctcattcctaaccttaggaacaatatgactataccactttatatatgagttttggtgacactaggttactataaagcttagccatgcttagaatggtcttcctagtcattatgggctcattacaaacatgaagattgatttttaaataatctggacagaactttaatacttgtgattttaataaataaaatgatggaaaacatggattttaggtttgggcctcaagtggtgcacatatggtgattagttgtgtaccgattgggggagagtgtgcccaaaccgacctaaggacttcactcaatgccagttcatttcgtatacagtacaaccacatgtgctagtatgggatagcccaagcttagtaaattatttatggtttagccttacattctggtaggccggtgtgtatgagttcggataactcagaggaacttcctatttaccccgacgtggtagtttaggtgactaagtctgtccaatataacggtattgtgccacgtgggtgggttcccgttgtgtccgccaccacggcgttaagtttaaggtgtgggcccaccacttaacggttataggttatataacgtgtatggcttaggatggagtaacatgtatcgtgctggtgtaaggctaaatcatgaattttggtaaagctttgttgcgggtaataaatcgggtacttatgtatcgcgtgccatgcttttgcatgattattatttcgcatcagggtaaagtgtacaaactctgcagagtaaaaactaatcgattagccgtgctcgcggtcatgagcggcgtgtggatatctattgagtatagacttatgtttattcttctaagtgctgaaatttaccttcaaattgtgttgagatttgagaatgatctccttgctgccacggaaggcaatgaggtgcatatttatacatgattaatgcctaccttgatgcccaatatgtcaagtactagcttgctgaaatttatttgaaagtaaacctgatttagaaatgttttatgcaaataaaacttgctttatgctaaaaagaaccatattatgccttccttgattatatgccttgcaagtagggtgttaggcttgtcttggtgcttgccagtacattatttaataatgtactgactcttgctattgaattaatcttttgcttgcaggttttagtcttagtctttgagtgatgtgggtaatcgactgcttcttctaggatttgaatttaatggggtaaacccctagtcggtgtgcttgtggattgggtagacaagcttccgctattctattatttatttggccggtcggccggtgtatctaaagtagatgtagtttataatcgctttcatcttatttgtgtttgctatgtataaccatgcttgagatgaaagtgtgaatctagtgcacatcctgggaactagattcacatgagtataagttaagaatattttagatgttgtagatctttagccattttgtcaagtctcctaattgtgtaacacatctggtcgctgccttcgagtggtttggcgggcacatctcaggctgaagttgactagcaggctaaaggctcagcaatgtctccaatattcctctctcgaggcgtcggatatttcattttgcttgttgaatgacttgaattatttatttcatctctcaattataatggaaggtctggagagcctacgacacccacatattttggaaaccccctattaagggaatttggtttattttttgttccaccgaaaaatatttcgcctagcgtactcagaatgtttcactatgtatagatctaatgttgcagtgaactgaaatattcttttgctatttgctgaaacattgtttttatataaggtgaaacaacacccgatttaaacgagtgaaacatttttaatctacttagtgaaacataaggctggtcctagggttttggggcccagggcaaaaacttatatggagacccctatatatatacataaactaatatacatatttatatagtcttataaagaggaaaaaaagatagagaaatttaccagatgagatgaattggatttggaggagtgtatgaccttgaaatcagatgaatgaatgaattggaggagtgcagtacaggtggcaggggcggcgagcagagaaggcgaccagcggacgatcgacacacacgagcatggctactggcgagccgcgatgtgctgacttgccatttccgtttgcgagacgccgagaagtcatcgagagcgcaggagcagcgagcggcgtgacgtgatcgaggtggcgcgatgcgagtggtgtgcgtgatgtgatcgaggtacatcgatgggagttagataaagatcgcttcggcttcgctgcaacaggcctgacgatggactaaaatctgttttatgtattgggctattcacttgtctaatttaatataggcccatggcctatggacttaaaattatacagtatatgtactatatgtgtatagggcccctagattttggggtcctcgggcggccgcacggcctgaccccctagggccggccctggtgaaacaattccaatatacctggtggaacatcgtgcgatatttaaaaataattcaataataagctattttgttttgtcggaatatatccatgtgtggtcttgttttgaagatttaattgcaacaaatttaatggtgtaattggatcatgatttggataagtaatttaagagaaaaatcagtttaaattagttttgcatgtattttaacctgcttgcatcgggcgcccgagcaggagtcgtctccgaatttattggggtatttggtttgtttgcaaatataaatttactagcaaaatgcttgtgcttcgctacgggtaaaggaacggttaaattctatgaagtacatcgttaacatgtatataataatgttccaatataggtaaattgtttattgcgctaatgataatcaagatggataaaaatattcctgtttagctcgcatcacgaaagaaaaaattaaattaaaacatattaaattctaatttaatgaaatatatatattttttgaaatattaattacactctttgaaattatagcaaaagtgctcgttgcaactgcaacgggaagtgtatagaccagaaaattgagaaaaagttaagaaaaatctacactaagtaatttattaaaatacaaattttctgaaatatttaatattttaagtaggtaggtgtaaaactaaattaatttacaagtaaagtaagtgtgagaaataaaatgacatggttaagtaagtgtgagaaataaaatgacatggttaaatttaattttattaaattctccatgattagttatgctctttggaattttatttaaattttcagagcttaattgctaattttaataatacaaacatcatttaacatttatttaagtggaaaaagaataaaaatcctcccttttaggtttgggccgaatatggaaaagtttatattaccgcccttttgcctatcctatgtatctggactattctttctccgttgaagttcattttacgtcctcatgcaatcacgcggtccattcggcagcccagtaatgtgggggcccaataggccgacagcccgatgcgggaacagctggagccgtctgatcaaatgaacggtctagattgatcctaacctaaataaatacccaaaacatatccctagaatacattcccccctccctcccgaaactcaaccgagcggcagcggcaccaccctccccctgcgagcggcggcgtcggcggcggtggcgccctcccccacgagcggtggcggcgccgcgccctccccccgcgagcggcggtgtcgtcggcggctcccccaccgagcatcggcggcggtggcgccctccccccgcgagcggcggcggcgcggcctccccccagcgagcggcggcggcggcggcgccctcccacccccctcactctctccacttctgtaacatcctaaaaatttgaccaacaaaaatcaaagttccaaaaatatggaccttcaaaaattttttaaataaattgtatcatgccgattttgttcacctatttcattggattttaatttcggagttcatagatcacgaataaagaatagttaattaggaataaaccctaaaattagattggcaagagaaataattaagatataatttaaaataaagattatgtgaggatagaaataaataaaacattatcgcgaccatatttatatcaattaaatttaaatgtgatggaataagaataaactctaattaaatttgaataaattatatataaaaataaaatatgggtaatgttaatctaggttagagcaacacaaatattgtgtaaacttgatttgtgcaaaaattagaaatattgggacaagatttgaataggaaaaacaaccaaatagaaaaaatagaaaaagttaactgttcattgcgctgtaagtgttcgatcgcgttccctagccctaacccctcctctgccgcacgcgcctggccgccgtcacgtcgccgctgccgcccgccctct

SEQ ID NO: 44192 - DNA, 14990 bp, Oryza sativa
tgccgcgccgcgtcgtcatcgcatcgccgtcagccgtcgcgccgagccccgtgccgcgccgcgccaagccccatgccgcaccgcccgcccgtcgccatcgccgcctgccgcgccacacgccgcccgtcgcgtcgccataaggccactcgccccgctccacgccctataaagcccgacccctcctcttctccaccccacacacatcctctccatctttccccctctccctctccctcttccccacgcgccgccgtcgtcgtgccgccgcgccaccgccacgaagccgccgcgccgtgccgcgacttgcgccgccgtcgccatcgtcgccaccgccgccgctgtcggtaagccgccccctccctcgcgtccaccgccgcctccgcccggggtgggcaaggagccgagagagagagagggagaaaggagccgggagggagagaagagagaaaaaaaagaaagaaaagaaaagagaaaagaaagaaaaggaaaaaggggaaaagaaaaagaaagaaagaggaagaaaataaataggcatttgagtaaaatttagaggtttagaaaatttaaaataattagaatttaatcgtagattaattatagtcgtaaaactgcgaaatttaattatattttggtagcctctatgagtaatcaatttgcggtaggaatttagatttatttaagaactaaaataaatgtgttgaattcttaggaaaattacttaggagacacaaaatgtcttaggttgaggaatagttctatttcgcaaataatatagtggatataacaatcgtctctcgtgctcgcttttcgatttggtctttattggattttatttgaattctaatggaattcaaatcaattcttcgcacgtacttgtagagcccgagggagttgcggatccgagcgaaggtcaagacccgcaagattttgagcaaggcaagtcatcactattccttgaacatgttgatcccaattgcgaaattatttcgtttacaaataaaattgcatgcaatgatgaacatcctacttgtgattatgccatgccttgattattgtttacccttatacgttcgtaaccatatttacgtccatatttacgtatgagaccctagtcaattatgacaattgcttagaaatgctattctagaatcatgcatactcatatttatcaaatgctatatgcttgggcaattacatttgggaaggtaattgagatgtggcatgtggagacatgagcgccacattgccatgatattgatgacatgatctgtgaaaggaaactaaaatgaaacaactgttttcgactggggcggctggaggatttgggtggtgtccggaaaaggctagtgccgtccctggtcaattaaggaccgagtcatgaagttaagcatgaaacgacccccgtacaaccgcacttctcgtatgggtatagacctagcggagtagatagctgagcggaggcagtatccatgcatagtggtttcttgacgtgtgaggcaggggctctacggtagggcagccattggtaggaccgcaaggcgggtgtctaccattgtgtcgccatcggtaggactgccatgtgagaatctaaacataattataacttaatgcatgtgtgagtcttcccttcccgggtgcgccagaactcttctcactgctagaaaccgtgtacgcctagagtgcatgaggatgtaaagttcatggagcgggtactgccaatgcgaggttatcgaaaagctttgccgtgacgcgtctcatgtgttgggacgaggctcatgtgttgggcagtcgtggagcgcgggtaaagtgtacacccactgcagtgtgagtaaaacaaatctattcgaatagccgtgctcgcggttattgagcaccgggacatgtattacacttggctagactctaaattcttaacttgtgtgggatgggatattgcatgatgatttttatgctgttggagccacttcctgagaggagggaaggtggacgtcctcagaaaaccatgacgactcaatggtgggaagctatccttgagatcacaatggatggtgacataaccgtcgttgtttaaatgtgaacactggtactaaaatttgatcagtcaatgctaggtcttaggcttgtgaaaagaattacaaaactggctttgcgcaaggaaccatagccatcctttgaatacccctatcatgtgcattgttgctataatggcttgctgagtacggttggtactcacccttgcaatatataaacttaatcagaggccggagacgaagcttcggaggatccctacgcgtactacgaggagggtgatgaagacgatggcgctcagtaggtcttagttacggtcgttgcctgtggcaatggcgtgccgctgccttaactccgctgccttatctacttctacttttggaatgtattccggaccgctcggtccgatgatctaagactatgcctgtgggcttatgatgtaataattcacactagactttcgtgtatgtgcatttggtatttcagctacaaattcgtgtgtaccagactacttgatccaaggaaatggtactgtttacacgattgattcctgttataaaaacgggggtccacagagctggtatcagagccatacgactgtaggaaaagaccaaaaggcgcccacccccttttctagttggtcaaaggagaaattcccatttagtaatactttcaaaaataaaaacgctatgtttacaaaactctatacgattttcatcttactcttaactattttcttcacaaaacaagttttactcttagctgactttgggtttttcttaaaattagatggcagatcaggattcacccactacctgggagatgggcgtaccccgctcagagggatacgtcattgagctacatcggttgatgaggcgcctacggtaccccagatttccgatctaccgagtgagacagtgtggacccgtttgggaggctcgggttgaggttcatacacgagttccttcagagtcagactacaactttccgacacgccaccgtcgcgacttaccggagaggcctttctccgaattagctctattcaccgagctgagttagcgagtaccgagtttgctcaccacccatttcgagaggagagcaactccgtctgcacagtccaggacacaccttgctgctacaacccgacagtgactcgactgtcccgatgggctgaggcagtagacgacttctacgaggaggctctgttagagatcgacgaccagtagaggcgtgtgggagagttagagagactgaggtgactgacctcacagtgcagcagcttcagctagaggaggagcacctggcttggggcagtgagatagactcactaaaggtacagcttcaggtccacggtgaccagtttcagcagctatccgatcatcacaatgattgccgcgggatgatggatacactcgaggagcagctgagagagagtcaggagcatgtcagccagcttgaggagcagcttcgagcagctacagccagcaccacaggagcttctacttccacagcagtagggcgtgaccgctacttcttcctcaccccgccgtacccaccagcgttccacgctcttttgggagaggttggtatgctggctactgagtcagcaccttacttggtggacccgacagtgacacagccacctgtctcggagattgtgcacactccactgatccctacaccttcgccacagctgggttccagtttggagactccaatccaggtcgactccgagacagaggggaccgacactaagccagagatagagccggacatcactgatctttcagaggatgagactcctgcccaccgcatcacctttgtcggaggccctcgtaccctcagcactgctcgcaagagcacacgacctccgggcaagaagcccaagccagatccagaggccactacttccgagccgtggggactcaggtttgcccgtgccagcgaccaccctctacctgcccaggatcctgcggatggttggatgattagaccggaggactgttgcagcttcgatctcgcttcagatggtttttggatagcatgcgagacacacacacccctacctaaattgacgagtagcttgatgattagttcgatgtatcttttggatgaactttatttggactgcgtatatgtgcagtcggttgcatcatgatttatgtactatctatggaactctgtgatgttatttatcatattattactgttgtgttatgaatgagtttattccaccatgcttgcaaaacaaagttcacaatcaaaacaactcccttaacgggataaaaccaaaagggctagttaggaaaataggatacatacctcatcggcctacacagatggcaagccgacgtagggcgtcaaccagcaatgaagaaactcaagtacccgacctaaccaccctggccagagttatggccactcaaacccaacttctgcaagccattgcaaacaatcaagacaactgcggaggatcgagctttggagagtttatgaggactaagccacccactttcgctacggcagatgagcctatggaggcagaagattggctacgcatcatagagaagaaactgacccttgtccgggtgcgcgaagctgacaaagtgatcttcgcagtaaaccaactggagggaccaactggcgattggtgggatacttacaaggaagctcgggaagaagatgctggagaacccacttggggagaattcactacagcttttcgtgagaacttcgtgcctgctgcggtgatgcgcatgaagaagaataagttcagaaggctgcgacaaggaaacacaatggtgcaagaatatctgaaccggttcactcagttggcctgctacgcaatcggagatctcgcagatgaagaggaaaagatcgacaagttcatagaagggctgaatgatgaattgcgtggacctatgattgggcaagaccatgagagcttccagagcctgatcaacaaagtcattaggctggagaacgatcaaaggactgtagagcacaaccgcaagaggaggcttgctatgaatcgcccacctcagggacctcagcgactcaagggagccacttcgtctgggtggaagccccctattgtggcaaccaaccgtcccgccgcgcctagcaatttcaacaggctggttgcgattcagaaccacacccctacaccaactctggctacccctggagccaagaagaatgtggactgcttcaactgcggggagtatgggcactacgccaacaactgccctcatccacgcaaaactcctgtccgtactggtgctaatgcaatgactattcgtggaactactacccctgctgccggacgaggtctattcaagactccgcaaactaacaggaccgctaccggatttggacgcggacaagtgaaccatgtccaagcggaagaggcccaggaaaatcagggcgtactaatgggtatgttctctatcaattctaccccggtttcataatgtaagtctatattcattaacatctatatgattgtaggcaatgctagaatgacttacattatgaaacagaggaagtacttctattgcataactaagttacttctgttgcatgtaattacttctactacagaaagttacttctattgcatagctaagttacttctattgtatagctaagttacttctacaatttaaatacattacttttaaattaataaaatatttgaatatatccaatatggatcttgcattatcacatattttatgtagagtataatgatgcaaatatatcttgaaaataatacgtgatttaaaatatataagttattaaagagcttaaatctaaatgtaatttatgcatatgataaaagtaacttacatatataataaaagtaatttataacatatatatatatatatatatatatatatatatatatcagaatataatcatgtaagatcttgttgtaaagatttaattgcaacgaacacaacagtataatcggattataaatcagataagtaatttaagagaaacttctctaagaagaaaaaaatacatagatattaagtgtagtagtagcttttttttttgaaagaagagtgtctctttttagtactatccagctagcattctcagtctagctatgtccatcttctctttgtccctttccagtggtccccatttatgcatgtacaacacaatttagaaaggtaacatcggtatcacaggtgtgggatagtgatacacatataatagtgtttatataataatagcgttatgcttggttcatatctcgtatattttcacagcacgaatcttggaggggatcaagtgagatacagaaattgattgtaaccaagcgaaaaatttggcgacagtattttagcagtcggaaatgcgagcatccatgtaaattaatacggatgaacaaatttcattataaataacctaaccagttgaactatgctcgattcgtatgattgcataccaattaactataatatgcaaagtgaaatttataccagtgattagaaaaaggccaggtaacagttggacggggatggtgcgaaagacttctacagaagggagctcgaggcgattatcttctccccggcgatcagccggtggccaaagctcacactgactgacataataatacacacactctcactcatcttaaactaatagagcaaatgacaattgtctatcaaactctaaagcatattgaaacaatgaataactaacccaattatttttgttagagaaaaagttagcattcccctgcttttgatcgactaacaaaattaatcctttctacatggaaataatatatatgttgtgcccagctttttatcgtcaaggattaaaattgccttcgatgcacttcttattccttggtatgcctttcccgtgtccacttaaacttcgtaccaccattgaacctatgaacaccaaattcccaagcacaaggttccccaatacccttggtaacaaggcatgtcaaattgataatctttgccttccacccgacgacgatgaaataaatattcgtagtcaagctccacggtcatcgtatcaagagacggtgaactcgcgaacaatagttgtatgaggcttatttgatcatccaatgatgcaaacttacggatatctaccactcttagattcttcaatgatatcatttggtcttcccaatcctctggctggtgacaaggcagcctgattttaaacaatacaagtcatactgcaataacaccagtacagaaaacaatatatatgttagtcatttcaagtttgattagacggtagaaatcctcttttatagaagattcatataagagctaaatcttacatacccatagtgaataatcaatgtgaaggtattgaatattgttgcacttaacgatgaacttggctagactagctcggtagctcctacggcatgcccgtcgaaaatcgaactcacttttattgtcaaacttgtgacactgggaagttgtggtacatcctttatggtgtcctcgtgacctgcatgccacaatcatattttaatcaaaactatagtgttattgcaaacgagaaaattataggatatctatactttctatatatttggtacccactaaaactaaagctcaacatgcaagcatgccacatcttcactcactagcaattactattctagcctattttaaatctcatacaagcatgacatatcatctacaatattgtattatagagatcaacaagtatgtgtcaaatcatcttcctcacattattttctcaacatttaaactttcatcatttcatcaatattttaacatatactcattcgttaatctcacagcaaagcgcggggtatcacctagttagtactaatatatactaccatgtcgagctacaaatttaacccgtcaaattaatagagaggccattaatgacggttttggtcatgagggccaatcttcaatggggaattttttcagaccgtcatgtgtatatatgatgggtcattggcctccgtcaaagatgcctggttgtgtacttgtgtactagtgatatatatatatgtatagaagcaatgcacataatgaaaacgacgatagttttcttttataagtgggacacggatattacttcatctttttataagagatgcggcgctgattcatggttcatgctgcatatggaagataaattaagagatactatagtgtgtattatgttaccttaatttatctagtatgccgtccgttttacaatataagactttctatcattgtctatatttatatagatgttaatgaatctaaacacatatatgtatagattcattaataactatataaatgtgtgcaatgctagacagttttacattgtgaaacggatggagtagaatataacgttatacaaagaagcatagcaatgtgcgtaccttcgtccacataaatatctagtttcacccctaggtgaaccacggcgttgcagttcttgaggagccagacggcggcggcattagcatcgtactgatcgtcgcctccgccgccgccgaacgacatgagccggagcttcttgatgcgccggacggccgccgcgccgtcgaactccagccgctccgggtccacgaggctctcgcacgagaacacctccagcctcgccgccgagatggccatggcggaggaatcggaatagggcaggcggctgcagtcgccgacgcggctgcagccggagccccggcgcgtccacgtcgagccatcgcaggtcgggcagatgcaccagccggagctcctcgagcgcggcggccgcgtcgaggcgcagtgtggcgacgccgcctacgtgcctgaggctcagcctccgcagccgcgggcagcagggtgacgagagcaagtggccgagccggaggtcgccgccgtcgtcgtcgatgatggcgtgctggagcgtcagctcggtgagggcgcggaacgcgccggcgactgcggcggccgggacactggcggtggcgtatccgagggtcaggctcatcgtctccgctctcgtcgagcgtggcaactcgacgacgacgacctcctcatctgccggcgccgccgcctcgccgtcgtcggtcaccgacgtcgctgctgtgtcggcggcttgcgacctcgcctctcctcttctcggcgttctcgccgccactggcgccaccagcggcaactcgaggatgaagctccccttcacatggcgctcggcgaagcggagccacccgtcgacgcgcgacagcgtgatgtcggcttcatggcgatggtcgtggaagtagtacctcctcaccacgccgtaaatacacaaacagttgtgttcggagctgtacaccagggagatctccatgacatcgacttcgtcgctgccctcgccggcggcggcgcgccgcgcgaggagtgtggcgtccacggcggcgatgagccgccgggcagcgtcacgacgagagacggcgaacttctcctggtcgagctcgccgtgctcatccgcgaaggagcccggcccgacggcgaagaggccagaggcggctgtcaccggtactgtaccaggtccgacaatgcctacggcaagtaatccagtgaagacgcaaccagcaagagaacgcatgcctaatgtaagagtaactgggccggaatgggcttaggtccagaatgtaaacgtgcgagtatataagcacgagtgagcagaggggaaaaggcatcgaacaagtgaacagaaaaactattcctccctaactactgcatcttcccctgctccaagttctctctgttcctccccttcttcctaccccttctctctgttcgaatctgctcctctaatcccaaaactcccaaattcgcaagcagattcgtaacaataggtatcagagccatccatcctggagtacctcgacaaacctagataccattcccgtgcgcaactcaagtcccaagagatggagcagcaattggcggaactcgcggcggccatggcgacaatccagaagcagaataccgccatccaagcttcgatgggatccttggaggaaatcaagcctatggtggtggaactcgcgagctggaagccagcggtggacaaggccatgacggagatgcgggacgacctcggcgacctgcgtcagcaagtggagcggatatcccgcaatccgattctcgccgtcaagccagcggatctgccccctcttctacccacgccgacggtgcctcaaatctcggtgccgaaggaggaggagacggcttccaaaggggcggacgcgagtccagggccgttaggccatggcgttgcaacgatgaatcgggggaaggcgtctggagatgatttctctccaacgtctctcccggccaagggtacgtgtcaatttcagtctccatctcgtgttcctttcgaattcggggagagttcgaattgagtttttgcttcggggttccatgggggtaatgctagagtagattgcccacagtttgaaggagagaaccctagagcctggaaaatgaaatgcgaaacctatttccgagtgagtgggattagcccggatgtgtgggttggggttgctgctttgcaattttcgggaagtgctcttgtgtggttgcaatccaccaatactcatgtggaattgatggggtggaatgatttctctgaggctgtttgtgctaagttcgggagggaggaatttcagagtctcattagacagttcaagaggcttaggcaggagggaaccattcttagttatgtagaaaaattcaatgagcttatgcatcaactctatgctcatcacccgtcctggaattcagtattcttcattactgaattccttgatggactgaaacctgaagttagctcagcagtaattttacatcgtccaaacgatttggatactgctgtggaccttgcttgtttacaggaagaggtgttggaagcgggacgacgggattcgcatcggattgatggaggtttttctcatcggaccggacaacgccctgtggggaatgttgcttttactcctgggcgagctggtgggcgagttgatgacagaactcagcctctggaggatcgagtggcagcactacgtgcttatcgcaaggctaagggattgtgtcacacttgtggggaaaaatggagtagggaacataagtgtgggccaactgtgcagttacatgttgtggaggagttactcgacctgcttgaggaaccggatggggaagccaaatccgctggaactgatgagctaacagaaaaggcttctgaaactgttagcgaagtctgtcagatatctaaagaagctatgctagggactgaatcttctggaactttgaggctgcaaggattaatacaacagtatgagataatgatgcttgtagactctggcagcactcatagctttatatctgaagaaatggcaagcaagataagaggcaatcagaaaactgtgcaagcttttcgagttcgggttgctgatgggggaatactccaatgtaacaaagaaatgcagaattgtctttggctggttcagggtgtttcttttcagaacaacctgaaggtgttacctctcggaagttatgatgtgatacttggaatggattggcttgagcaacacagtcctatgcaaattgattgaagggctaagactctgagattcaaacatgcacaaaaggatgtttgtttgcgaggtgttcgagctgataccagcagctgtacatctctatctgtcaatcaagttcaaggactgattcatcgggaagctgtgatgcaagtggttgagttgtgttctctgatcaatgaaacagataatacagaagtacctcaggctgtcgattagttgttgaaagaatttgtccatgtctttgatgagccaaaaggtttaccaccggccagagtatttgaccattcaattcctttactgccaggagcaaaacctgttaacttgcgaccttattgatataatccagctcaaaaagatgagattgaacggcaagttgcggatatgctccaacagggaatcatacaacccagctctagtcctttttcatcacctgttctgctggtgcttaagaaggaccttacttggcgattctgtattgactaccgccatctcaatgcaattacagtcaagaatcgatatcctttgccaattatcgatgagttgcttgatgaattagcgggatcctgtttattcacgagtttcgatttaagagctggctatcatcagatccggatgcgcccagaagatgagcacaaaacagcgtttaagacgcacaatggacactacgaattcagggttatgtcctacggccttaccagtgccccggctaccttccaagtactgatgaatcagatcttagctccattgcttcgcaaaggagtgctggtgttcacagatgacatcttaatctatagtcaaaatttggatgaccatgtagctttgttgcgacgggtgtttcaattgctaactgatcatcaacttaaggtcaagagaagcaaatgctcgttcgcccgtgcaagtttaccatatcttgggcatgttattagtgcagaaggtgtggccactgactcgaagaatattcaagcggtgcacaactgggcagtaccctgtaatgtgaaggaagtgcgaggatttttgggtcttgcagggtactaccggaagtttgtacactcttttggtattatcagcaggccccttactgatctgctaaagaagaatgtggtgtttgtttggacgtcggagcatcaagcgtcttttgatgccttgaaggaagctctagtttctgctcctgtcctagcactaccggatttctccaaagtttttgaaattgagaccgatgcgtctgataagggtgttggcgctgtgttgatgcaagctggccatccgttagcctttctcagtaaatctttggggcctcgaaatcaagggctgtccacttacgagaaggagtgcttggcgattctcctcgctgtggaacaatagcgctcttacttgcagtttggagagtttataatccgtactgaccagcgcagtttgattcatttggatgatcagagattagtaacaccttggcaacagcgtgctctgaccaaactgcttggtttacaatacagaattgtctataagaagggactggaaaataaagctgccgatgctttgtcacgcaatcagtcaaccgatgtgtttcagctcagtgcggtgtcttcctgcattccagtttggttggcagatgtgcagctgggatatgctcaggatcaagtatcctctcaactgttgactaaactctcgtttaagtcctgaggcgctccctgagtacagattacagaatggcattatctaccataagggaaggatttggttgggtaacaatgtggagttacagactaaagttctgactgcactgcacaacgcagcaattgggggtcattctggtactcaggcaactttcagtcgagtgaataagttatttgcttggcctggactcagaaaagctgtgcgccagtttgtgtcggcttgttccatctgtaaacaggccaaagcagaacgggttcggtacccaggtttcttacagcctcttccagtgcccgagcatgcttggcaaacagtctcgttggatttcattgaaggcttacccagctcatcgggttttgattgtatacttgtggtggtcgacaaattcagtaagtatgctcactttgttgctcttgctcatcccttcacagccttcgacgtggctctggcctacctcaacaatgtctacaagatgcacggattgcctcagcatctgatctctgatcgagatcgtatctttaccagtgcattgtggaaggaactctttcagttggccgacactcaattgcaaatgagctctgcttatcatcctcaaacggacggacagaccgaacgggttaatcagtgcttggaaacctttttgagatgttttgtgcacgcttgcccaaagaggtggtatcgttggcttgctttggcggaattctggtacaatactgcctttcattcggctctggacaaatcaccatttgaggtattatatggtcattctcctcggcattttggtgtgttcgatcgctttgagtgtgctgttccagatttgcaagactggttgaaggaacggaaagtgattaccagtttgccgcgacaacatctgttacgagctcagcaaagtatgaagttacaggctgacaagaaacgttctgatcgtgagtttgcagttggtgactgggtgttcctgaaggcacagccgcatgctcagttctctatgacaggacgttctaatcacaaattggctttccgttattttggcccctttcagatcttggcgcgcattggaagtgtggcttatcgccttcaactaccgacaacttgtgctattcacccagtagtacatgtctcacagctccgtcaggcttcttcaccagctcctgactcgtcgattcaagacctgccagcgttaactgaagatgaagcgctaccagtccaaattcttgctcgtcgtgcagtcaagaaaggcgctggagctgtggaacaactcaagattcgctggtctggtcagacgtccgctgaagcaacctgggaggatggtgctgcactgcgtgcgcgtttccctgaagcaccggcttggggacaagccgtttctgaagaagaggggaatgtcaccggtactgtaccaggtccgacaatgcctacggcaagtaatccagtgaagacgcgaccagcaagagaacgcatgcctaatgtaagagtaactgggccggaatggacttaggtccagaatgtaaacgtgcgagtatataagcacgagtgagcagaggggaaaaggcatcgaacaagtgaacagaaaaactattcctccctaactactgcatcttcccctgctccaagttctctcctctgttcttccccttcttcctaccccttctctctgttcgaatctgctcctctaatcccaaaactcccaaactcgcaagcagattcg

SEQ ID NO: 44193 - DNA, 19621 bp, Oryza sativa
aagccatggatgatggtgattgaaacgaaagcttgcatgaagccatgaaatttgttggtgtgaaatacatagagggtcgaatcaagctcgggatacatggtcgaatcggagtctcgatcgatcgatgctaattgcactcccagtagggattcgttctgttattgatagtactagaaagaaacacgcgctacgccgcgtgtgatatgaattgatcaaaatgcacaaagagtctgcttgtccttcatatatagagttgtgcatatatggagtgaaataacctttgaccatcatcacagtgtgcatttatgataatcaggtttttctacataagcactattactctataatgttgaccaaatttgcaaacaaactatactgtagacgaaccatttagagaatacatatacataattttatataggcaacatttatcgaatttaatctaaaatcacaaagaaatcttattattaaaaaaggaatgacataagtattacaaaatactgaagaaccacagtgttagacgtctactggcgcggtgagagaggagcggtggcattttgactggttagcacagaacttagaaccgcgaagattgaccacaatagaatcaatttgtaactattatccttgtgaatatttaattaagagcaaaacacaatgacattccatagcttgtgagtggctaacagtagtacggtccattgttaataaaattattggtaagctaatcatacaatccaaggaacttctcacagaaaaaccaataagtttgataacaatattggctgacgggaataagtagataattaaacagagctaggtagataatgaagcaaggggaaaaggatgtacagtgattgttacaataatatgatattattgcgtggcaaaatgtctctccattgtaagaaaaggtgtgaaaaatgtacatgcaaagaaatccatatgtaggagacctaaagctaccaaaattttggatcacgaaatctccatgtcatggtactaaataaataatccaccatggggcaactgcaaattataagtgccctatcaagcgatcaaaacatatgtggaacattgtgagaaataggcagtaatttgtatgttttatcagaggttgtatagacaaaaatgagagaacaaccacatgcagaattacatatagcattttgtttgggcaaaactggaagtctcaaacaaaacttacctatggatatgttgtaccaatgaatggataactcttgtttcatgttggaaacatgcaaattgggagctctagaattagtttagctattcatcattagctctgcaggcacaaactattgattcccagtaggctatactatcctacaggttcaggaacaccacaataaataaaggattgagcatattactgaaataaaacagaacattagcctaggttcatcactgaaactccaatgcaagcacaaatagtccttgaagggcatgccatgtcaattatgcaaaatgacagacattgctagaaattcatatagcataccttggcagtggattttctataaagcaagaactatttttttaaagaaggaaagcaaggcaatactatgcaaccattggagtaaggagatgatgacagcaaatttcatttacaaagaatgccaatatatatatggccatgtccacaggccaaccgatgctatccacctcctcaccaatgctagtgctattatacttgcagaacgaacacacagagagaaagcagcagtaataaagtgaattgctaattttgtgtaccaatcattcctccactgatctattttgctagtatgcgcattggtttgcgtgtacatcatgagagtagtattaccagcaatcaaccaagaaatataaaaccaataataatatcaaaatgtgcatgttacatcttgtgtgagagagttggcaaatatgacataccatggctaaagcatgccttctccagaccatacaaaaacacatgatacatgtctacctgcagctaatattaacaggttaattccagggataagtgaatttgtaaaaatcgaacaaaaaataatttatgactaacccatcatccgattgagggggatggtattgtggctctgtgagatataaacagctgttgttcataaaaaggagaataaatgtgagaaggagaaaggaggcatagctgctgacctggggaaggagtaatggaggagcacatttgaacagtgaccttggctgggagatagaaatgaccttgaagattttgaggtccgggaggcccaaatccatggcgcatcatcggcgaaacctgacctcctgctgtgcaagcagcaccatcgtcaacaatctttagcctaattagcctaggaacagcggcacatttggcattgagcaacccgcagaatatcaactaattaggctcaattcataggataacaacccaaaagctagtaaatgcaaccagagcagtgaagggtctggggaagaaccaccaccacctcatcctgccactccgtaatcttctgcatgtgctagctgcatgacagaatacataaatcatttcattaggcaccatgtttgctccaagatagaacaaattttcagtgcaaagcgatcctctttggcacacacctatttgcaaaatatcaatcaaagagcactaattatttccccccccccaaaaaaaaagagcactaattatttgctccaaaaactcacctgcagacaatatgatagtattatggtgggctatacaggagaggcaacagagaggacagcttcttctcatcctaatcctcctctacgccatcgccgtacccagtacacagtccaaactcgaaacccacatttaaatcaatgtaattgctcgaaccacacgcccgttgatgaaaggtgaaaacacagggagctaatccacgcacggacgcacctagccgcaggctgcgccagtgacccgtagaactcgatgcgtcgtcaccaagccgaagacctccaagaaactgttgcggagccgcagcaacctcaaatcgctgggacctccagcagcagcagccacagccaaatccctcagctagaggctccaacgacgccgctaggtccccgacctcgaggcgatgttgaaaccgccgttgagcccctccatcaagcgcagccacgaccatacactcgaggggagcactcttagatgacgggtaaaacgacggcgctggaaaggccttggaggaggaggaggagtaggagcaggaggcggaggagcattggcgccgcgccgccgccggtcacagaagggagaaaggagatcccaactgctcctaccacattcttctactggagtggcccctgagcaagaacccgcatcaagtggggcgaagagggagagaagaagaaaagggctatgacgctggcttacctccgtcgtctttgggtagccggatacatcggcgagccagccgatggtcccgaggcggatttggcgccgcacagaccggggcagagatgcggctcgcagcgggcgacggatgcggggtcgcggccgcggccggggtgtgcctcgctccaggcggtggtgtccctcccgactccccttctcctccccagcctcctcttaacggatctggcggctcattgggagttagcggtggtggcagcacggtagaggagaagggagttgcggcggcgacggcgacggcgacggcgacgacgcttgcgagcggaggttggcgtcttggcgccggatccgccggtgaggagaccggggtcaccggatctgacggccccggcctccttactaggagatccgacggctcattgggagggagcggcggcggcagcacggtagagaagagggagctgcggcggcgacggcgcacgcgagcggaggaggcgggcgaaccgacgtgaattctttcgaaataggatcttttaatattttagtttgtaaatagagttttgatggcaaattctcactagtaaacaaatacaaaagattaattcttagaaatgattttcagatatcgattaatattagataaaataacttcctccgggaattatccctaaaggggtttcctttaaatatttagtgattataaatactcataaaacaaatacccaaaaaggggttccaatttatagagacagggtttttaggaaaatgatttattttcacaaatactttcttatttcataatcatggttccttaataaataatattttaattcaaaatagattttattcctagatttccgtccttgtgtcccaagcacaacaaaaacggatagtcagatccaataaacttcggcacgaaggaaattagaaaaagatttttggttattccgaattttgtttccgtatttcaaactcgaaatttttagggtgttacaatagattactctaacccgcccataacaactaaggtggaattaattccacgatctcataacacagtaacacatgagccaaattcaaataggccgatgtcacctaatttaaggtgactaaataaaagggctgccatgccaaaaaaaattatagttcttggacgtgcaaagctgccgaccctgtcaacgtcgattctttgtcctgatctgttgtagtatgttgttgctctctggggtagatatgtgtagatttctcaatatcgtcatcggtgacatcgtcagtctcattgccctctttgctcttaccccacagcatggtgtaaagacttccgaccagcaaaattccacccaagatgctgccaataaaggaagagcggaaaatgaaagtttgtttatttcagagtgtttttagaatattgcacctttgatcagttgacagcaagtacatatgatttaacttacctgccgaggtgaacaatctctccaagaaagaaggatgagcaaaatattgtgaacacgaaacagagtggcgtccaggaggcgaagaacatggggcctctcatctctaggcaccacgtttgcaggtagtaggacactcccgtcaccataacaccctgaagcaaaccaccagtcgtctaatagtcagatgcgtgtgcagaagaccatgccaatagtgaatacgctagtggaagaggatgactgaaaattttatgtacagaacttaccgagtataggatggcaagcaagctgatgtcgaatcttagcttccatttggagaagtcgcgctctgcgaccacggcgacgacaaacgactgcaccgtgctgaacaagcattgagtcaaagtcacaatcattttatctggatattccttttgcaccgctgcctgcacagtcaatagacaaggagtggagacctcgattcatcagcaattgcagatgtggatcgatgcagacaagcatgcaagaacagctcagattttttttaaataactaaatatgcatgcgaacctgaaaaatgatccacaaagaccagcacatgttggcgatcaccataaggaatgtccatttgatccacacacccctcggaactacatttttagagcctgcgtcagaggcgaaggcacggtgatggttgatagggcttatggatgggccggtgaagaaggcgatggtgaagactccagccaggcagagtgctacgctagtgaccttggctatgcctgaagagctcctcagcttcacatactccgtcctggcaagcaacatttcaatcctggtattatatactactccatccattcaaattatgtgtgtcgatatagtgtatatctaaatatgtatatcaaaatttatgattaatgtcaaaacatcttataattaatgttttcacaactaacttgaatctatttatggtacattctcaagttaggctttaatgatgtctcgtttagagcaaaaataatagtgagctataagcaagctatatgcttatgtggaagagaaggataaacaaaagtggggagtgttggctctcatgtaagagctaactgcacacaagctccaagaaacatgcattaaattcataggagagaaaaagaccggatgaaaaaaataaagataaccttatagttaacctattatacatgttagctttcacaatgactaatagtaagtagtgagctctactattaaacttgctcttaagaggtggtggactatgatatcgatgatgataaacctcaaaagcactgccaagaagaaggtgatggctgggagtgagctgtctactgcagatgccaccgttgcagaggtgaacttgaggcttacatggtacagatttaccccaagcgtaatcctgaaaagcaatttccgcaggtaaaccagcagagactaattaaactcttgacatatcatgagtatacaatcgatcgttttttttgttttgtttttgtatcaataaattagagattgcaaagatgagtgcatacccgattaaggcacaaaagaagagctttatgagcaccccaagtgtcatgacctgtcgtgcacttttcctacaaatataatcaaacggacttctatttctcagcaaatcaaacaatatagcaaactaaacgaagtggcgatatatatatatatatatatatatatatatatatatatatatatatatatatatatatatatatatatatatataatttattttgtgctccatggtgcccaattttggtcgttcgttttatttaaaaatttttataattagtatttttagtgttatgatatgataaaacatgaatagtactttatacatgacttatgtttttagttttttttaaaaaaaaataaataagacggacgatcaaagttgtgcacagaaaatcatggttgcacttaagggcctgtttagatcacctggcaaaatttttcaccctgtcacattgaatgtttggacacatgcatggagtattaaatataaatgaataaaataactaattatatagattgcgtgtaaattgcgagacgaatcttttaagcctaattgctctataatttgacaatgtggtgctaagtaaatatttgtaatgacggattaattaggcttacacagtttacaagcgaaatctgtaatttgttttgttattagtctacgtttaatacttcaaatatgtgtccgtatatccgatgtgacacgtcaaaacttttcaccttgaatataaacatagcctaaattggacggagggaatacctttgtagaagagctgcaggcagcaagatgagggagccaactgcttggcgatagaagatgaagatgtaggtgttcattccgtggttgaaagcagccttggatatcacaaacatgccagtgtagatcagttgaacgatgatggcgacaaaataaggcttcatacttgctttcaccatctcgatacaggaatagcaaggcgtgcgtagtgtttgtgggagtgtattatcttcagtgtgcgagagcccccgtttagttcatggcactactcctatgtatttatattaaaaagaagaagcaagcagtatgccgctcagtcatgtgctcaggagatgtaaaacagcagcggtggtcggtagtgtgtgcttggacggttggacccagtaacggcacgccaagtgtaaacgcaagagcacggtaggtgtggacttggactgagtgacggcacgtcgtatggctttgacttggactttaacttttaagcacgccagatccacagataggagacccacttcgagtctgtctaccaacgttcagctcgagaggaccgacgttccgtggccgagcgtgccgcgcagatgcctgtccagggaccaactttgaccttactgtgccggacacgagaacgcacgcaccggagtaggactggagtatggtcaattaagtagaaaacaaatgtatggtcaaagtcgctgggattcgctaattgctacgcgcaagcaaacgaaggctgtgttcgtttggacgttttccccagcgcgctacagtaacacggaaaacggaacggttcattaacacgtgattaattaagtattagctaattttttttcaaaaatggattaatttgatttttttaagcaacttttgtatagaaactttttgcaaaaaaatacaccgtgtagtagtttaaaaagcgtgcgcgggggcaaaacactgtagcgcgacgggaaaacgtccaaacgaacacagccgaaatcacgcgcgttttggatccacgcgttttcacttttcctctttttttttggcctggtttagttgctactaaattttttttctaaaaacattacattaaatcttttgacacatacatagagcattaaatatattaaatatagattaaaaaaactaattgcacaattagaaagaaaaatcgtgagataaatcttttgagcctaaatagtccatggttagccataagtgctacagtaacccacatgtgctaataacggcttaattaggctcaagattcgtctcgttgtttcaaggcgagttataaaattagttgtttcattcgtatccgagaaccccttctgacatccagacaaacatcgatgtgatacccaaaaattttcttttcgtgaactaaacaggccctttgttttcttttccccaccggatccccgcacgcgcacacgccgacgcgcattttctcctctcccgtaactaaccaagtggcggcgcgcattttttcttctcctgtaaggccctatttagtttccaaaacaaaaaaatttccacactgtcacatcgaatgtttggacacatgcatagagtattaaatgtgaaaaaaaccaattacacagattacatgtaaattgcgagacaaatcttttaagcttaattgcgccatgatttgacaatatggttctacagtaaacatttgctaatgacgtattaattaggcttaataaatgttattagattacgtttaatactttatgtgtgtccgtatatccgatgtgacaaccaaacctaaaaattttcctcaactaaacaaggcctatctaaccgagttagtttagaataatgacaataattaaaaaaatattcggtagcgctaatacgcgcgcagcgctagaaatagtacgtttgtccgcttttctcgttttatttctacacacggacctgtcacgcctccttctatttgtcccaagtaaaatattactaccggcttggttggaaatacctaactaaaaaatacgcaagggcttccataaaaaatttcgtctgtcgtccgctttatccacacgagcaattggttccattaattttcgtccgtacgtgtaacgactccgatttgttaccatagacgtggcctgactgaccgttgaatagtcatattgaccctgtttagatcctaccttaaaatttttcaccctgccacatcgaacatttaaacacttgtatgaagtattaaatgtagactaaaaaataactaattgcacagattgcaactaatttgcgagatgaatcttttatgcctaattcctccataatttaataatgtggtgctacagtaaatatttgctaatgatggattaatttggcttaataaattcgtctcgcgatttactgacggattttgtaattagttttttattagtgcccgaacacccaatataacatcctatataaaactcgatgtgacatggcaaaactttactactattgacctaaacatccctattgtgtagcaacacattatggcataaccattgacattctcagttggttagccaatgaaacttgtggccgctatgatgggagttcgattcctatcacccatctgttttgtgctccttatcctctccaaatttttcttttcctctcctaagctgattatattatattttttataaaagtacatccatgtgtttgaaattcatattaaaccagcaatatatgtaattttctaccgtgtttttctacactttgtcacctcctcttattaatattttcgaaaagtatgtccatatgtttgaaactagtattaaaccagtaatacatgtaattccctactgtgattttctatactctatcaccaatgctgcttatcctctcattttttttccttttctctcctaagctgattatattttttaaaagtacattcacatgtttgaaaatttatattaaaccagcaatatatgtaatttcttacagtgtttttctacggtttatcactgtttgagatcgcgactacggtatttgcatggtatagagataatggtaccagggcatatgcaagattgaaataaaagagacagaaacaagaatttttagggtgcgttcgtaagaggcggttgggaactcatttccttcgcacgtcaaacggagcggttcattatcacgtgattaattaagtattagctatttttttttcaaaaatggatcaatatgtttttttaagcaactttcgtatataaactttttgcaaaaaacataccatttagcagtttaaaaagcgtacgcgcggaaaatgagagtggggagctaggaactgggagatctgaacacacccttatataggttcgggccccttatctagcaggtaataggcctactcctgttagtcgaaaccggtgttgctcctttattcatgtaaatcacgcaaatataataattgggataacacatctagctgtcgtcaacttggcggcatgaataaccaacacgtagtcgacgatagggtagataaaattttgtgtgttgaaagaaaatatcgatatatttttttaagtagataagtctaacggaaatgagtgaaatgtgggaatatagtcgtgtgctgatatggaaggaaaatgcgtggagttgaaaaatattgctcccttcataaaaaattaatgtaagatatatttcttttatcatcacaagtctggctctaatgggccgcctggggttgaggctcgtcgcggccttggttacgttcggaggagaacagagcagcagatcgggctcgggcggcgaacgagctctcagtgactcggccagccgtggcttcgtgctgtgcatcgtcgcagcccatcggagatgtgcgtggccttagcttgctgttaacgggtgcctcggcgtcctcgctccaccgaaatcgctgccgccaccatcgtttttcacaagagtgaggaaggagatgggcaaaatgattttctttttagattttttgttgtcggatttttgtctaagtcgggatcaatcgggaacatcttatcagattggctggtcctagcttctcccccgtcggcccagcgctattcccagggcgccgcgctgctgggccgcctcatgtgcggcgcgcgcgctccacttagaagcaggccgcaagtttttggctatactaaaatcagttattattatttttctcttcctgtcattttaagtagtagtattttctatttttaaaaatagcattagtagtcacccctatttaacaaaaccaaataattataggtatacatacaattaatgagtatcaagttgttagtgttttgatcaacaattattttagtacatggagactatatatgatccctctaaaaatatataaaaagagagagaaaaattataaagccgagtgaacagggaaggaaaaaaaaagacagaaacagagcggataaaccaaagcagagcgaattcgcgaactcacattcttcctccctctctcagtcaccggatagaaaaatcagagcagacagaggtggtttttgaatattctgaagatgaagatgaagataaaaattaaatgtttcacacaaaatgaggttgtaattgtttacacccaaatttggcatataaaattaaattaaggaaaattgtcaaaatttggaagtctgccggtttttctctaagaggaccagtctgaccgccgtgtgtcagccgatcagaccacctctagtgggccggttagactggtggtgtgtggccggtctgaccggcagagtccgagccctagtatgtttcatcgggtctcgagttttccttacttgggaaggcatgtttcgggtttcctttggtttctatcccgagttgaacgtggaggagggcctgtagagggcaagaccaatccctatataagagacaaggccggttcattgtaaaaacacaatcaacaatcaatcaataatagaatcgttttttcatattgcttttagttttcttttattttgtccatctttgtcgattttcgctgtaaatcgttcgccgccgctgcgagagtgtgatacctctttgtatgtttgtcctgaaaaccttccataaattagtcatgaaagcgagaaggttatccttttatagtttgctcggaaactagtcgttcgtcgtcatgtaagtaagatattatcttctttactaattagtcatgtaattccacaaaagtgaattaatctcgaaatcagtttcactagccggttttgatttatcgattttgacgactctgttgattacaccctaaattattaggtgatcttatgttgacctaaaaagcgttaacatattttagcaactccgctagggagagaatttcggtcacgcgattagaccgaaatcaatctaatccgctctttgttggctgccgaattaatctattcggcggcgtcggccagccatcagtccgattatctatttatttttatttttgtactccctccgttacagagtataataagttttagagctggacacagttattaagaaaatagataaaaataaatagtggtgggttgtgattagatgagtagtggagataggtgagataagtgaatggtggaggcctagaggattgtgattagttgggaagagaatgttgacgaaaaatttgttatattttaggataaatcttgaggattaaaagttgttatattttgggatgttgggagtatttgtttggtggtgaaatcgtttggcagtactgggaaagcacttctacgcatgctaaccgaggtataaagaagccacgctcaatctgtatgtgcttgtttatctatttggttttttaggtatacacgcaaatcttaccaggaagagtcaagcttccgtgctgaaaatacatcgacgtgtaccggagcgcgacaccactgtatgttaattgcgaggtacaatctacaatcactttgccagtgtcttcaaattatttttcgagtattgtgaattctcatatagatgttgatagacctaatttcaatggatatctgcatcggttaatgattgctcaaataattatttgagatctttgaattatgatgaaaataacatgtcgcagctttaaattttaataattcaagatatccaatatgttcacacaccttttaattgatcggtaattattttggaacctattactacacaataaattttgccgatgaaagacatgcatgggcatatggccatggcagtatgtattatctagttgattctattaattcattacatgccatgccaaataatgggactcacctatggatcgggtggccgattttttctgagaaaaatcgggtgcccacatcatcatgcatgcatacaaaattttctaagcgaactttaaactattttttctcttaagttatttatccaaatcatgatccgattgcactattaaatccattgcaattaaatctttacaacaagaccacacatggatataatccgatgaaaaaatattttgctagaacctatgaaacaacggtttgccaaaaaatcggcgctatttcaccttatataagaaaaataatgtttcagtaaatagcgaaagaatgtttcaattcattgcaatatatacatagtgaaatattatgtgtacactagataaaacatttttgatggaaaaaaaagagacaaattcccttaatggagggttttcataatatatgtgggtgatttgttgcaaaagaatgtttcaattcactgcaacatttgatctatacatagtaaaacatcatgagtacactaggtgaaatatttttgatgaaataaaaaatgagacagattcctttaaaagagggtttccataatatgtgggagattcgttgcaacgaagtgtgtggtggggacacgtggcgtgttgttgtagggacgcgtggcggggcgtgtgggaccgctacgcgaggcgcccgatccgcacgcgcgcgcgttgggcaccgaagcgtcggcattttctcaatcggagttttcttttcatgctaatcgttcatcttgtatagtgtaaaacgcttataattcggcttcatgcgctatgaattatggctagattaatgaaaattcaacaagtatacatacaactccgtctgattttgttgcatatagtacatcacatgaatctccccagactttcggcaattctcatagttcattgccgaaagcacgtgttgagatccccgcattgcatatgtcgtatggagagccctccatatcataaagatagatagaaaaaactgtagagatgtgaaggagaaatcaatgcatatattttaagcaagggtcaaaactaacttttgctcaacaacaaaagccgataaatttagaattatcggctaatgaaatagaggtagctatgtttgatttctctggagacataggagcttttgttttgccagctgaatttcatgtcaaggaagttgacaaggatcaagacgatgtagcacaaaacaacgcagacaaggaggagacgttggatggccataagatggctaagcaagacatcgttcaggtgaagaaatcgtcctccatctccaacacatctgataagtaatattaactggtaatttacttttttttaatcacacagtacaacgcagatactcacaaccacaggcacctcgctgtcgatggttacgtcgcctaccacttaaagcacatcgccgttaaatcctagaaaattcgctcccatggggagtcgaacccaggatcttaggtactactgaggctcttataaccactaggttacatgcccttttgcaactagtaatttacttatttcccaatttgatcataaatttgcaaataattcatgcgttagaaatgtcatcatgaataattctaagggatcaattggcgagattaatatttttgttggaaataataaagtgtttaaattttctatatcatcgttgccaaagtttatgtctacatggtttgcttataatcaatctagagctagagacacaaaactaaaattagaatatattaatgaggttgatgctaataaagtggatagttctaaatcattgaataagggaaatataagcaactgtgtagccgaatgggtagacattaaatctgaatcattcgcttgcttagctttaaaaccgtctccacaaaagtgtcggttaaagaaaaagaagtataattttgattggactatgtgcgatcatatttttgatgatttgctaaaaaaagatttgatcaaattaattgatcactatgtcatgccatcgcttccagatttaaaagaacaaatttattgtaagtggcacaattcgttcaatcattgtactagtgattataatatttttcgtcagaaaatacaatcggctattaatgaaggccgattgcattttgcaacttcaagaaagtcacatgccaaggatgatcgtttggataaaataaattagtctaggtggtctctaataagaagaagtcttcggcacaggtgggaggtagttcaatgaggaagcaaatctaggtaccgaagtctaaaggtcaagaaaagggcttagctgctagcgcacgtctgagtgtagaaacaaccttggttcaaaaggagataattgaacctcgggggcatacacgtgtgcaacaactagaaaatttacatcatgtgagtatgaagcgagaggcatctccgacagagttagtaacaaatcagaattcgccgaagaactctgtgggcaatggtagccaaccgagacactcacatagcttatcaaattagtagaagaaacagttggacaaagtgtagaaaagttgagggagagagtatagcatgggttcctaaaggatgtgttcaagtgcagaatgaaagagatacaaggagaagggagttaagaggtgtgtgccaaatcaaaggttcgcatccaaatatccaatcatcacgaaattttgtcaccatattatttatattcttcaccaatgtcatattaatgccgatgtcatggaatccattcccaggtatgcctttgcgcgccgcctgaaagacatcaacaaaatcaaaaggagacgctaattatatgagaacattcatgttaccgatcacacaaagttgaagcctacacacctttcgccgcgcatacatgagcccaaattaaaaatagaattaggctgcaagctgcatttgtgtacaatctaatgtaagttgcttctcaacatctacatttctgagacctgaccatcctctcctactgaaagccctttggatatatgaacgtcgagtcgacacaaataccacctgttgtgtgtgtgcaatcaatctacaccatcgagaacatcagcttgattgtttggtcaggctttgagaccacaaaatcgccagcatggtaaagtacccagctcccgggctcacccagggagcagagcactgagataatgagtgctgcccaccagaggtggagagctggaagcgaacaggcttcttgtcccaaccatggacatgctcagtgcttcaaactcggcgtccaaatcgcttgtagaactttccgagatgaatcctgaagtataagctgtaggttcccacagggaagctgaaatcgatctttccaaccacttcaaaccaccagatttgctgaaggtatgccacagatgaaatctgcatgaacaaaacaagaaagcgtaggtaaggttggatccagaacatatgacattctcaaccgtaattgagtttgaatagagtagatacattttcagaacgtcattatgagaaccaattacggttcaaactcaattacggttgagaacataactagttaatattaatatgttaactcaattacggttcaaactcaattacgtcatacagccaaacatatcattatgtttcagaactaagagtacattttaatttataactttggctttacaatgttagttaatactcggtggaataaaccacggagaaatatgtactttgtcatgagggaaactggaaagacctttggttcaacactcttataaactttataatactatcttatgttgaatagtttcacattggttgtggaagggcaaatgtcctaagatataattgggggagccccttacctcaatggctagcttttgaggtgggaaagaccctttacgatcctataattggtataagagcctggctagtttaacatctctggcccgatggacacagtgtgtgaagacctgatggaccgtgggtgcttgcggggctcgtatacctgatggaccgtgggcagggcccgtatacagttaagggttgagggacaccaatgtgtgaagggggagattgttgaatagtctcacattggttgtggaagggggagattgttgaatagtcctacattggttgtggaagggtaaaggacctaagatattagtgggggagccccttacctcaatggctagcttttggggtggaaaatgccctttacaatctacatcttatggagctttagaagacaacaaggagcaaggtagattactaaaacaactaccaaaatatcagcattcagatcaaacttttaatttcaaaaccaagttagaggtatgcgtgaacagacacttaactcggtctcggctccaacctccctaaccatcagccctaccttgaccagcaatatccatcccgtaccagagacggacaacagcttgagctcatggagcatgcagatggcctcagccatgcgcttgcggggcatgtcgacagtgacgatggtcgcactgcgaggacaaaaaaactcagtaaaaggcaaacattttcttgagtgaagttactgctgtaaaagaaagtgatggctcaatgatctacagggattagcaagcataaatctctgtttcttgcagagtaaattgtactcctaccaaattcccttatctgattatggattgtctaacatcagaatctaggcctttttttcaccatcctacaatgaactgaaggatggcgcgtcatactacccccaatgaactgaaggaaaaactaagttgtaaaaaaaaaatcaaccacaataatagtctctcaatggtgaatttcaactacaaattttgcatataattataaagctaaaggttgaaagttgcaaactcagggtgatctctatagattatagaacaagacataatgtgtcaccaccatatataagcaaaattgtaagctatgcaaacatgtcactgacctatgtgccaggaatacaagaataacgacaggtcaacagtaaagcaaaaaacagaatctcggttgttagtttcaatgggctttctaccaagtttgtttaagcattacaagaagcaatcaagctgtattaaaaatagtataaatcagtagtgcttcatttggaattcctttgtggtggtgatagtccagaaaagatcatattaagagatattaaaagaaactgatgacaaggttagtttcctttgtattggtaagaacattagtttcctttgtattggtaagcaatgacaatgatggtctgttagcaactactttggaatattggatcatgcatttatgaaaaaggggaaaaaagagaagcatggaaggacaagcaaattgcaaaataaccatctgttcgaagcaccagttattcttgtacatgaatagttacattatgctagatgaattgtattaatatccaactcttacaatagaagtaatatgcatcaaaatttctgtacacacattatttttgaaatttgtgtggaataacgctttcaacacaaatcttccccaaaattaatggctaaatatctactatgtaaaaacataaataaataagtaaaatggaatcctgtaaaaacacacactcatgccatgtccggagtatattctacggaaccctatgaaaacatgaaaggatccattgaatctaaaacaataggaaattattacaacaagtgtacagtgtatcttgcagcttgcctatactgtgcaataccctaattttcgccaagagtaaattatacctacggtgcaacaacttggcaggtggatgcgatatagtgcaagaacttaagaattgaacgtccgagtgtgataacttgacaagtgggtgcgttctagtgcaagaacttgacaattagtattttggtgcatcaacttggctatgcatatgctaggtgagtttttttcacgatgtcaacatgccattacataataatcctacggatattactttataatattgaatataatctttaagaattttttgttatcttcaccttctcaaatatcaaccgaaatataataatttctacatccgatttatttaaaaataaataaatatgcttatacaaatccacgcaagtatattgtcaaaataagtacttaaaaattgaatttatataaaaaaaatgctccaaataattaaaatgtcgcgtaacttaatttattgtatcaaaatcgtaccaaccttgcaagttgttgcatttacacgatcacttataaagtttttatactattgcacttacatttaatgttgttactagaacgcttatttctcaaattaatgcaccaaattacacccatatgccaagttgatgcaccgtgtgtgc

SEQ ID NO: 44194 - DNA, 9243 bp, Oryza sativa
ggcagagagagcgaaccaagaaacagaagaagaacctctctccgcctttcttcagttactggtcatgtctgaaaatatttaatcagtttgagagcaatgttcttggcgagagagagttacatgagcacgtgcattttttttctgatatagcaatttcgaaaacaaaagaagaactggaaggagaagaactgaaccttttcttgagcttcttaactgcagcattttgctaatctgaaccaatgccaaaaggaaaagaacatctccacctttcttcagttaccggtcatgtctgaaaacatttaatcagtttgagagcagcgttcttggcgagactcgagagagagctacatgagcacttgcatatttttctgatagtaatttcgaaaacaaaagaagaactggaaggagaagaactgaaccttttcttgagcttcttaactgcagcactttgctaatctgaaccaatgccaaaaggaaaagaacaggaaggcaattacagatcgtagttccacacccttatgtaaaaatgaactgatgaaatgcagcatatcccgtaacaatgaaggcatgaaaaatagagagcgtaccaaattttggtgaggatgcaagctacgatagatatacaaaatgcaaaaatgaccggaattgctgaagcagcacatgaaggaagatatcaatgccccaacagtaacaaataagataatagtcataaaattgtggaagaattactttttcttgacttgaaacctggtgattagaaagatacatttcagctcaaagttttacttatataagatgtaatttcagactatcaaatcaatgtttgagtactgaaaatgcatgtgtttgtaatttggcagaagcgttctacctctctcgaggccgtgttacgtgttaatatagatgagaaaagccctcatcgtggcgtgtacaaactgggacaatcagagatagaatatatcttgtgaaataagaaagaaaatagaaaccgattctatctcctatcaatatatgctattattgcatgcacaaactcttctaacactcccccctcaatcataacttatctaagttaagattgtgcctaaaatttctaagctgctgaactgaaagcggcttagcgaaaccatcagccacttgatctcctgaagatataaacttgattaccagttgttttctagcaactctttctctgacaaaatgataatccacttctatatgtttagtcctggcatgaaaaacatgattaactgacaaatacgttgcaccaagattatcacaccatagacatgctgtcataggtgcattaatcccaatttccttaagtaaagtttgtatccacataacttctgcagttgcattagcaactgccttatattctgcttctgtacttgatctcgagactgttgcttgtttcctagcactccaagacactaaattggatcccagaaacacacctccagttgaccttctatcatccacagatcctgcccaatcagcaattaaaaataacttaccaacatagatgaagaccggtttattttcaaacctagatcaactgaaaattttatatatctcaatatcctctttactgccatccaatgttcaacagttggactatgcaaaaactgacagattttattcactgaaaaagaaatatcgggtctagtcaatgtgagatactggaaagctccaactatacttctatatttagttgcatcactttcaccaagaacagtaccactatgagctgacaatttttctgaggtagagataggagtattgactggcttacaattcaacatacctgccttttttaataaatccgtggcatacttttcttgctttaagagtataccatcatccactgtactcacctctatacccagaaaataatgaagatttcctagatccttgagtgcaaattcttgcctcaaatctgtcagcaatgcagttactgctccttctgtagaactagcaataattatatcatcaacatagataagcacaaagactgtaacatctcccttgctataaaagaataacaaagactgtaacatctcccttgctataaaagaataatgaagtatcagccttagatgccttaaaaccaagattacacaactttgtgcttaaccttgaataccaagcacgaggagcctgtttcaatccataaatagccttatctaacttgcaaacatagctaggcttactcttatcttcatatccagatggttgtctcatataaacttcctcttccaaataaccatgaagaaaagcattttgtacatcaagctgacgaagacaccaacctctagatacaacgatagataaaatagttctaatagttgctgctttaacaactggactaaacatatcctcataatcaattccatatcgttgtttaaatcctttagctactaagcgagccttatagcgatccaaacttccatcagacttccttttaattttataaacccatttgcagtctataatatttttgtcactactaggcggaacaagatgccaagttttattatctagaagagcagtaaactcagcatccatagcatgtttccaattattatcagctaaagcttcagctagattatttggctctccagtcatagctaaaaaagaatatcgaacagttccatcggtatataccttttctttccttgtacctcgttgcaaccgagtcattggacgctgtaccatctgctgctgctgctctgcgccatcattgccatcattgccgtgctgctgtacactatgctgtgcctgcgagtgctgctgcgcactatgctgtgccgacgatgtggcagtcggcgggccttcttgctccctgtgacgcagctgcagagctagcaccatcatgtgcagtagaactgtcctcatctgcatggtactgtacaagagagtcattattaaattttacatcattaggctgaataactgatgcatgatcaggatcttctgtgccgtctggatcttctgcattttcttcaaaaacctctgtattccctgaagcaatattctccatatttcctgaattatcattcaagtgctcatgctgatctgtaacatgctcagacacaccattagaacgttcaggagtattaagcatgtgatcattactatatccaaccccattaggaatcaaagaagaaggtaaaagtaagatttctgatctcaatctagctccagcattagaatgcaatttagagaaaggaaagacattctcatcaaagacaacatcccttgaaatataaactctgccagtagatacatcgaggcacttaaaacctttatgtatattgctataaccaagaaaaacgcattgttttgagcgaaactcaagcttgcgcttattgtaaggacgaagatttggccaacaagcacaaccaaacgttctcaaagcagagtaattaggtttttgatcaaggagccgttctaaaggggcggagtattgaataactttgctaggaaggcgatttatgagatatgttgctgctaggaaagcctcatcccagaactttagcggcactgaggcatgagctaggagagctaacccaacctctacaatgtgtctatgcttgcgttctgcggaaccattttgttggtgagcgtagggacaagagacatgatgtgaaataccaatcttggtaaagaaggagtgtaatttctcatactctcctccccagtcagtttgcatagaaataatctttcggttaaacagcctttcaacacgctgctgaaactcatgaaacttggaaaacacctcagacttgttctttaagagataaatccaagtaaatttactgaaatcatctatgaaactgacataatacttcctactctcaacagacacaggagcaggtccccacacatctgaaaacacaagctctaaaggatgacttgacacactagaggacttgggatagggaagctgatgacccttggcctgttgacaggcatcacacactcctaattcattaatctctcctaaacatgggagtttattattgctaataatcttttgaacaatagctagagatgggtgacccagacgactgtgctacctcgaataggtaggcttgacgactccgaggacttgcttggatgaggaaaacgaagatgttggcaaagggtacaatccattgcggcatggccatctaagaagaagattcctcgtgacctgatccttgatagcaaagaaacgtgagtgaacttcaacaaaagcgttattatcaacagctaggcgatgagcagatatgagattctttttaacttttcgaacatggaggatatttttgagatgaatattgcggacaggggtatgaataatagaatgaccaacatgcttaatatccatacctgcaccgctcgccgtatgaatttgttccttgccattgtacttttcatgagtcgtcaatttttccagcttgcctgtgatatgatctgtagctcccgtgtccatgtaccaatttgtatctacaccataggatgccacagcagctattctggagtctggaacaaaattttcaacgtacctgtgccaacaatcggccaccacatgaccggtttttccacagagttggcagatggggcgtggtctgttgctgaagccacgtgcgcctccgtttcctcggccccgaccgccgcgatcgccacggccgccgccaccgcgcccgcgagatacgttagcgatattgttgttgaagccggtgttgttgttgaagtttgtggagattatgggtatcccatatctacacggcgacggtattcgaactgggtacaagatacctaatgtagatagaatatcttatctgtatctcgggtttgtttcttaacttgtgtatcaaggaaacaccctgagacttagtcggttacgactgtattttacctctatcttcatattccgttaggaatatagattatcttttgtaatccggactccttcccgtatataaggggggtccggagcgcctctaggggcagatgttgatttttcccgaatcatacaattaataatacactcggcggattcatccccggacaggagtagggtattacttcttttataagaaggcctgaacctgtataaatcttttgtctccaaacccatacacttttccagcttgatagccacccccttttattattgccgaaatctagtttcgacagttggcgcgccaggtaggggtagcgtcaagcttttcgccgatcagtgcaatgggtcctttttccggcatcgacgacctcgtcttcccacccgggcagacgtttcggttcggcagcctcgacttcatcaccaacaacttcggcaagatttctctcctcgactcggaatcagaccagtcgggagagaaccggctttcggtcccgtttggattcccgaacgcggctgaaagctacttcaagaccatctcacccgagtcggcttcaaaccactcggccgagatcgcatcttctccaacgataccagatcaagatgatggggcttacccaccggtcctgatgaagctccccgacgatttagcggccgtcttcaccacgacagcgccttcatcccgtaggcctaggcggaagtcggcttcaacaccgatttcgcctagcttcagggaagtcggcgtcatcctccaaccactcggcacggtttcgacggaccagctggatgactacaacagctctcccaccgtcgactcacgtcctactgacatcgtggagtacgacgaatttagttctcgatacaacgacttcaacgacttcgacgacttcgacggaagcctagatgacaactacacccctctctactttggcgttttcatggccaataatgagacggaggagcaacgccaagcccgggagaccgaagaacgacgccgactggaggaggagcatcaagcacaagaacaagaacggctacggcgcgagcagcaggaccgtgagcggacagcgaaggaggctgaagatcgacgtcagcgagctttggaagcagggcgccgagcgcgtgatctcatcggccagcaagatgtcgaagggacaccggttttccgcacccctcaacagaatgcggttgccgcgatcacccttctcgacaccctcctcaaccaaaacgagctcaatcaatccgaccacgtcgtcaacatcttgaatcagacgaagaccatgattgcggcaacggtcccagttaactccgaaagcgtccacacgccgactggcagccgggtcccccacttccgatctcatgactaccgtcatccaagcctcagcatcactggagcaggatccaatcgcaggagcaggggccacgacgagcggtctgttcactcgcctcccgaacttcatagggagcgccgagtggaacggcctcgctcaccacctcgtcgccgccccatcgatcttcgcgacacaatcatacagcgccgagcagctcgaggctaccatcactcgccggatcgccgcgacgacgaccttgacggagttgcagccttcaccgacgacctgcgtcgagtggattggccagccggcttcaaaccgactggaatagagaagtacgacggtaccactaatccagaatcgtggcttaccgtctacggtctcgcaatccgcgcagcaggaggagataacaaggccatggcgaactatctaccggtggctttagcagattccgcccgatcttggctccatggactgccccgtggtacgatcggatcttgggccgaattacgcgaccacttcatcgccaacttccaaggcaccttcgagcgtcctggcacacaatatgatctttacaacgttatccagaaatccggagaatcccttcgagagtatatccgacgattttctgaacaacgtaacaagatctccgacatcactgacgacgtcatcatcgccgcattcaccaaagggattcgccacgaagaattggtcggcaaatttgggcgcaaacctcccagaacagtcaagctcatgtttgaaaaagccaacgagtacgccaaagctgaagacgccgtcaccgcatcaaagcagtcgggcccagttggaagccgaaaaatacgccggctacgggaggaggtggaagtaacaatcataaggaccgcaagcgtaagcctgaggaacttgttgcaaccgctactcactcttctcgacagcgttcgcgcgtcaacaccttcgacaagatcatgaactcccaatgcccgcatcatccaaattccaaccacgtggccaaagaatgcttcatctacaagcagttcgcggagcagtacaccaagtctacccggaagaactccgacaaggaacaaagcacgtcaaggaagaaggacgacggcgacaccccggctggatttcaagaccaccgcaaggagctcaaccatatctttggcggccccctggcttatgagtctaaaaggaagcaaaagctgaccgaacgggagatcaatgctgttcagcccgacacgccccaatatcttcgatggtcagagatcgcaatcaggtttgaccgctcggatcatcctgaccgagtggtccacccggggcggtaccccctggtactagacccagtggtccgtaacgtcaagcttcgcagaaccctcattgatggcggcagtgcactcaatatcctcttcgccaagactttggatgatatgcagatccctcgctccgagttaaaaccaagcaatgcgccttttcatggagtaattccaggattatccgcaactccactcggccagatcactctcccggtcacttttggtactcgggaaaacttccgcacagagaatatcagctttgaagttgccgatttcgagacagcataccatgccatactcggacgcccggcgttagccaagttcatggccgtcccgcactacacatacatgatgatgaagatgcctggtccccgaggagtcctaaccctacggagcgacatcaagcaagctgtcacatgcgacaaggagagttgcgacatggcccaaacccgcgagatggcgtctgcccgagaggaaatccgactggctgcaaccacggtgagcgaaggagaagtgcccgctgccaagatttcaaaaagtggggaaaccgaagcccagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggacgcgatcaaggaggaattgaccaagctgttagcagcaggcttcatcaaagaagtccttcatcccgactggctggcaaacccggttctagttcggaagaaaacagggcaatggcgcatgtgtgttgattacactgacctcaacaagtctgccctaaagatcccttcgggttgcctcgcattgaccaggtagttgactcaaccgccggctgcgagcttctcagttttctggattgctactcggggtatcatcagatccgactgaaggaatccgactgcttgaagacttcattcatcacgccctttggggcatactgatacgtcaccatgccgttcggactaaaaaacgcaggggcaacttatcaacgcatgattcagagatgcttctcaacacagatcggccgcaacgttgaagcctatgtggatgatgtagtcgtcaagaccaagcaaaaggatgacctgatcttggatctagaagaaaccttcgcgagcatccgcgccttcaggatgaaattgaaccctgaaaagtgcaccttcggagtaccgtcagggaagctgcttggctttatggtgtctcataggggcatccaagccaacccggagaaagttactgctatcctcaacatgaaaccgccaagcacccagaaagatgttcagaagctgactggatgcatggcggcgctcagccgattcgtttcaagacttggcgagcgggggatgcccttcttcaagctactgaagaaaacagataatttccaatggggacccgaagcacagaaggccttcgaagatttcaaacaactcctcaccaagccaccggtcttagcttcaccacacccgcaggagccgttgttgctgtatgtatcagccacctcccaggtcgtgagcacagtcttggttgtcgagcgtga

SEQ ID NO: 44195 - DNA, 5904 bp, Oryza sativa
cctgcattgacgacaatatgatggcatatcgacaagaggtacgcaagttggaagacaagttcgatggactcgagcttagtcacgttcttcgacacaacaatgaagccgccgacaggcttgccaactttggatccaagcgtgaggcggcgccctctgatgttttcgtcgaacacctttatacgccgacggtacctcacaaagataccgctcaagttgcgggcactcatgatatcgctatggttgaagccgactggcgagagcccttcatacgatttttaacttctcaagagctccctcaagataaagatgaagccgagcggatttcaaggcggagcaaactttatgttatgcatgaagctgagttatacaagaaaagcccttcaggaattttgcaacgctgcgtatctttagaggaagggagacaattgctgaaagacatacattctgggatatgcggaaaccatgctgctgcgcgcaccattgtcggcaaagcttaccggcagggttttttctggcctactgcagtgtccgacgccgacaaaattgtgcgcacatgtgaaggttgccaattttttgccagacaaattcacttaccagctcaagagttgcaaactatcccgctgtcttggccgtttgcggtttgggggctcgacatggttggcccgtttaaaaaggcagtcggcggttatacgcacctcttcgtggccattgacaaattttccaagtggatcgaagctaagcctgttgtcacgattacagcagataatgctcgagatttcttcatcaacatcgtgcatagatttggagtgcccaatcggataatcactgataatggcacacaattcaccggcggagttttcaaagacttttgtgaagattttggaataaagatttgttatgcctcagtagcgcacccaatgagcaatggacaggtggagagggccaacggcatgatacttcaggggattaaagctcgagtttttgaccggcttaaaccctatgccggcaaatgggtgtcacagttaccatcagtactttggtctttgcgtactacccccagtcgggccacaggccagtcaccttttttccttgtctacggggcagaagcaatgttgccgagtgaagtcgagttcgaatctttgcgcttccgtaatttccgtgaagaacgctatgaagaagaccgagtggacgacttgcaccgactggaagaggcccgcgaagcagctttgattcagtcagctcggtatttacaagggttgcgacgttatcataatcgcaatgttcgatctcgtgcctttctagtcggcgacctggttttacggaaaattcaaaccacacgagatcggcacaagttatctcctctatgggaagggccatttattatctctgaagttacccggccaggttcatatcgactcaagcgcgaagacggcactctcgtcgacaactcttggaacattgaacatcttcgtcgtttctacgcttaactttatcactgtatttccctatttttgactgtcaaacatcaagttttttccttgaagttgtcagtcgggggctatcatcataataatggagtgtgattttttatcaattcagtttgcttacttggtttatcattgccttgtttggtttttctacttagtttgcgaggactgaaagtttttaatagcttctttgggttttaggctcaacaaagcttagcaaaaacttttaagaaatcaaaaacttcgcaagaatcatcaagcacagcataaatacaccagtattgtacaaattgagcctccatgtattacattcaaactcagtcagaatcagtcctttcatcatcagagtcttcattactcggctggaggtcgttgttgcgaaattgctccacaacatcactcgcaattttgtcagccgcattttgcgcactgctgataagatcaagggcagcttcttcacttgtcccgtctgcaaatccatcaatggtgtcgacttcaattctcgggtacaaggattttgtcatcgccaaggccatgccagctcccatacttccagctttcttgatattcttgaaatatacttccggagcaacactcagcttgtcaaatatttcggttgcgtcgagtgcactcggaccaccattattgaggaacatggcttggataattggtgcagcggcattggcgacgtcatcccttgctccttcaagcctcttgatcttaccaaccaggacgtcaaactgagcttgagatttgatcttgcgatctgcaaaacacatttatgatgagcatctgttgcattataaggagagaagctcagattgttagctggcgttaccttcgacttccttcaaggctgagtccctttgcgcagccagctctgtcttgtctctctccagggcttcaatttgctccgccatctgttccaccctggcggcttgcgctgtttgaaatccagatggttgaggatgcaattatgacagcataaatcaatggaatggatctggatgattaccttttgatgaaccacttagttcgaagtttgcatcctggagctgggcgattcggtcccttaactctttctctgtctttttggcgcactccttggcctcatgcagctggtccctaactgcttctagggttcccaaatgaggaaccagcttttccaaagttgtagtcttggcctcattgcgaagatggattctctgcatgatggatcgtggttcagttctgctaaaaagaaaataaagttaccgaaggccgtcactcggaagacttacatttacaatacgagtggcttctccgagcgctttcttcagctggcacacttcttcatcttctttttgacggtttatgactatgccggcggcttgtgagttctcgtcctaccatttgatcaagataggaggacgagagtcgtcggtcgcctttatgcgagggatttcttctccgtcatcacctgacggtcctgatgtgtttccaagtcattagacggatacactgaggttatttaaatcgccattgtttgagaagacaactaacctgaagatgtacctagctgagcgtgaggtgatctttgttctttacctgaagacccagctatcgagtcattaccagcctctggtccttgcgaagtcgtcgtctgcgcttctacttcggggatctcttgatcagggcctgcgtccgactggtttccagtcgggggctcttgagttgttgccgtttcagttgttgccgactggtttccagtcggcggcaggtcactcggatcggccctatcgcccgaagcatgggcaccagtcggctggctttcagtggtcggctggttttcaacagtcggctcggggtccttggatatattttgctctgtcatgccaggatcggggtcttttccagatggatctatatcagatggtttcctgcagagtgttctttcagtatttagcattatcttcatcggaaaacatgccgaagcggaaatcataccgagagatctaatacctggaagatgttctgatctttggcattgcacggccagctagttttttcctgggcatggtgcgctttgggggtttattaggcgagcccttatccccagatttatcatcgtcgccttcatcatcatcaagtaccagctttctcttgcgaggacctgtttgaccagtcaatttggaggtctgaggttgcggatctggtctgatcgttggccctccacctccctgagcggtgtgttggcgaggagaccggcgctgagtgactggtggatctgacttcatcaatgcatattcctgaacaagatgcttccatagttagtcaactcagcatgaagataaaattatgttctgatcacagtttgagggtttctgatacatacctgtggaggcggattgaatgcattatatggcacaactggcagttgatgagagtagctgactacaattgcatttgagaagattttatacatcctctccttcatgattttgaaatccagggaatctggttcttcacggttaggatcatgtttgccgtcgaactcgaatgctgtgcgggatctttccttgattggcgccagtcggcatttgatgaagtgccgagtgatctgctctccctgtaagccttgttctttaagatttaacatacgatccaacaactccaaggcttgtactgcttcatctccgattggaagagagttccaagtatcttggtacactggaggaagacaagagtacccggggagagcaggctcgggattctgaacatagaaccagtttgcatgccatcctttgttcgaagtcttgaagggcatcgagaaatatttttggctcagagttccccttagttggaatcctgcccccccgactacacacggtttgttcttgtttggttggggcttgaggaagaagatccggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgcgccaccatctccttaagatcctcctccgttacgtcggatgacgcccattggccttcgaagctttctctctcttccgccatcggtttcactcaaatgtgctgatttgattcgagggatggcttgggagaggtgagggattgaggcggtggatcacgggaaggattttgatgcacttttcggaggtggatttggccggagttgtgaaccctagttcgccggcgcagctttgcactgtagcagggagtggggaaaatggcgagagttccggcggggaagacgaagcgtcgcttggatatcggatttttcagttaagggtatcggaggtgctaatgggcctaggcctgaacagtactttagcccaatacttttaacagcgtggcccattgtgttccttagggacttaggcatattttgctttggcgatattatgcacacaacagtgttgcccaatgctgatgaaatcctttttatgcggtcatataattctttggaattattgcaatgcaaattaaaaaggtgcccgacagaaaggcgttatgctgtttttgcgagcttttttaggctacaaaagctgtttgggttaactaggaatgacttgtttttattatagtcatctccttggcgtgttatatgcctgttttcatggtaaatagtcatggcctaggctattcgacttattattaccatgatctttataatacttgatgggtaatctttagagtttttatattcggatgcctgtcgagtgtgttcattcgtgaaccttttagagtgtaaaccactcggatttcttttattgcggctaaaaagcagtcggctagcatgcctatttaggcgccgcgtacgcttttgtcatataatgcacaattgtgttattattttgtctttcaactatatgtttagtttgttaactaatcacatagttgggggctacacctaattaggtgcatctattcgatgcaccatattctttatcttttcgccctttacagtccactcggcaggttttggcttgaagagtttgaagtactcggattatcatctttgggaaggctacgatggtcgactgcaaaggactcgggggctactgtggagattatgggtatcccatatctacacggcgacggtattcgaactgggtacaagatacctaatgtagatagaatatcttatctgtatctcgggtttgtttcttaacttgtgtatcaaggaaacaccctagacttagtcggttacaa

SEQ ID NO: 44196 - DNA, 1500 bp, Oryza sativa
actttgctaatgcactttatacatatatctatctattatctatctatctattatatactaaaagtccattaaacttcctacaaacgtttctcaagccaccatgtggcacttcgacaaacgctcctataccgccacatggcaatgactaatctcaccgttgattttcacttaaattgatggacccgataatttagaccattagattaggagaaactaataccttcctactgtggccggaaaaagaaaaaaaaaagtaactaatccattactccgtaagtacacacgtacggcagaaaagcaattaatcttacgtactgttcatcggaagaaaaaatatcctatgcacagacttacttaaaaaaataaagccaaaaaataaaagtccttagtaccacttaaaaatactataaaaaaataaagccaaaaaaatatacgtacagtaccatttaaaaaattgatgatctttaaaacaaaaattttctactatttagagataaaatatattacgacctaaatttaagcaaatatcaccgtcgatttttacaaaaattaatgaacccaatactttatacaattacattagttgtattttattttctaaaaaaactaataccttataactatatgtacgtatacgggacgctagaaaaagacaaaaaaaatcataagtaggccgtacgtatgtacgactgggaaaaagaaataaaggtttcctactgtccatgggaagaaaagaaaaatctacgcacggtgaaaaatactataaaaacaataaagcaaaaaaacatacgtacatagtaccattgcaaaaaacgatgatctttaaaatagaattttctactatttagagataaaatatatctatataactaatataaatattcatatttttccggtcgtcacctcatccgtacaccaatttttcgtccatcacctccccccctagaatcccaatcggaattcaatcacccccaccccaaaaaaattcccaatcgaaattcaatcacacaaataaaatcagaggaagcatatacacacaaatatatcaaaaaaaaaaaggatcgaaggggagtcgctgtcgaacaaccgccgccgccgccgaaccgccgttgccgtcacaggccaccgccaactcccctcccgctggatccggtggagaggaggggcgctgccgccgcttggacgccggcgggccaccgccgcctcccctcccgctggatccggcagaggggaggggcgatgctgccgctgggacgtcggtgagccgccggcgcctcccctcccgctggatccggcggagggaagggcgctggcgcccctgtccgccgcctcccctcccaccagaagggagggcgctgccgctcgccacggtcgagccctcctggagccccatggcgagggagaggaggccggtcgctgctccacgccgccgcccgtcgccgctcagtgtggggaggggggcgccgcgccggcgacggcgatcggggtgggggggtgggc

SEQ ID NO: 44197 - DNA, 1729 bp, Oryza sativa
gcctcgccgccgctaccgctcttccacccttcctcgctgccgccgcccatctgccctgctgttgacggccgttatcgatcagtctcgaccatcaatactaccaaaataggagaaaactagtgatgcttgcaatgcattaaaatgttagagtaataatattccactagtattaggtttactaacattttgcagagaatgacaataaagtgaaggagaatcgacgtcaacacaaacgataaatcaatcggacgatgtcgacaatcagacttatgtatgaatggccaagaactcagaattgacatgatgaattgggccaaaattcacaagtctgcggagtggagcaataaaggaggccaccagccgaaattgggctagattgggccagccacaggttcggccgaaccaatcctggagccgttggatccaggttttggcgtggacgtccaggattgcatcccaatgacggttggaggacacttcggacaattccccttccacaaccgtcataactacctctatataaggacttcaccttctcacttcactcacacacctgttgacgatgaaatttggttagcccgaagtcataatcggcttagagtcagtatcggcttccgcatctcggaattagccgatgagaattatcaagtcgctaatagccggattcttgctatattcggttaaggaaattaatctattaaaggaagtttatctagaagagaccgagttcaaggaggatgcggcatggcaagttatctattaattaggaatagtttgttagtttccttttatctctaggaaagtatgtttagtgtccgataaggactatgtgttttccttttgtctttaagaaagtttctttcttgtcctacaaggaagagtatctacccatgggtataaatatgtacacccggggtcattgtaatctatcttcacgatcaatacaattcggcgcatctctagccatctttttgactgccaataagggtttcatcggggtttcagccgataagttatctggacgttgtatcggcttataaggatttcatatatatataagttgaatttagccgatgacaacaaaggtttcactgtttaatctaatctgtggattttatgacatcggacctccagccgatgtatgctttaaccttcggattgatgcttatttatcatatcattgctagccgattggtttatactagattatattgttattttattacatcatcatcagccgattgcctttatatcattatctacattggacatatagccgattgcttaaaccctatcgctaccggctggtatcggcatcggctatgatcggctatcggctggaactactccatcagtttgtcagccgatcggctgttttgtctattatttgcatatcttgtcagttgcaggatcaaactgactggcacgcccacatctcatcaacctttcgacctgcattggagctaagcagatctcccaggccggtgtgttcaattttttcgtcaacacgaattggcacgcctagtgggaccacgaattttatatccacatatctgaagaagaagtcaatgccaagattgtggtcacggtggagaatttaacggaggaacaataatatcggctcggggggcaagcgtatcagtttcagcatggtggagcacatcagtatcagctcatgaaagccgattacaagatagagaaagaagggaatttcgaagcatgacttctc

SEQ ID NO: 44198 - DNA, 5491 bp, Oryza sativa
cccatgggtataaatatgtacacccgggttcattgtaatctatcttcacgatcaatacaattcggcgcatcgccaccttttaccttttctactttattttatcgtccggcgggacttggcacctgacgcagtgctgcatcggtgttcgatctccagctaaggggtaagtccaatgttccgttggcccaggcagttgtatagtttaccgcggtgtcgttcaaggctgcattagtacattcgacctcttggattgctctggtttggatgatatatttgcctacctatttatcatatgtcactgttaatctagtcttagcatatcaatttagctctatcggctgcttctcgtttagggtttatgccggtatcggctaaattgtgttgttagattagattagcttagacatctaccaccctgaaaactcagtaaacagcttgattgtctagatattatgtttttttcatacttagtgctgtattagttaaatttgatctactaagtcgtgcttagaaccataatctctagccatctttttgactgccaataagggtttcatcggggtttcagccgataagttatctggacgttgcatcggcttataaggatttcatatatatataagttggatttagccgatgacaacaaaggtttcactatttaatctaatctgtggattttatgacatcgaacctccagctgatgtatgctttaaccttcggattgatacttatttatcatatcattgctagccgattggtttatactggattatattgttattttattacatcatcatcagccgattgcctttatatcattatctacattggacatatagccgattgcttaaaccctatcgctatcggttggtatcggcatcggctattatcggctatcggctggaactactccatcggcttgtcagccgattggctgttttgtctattatttgcatattttgtcagttgtaggatcaaactgactggcacacccgcatctcatcaacctttggacctgcactggagctaagcagatctgccaggctggcgtgttcgattttttcatcaacactcaagcaatagctctctcatttctctcaagtttagtttagtagtatctagttggtggaataggaatagagtagaaattaggagtccggaagccttcggaatagttcgggtatggctctatcagcttttctcttctcttttgtaagctttgtacttttattagaatactctactaaatacatttatggtattgaaatactttccgagtatatcagtacctaatttacattatgttcttgttatactgaatatacggctagcttatctgggagatgctttggtgcgggtataatgtttgcttatgcaattactctatgtcatgacgatgatattagagtagtatctggtagtttagacgtggtgtctagattacgggatatcattatttggggttatatattgtggatgagaggtggaccgctgatggtgacaactcagtacgggtattcctccatgcctatatataatcctaagttaattccctggggagggtattcctccgtatttagccccgattgtatggtcatggcggactgtcgtaaggaactcgacagtcaggggtggcttctcgaagtaccaggagggcatcggaaagagggtattagctagtatatcagtaaactaggatgtatgtatactatgtatattagaagtttaggaatagattatcttcctcttttctttccacttagcttagataatatattatgagaataagtagtttatgcttgtgtgtcactctacccttggattatcttaacccctgtttagaatatgattatcacaagcaatatataaattactagtcatgttctctctacatgattttcccacaggataaaataaatatgatacccttggaatactctcgggtaaaatgctataatggtatatccgtgcgcttgcggatgaactctgtaaccataatatacaagaagtatttctgcgccattgctgggaattatatttctagtaatgtcattaagaaataccaacaagcatttctggcgccattgccggggaagattcataatagagattacttattttatatttccctctgtataatcattttcctttgcaggctaaccttggttgttttcacttttgttgtgaaaacagggtagtgcatgacttgtttcaacctgctggaaaacttcaaggaaaatccagaagttgttgctccgcagaaaactttaccgatagagaaactagccgtaccagcgccaccaattttcaagactatggctagcaatactctccgcgagttcgctgctccttctgctgacaatgtggccattgggccacagatcaacatgggagacatggatttcgatttgaagtccagcctcatcacgatggcgcaggctagcccgttctgtggcaagcctaatgaggatgccaatgctcatctgcaacagttcctggagatttgtagcacgtacaccatcaaaggcgtcagtcccgacgctgtcaggctgcgactgttcccgttctcccttctcgagagggcgaagcagtagttctatgccaactgtgctgctgtcaacacctggcataagtgttctacggcattcctctcgaagttcttcccgatgggcaaaactaatgcccttcgtggacgaatttccagtttccagcagacgagggatgagtctattcctgaagcatgggaacgtctgcaagaatatgtagccgcctgtcctcatcatgggatggacgactggctgatcttgcagaacttttataatggactcaccccgacgtcccgcgatcacctggatgcggcagctggagaagcgttattctctaaaacggttcaaggagccgttgatctaatagagaagatggtctccaatatgggttagagtgaggaacgactccagacccgctagcaaggcatgcacaccgtcaaggagacggaattgcttgctgccaagctggacctcctcatgaagcggttggacgaccacgagaaacggccacaaggcaccgtcaaggccttggactcgcacgtcacgtgtgaggtctgcggcaatacgtgtcattctgggaatgactgctcggaaacccgtgaggaggcgatgtacatgggcaacaagaacaacgggtatcgtccacaaggaggtcagggatggaaccaaccacacgcatattatcaaggaggtaacaataacggtaatttctctaaccagccctgcttgaagcatctagtctttgcgcaagctaaaaccactgatgcgctaagcaaaaatcttgcggccaatgacaaggtcctggagaacataaatgtcaaattatatggctttgcttccgcttttcaaaatcagctgagctttaataaaatgatagaaacccagttagctcagttggcatctttcgtccctgcaaatgaaactgggaggattccagggcaacccgactcctccaatgaaaatgtcaaggcgatcacgacgagggaaggtaagtccactcgtgatccgccatatcctaacccttcaggaactactgggatgtcaaaagaagcaccatctagtgactcggctgatatggatgttcagccagaaaagacagtgccgtaggagtactgcgacacacggttgctgcctttccctcaatgaagtaggagaccgtcagtggacgagcaattcgctcgttttgttgaagtaatccagaaaatccacattaacgtgccgttgttggacgccatgcaagttccaacatatgcccgtttctcaaggatatcctcaacaacaagagaccgctcccaacaacggaggtggtcgacctgacagagcaatgcagcaacattatactccacaagctcccggaaaagaagaaatatccggggtgtcccacgatcacctgctcgatcggggcacagcagttcgaccaggacttgtgcgaccttggagctagtgtcagcgtcatgccaaaagacgtcttcgacaagctcaacttcacggtgttggcactaacaccgattcgcctacaattggctgattcatcagtccgttaccccgcagggatagcggaagatgtgctagtcaagatacgggatttattcatcccggttgatttcgtggtgctggacatagagacgggaaaggagacgctgctcatcctggggcgtccgttcctcagcaccgcaggagccaatattgacgtgggaatggggagtatccgtttccatatcaacaggaaggaagagaagtttgagtttcaaccgaggacggaacaatgctccatggtcagaataaagtacaggccgaacccgcagaatattcaagaggtcgaagtggagccaccgaaaacggatagcctggtgaaattcatgcagaatttcctggagaaggaaacaacgatgcctaggaaccgttattggaagacgccgataaaaccacccataccggccaagaagtcagagcagccagcttagaagaagccgctatccacaccaaaaccaaagaaggtgtggaggaagaagccaacgacgcccgctccaacacctccggagacgggtagaaaattcttgaactgaatcagaaggaggtacagtcttgcacgtcggactttaaatgacgcgactttcgccaacaggtaaattggtatgtatccgcataattgatttcaacaatttgaatttttgcatcatcacatgtttgaacttcaaaattgcatttaggacttttgaattttgaggaaattcttcaaatgaatttttcagagcaaaccaaaataaaattttcaataaaaattcattgtgccatgaccacactgaccgttggaatccaacggccgaaagtggggccggtttggcctaccaggggttcggccgaaccagccaggccaacggtcagctgccccctccttttaggcaacggctagtgggccccataggtcggttttgaccgttgtgggtgcactacttaagccaacaggccgggagagggaattccaccccatttcaacacgttttcattccctctccaaagtttgctctcaagttcattcaaactttgatagtttccctcaaatttaaactcttagttgcatatatacaagtcgctttggtgaaactaactggcgagtgaaatccttgtcattcctaacccccgccgagttcgtccgttcttgctccattgtgcagaatgaagaggcgattgtctcgtctgttcaaggagtccggctcttcatcaagtcatcatgatgagtctagtactcgttcatcagccgatatcgtgatggaagatgccaaagtccgccacaactcctgaaccacgccgatcttgaccttgttggtgatcgggagagacaagcctactatatgctagccgaccgggagtatgctcaccacgcgagaatactcaccggagctgataaaaaagataggtatggatactgaatttcgtgctatttg

SEQ ID NO: 44199 - DNA, 10383 bp, Oryza sativa
gtgtggaggattaggtgtagccttggtcaagctgcctgtggagtggagccgtctgcgccgtttatttattttccgctgcttagaactttattgattgagaggaactatctacctctgtaatgacattctattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcatttaccagcaaaagttttacaatactgttttatttaatcttgctgcaataaaacaaatttagcatgttggttttataatttcctttcatttcttttgaaaccagttattcaaaattacaaaatttgtgacctcgtttccaaatgttttaatttatttcgcaaagtttactttatttacttacttttttttactttgattttctaactttattcaaattaatccaaaaacttgtgctattaattggataaagtcttaactccctcctttcacttgtctttagatgccgcgttacaagcctgagtacctgtttggtgttgagggttttgtccaggagttgcgtacgatgtcctttgtcattggatttgggactgcccctttttatgcccagattcctcatgatcgtcatgaagagaagtgccgagtcaaagtcaccttgaacagcaatagtgaagaggtcccctcagtgatgtttgaagctggaggaagaaactacatccatgcatgtcaggaggtggcaaggatcgccataggagagctccgtgatcgctacagtgatcaattggccgacactgagtatcgctaccatcctccccaaccttagggaagtgaccgtggcagttaccttgagactgaaggaattgagaatgatgtaccaccaaacatttggttgagatgttgtgggctatggatgaaagtcgtgcggagactgtgttaccagctcaagatcgtgaagatcggaatcgtggtaagatttgcaagctagaagacaaggtggatcgtttgaagaaggaattagccgcattgaagggagaagcaccgccgcagaaggccaggattcgtcttaccgcaaggaagagagctttatttgtccctcgctatcaactggcgccaaaggttcgtgtggtggagaaagaagttgctccagctcaagcggatcctccggtcatcatcataagtagtgatgaagaagaagaatccaagcgcaaccattccaagattgagtgggtagcaactcaagatgatgaagacgagccttcaatcgacctccgatgcttggaagaactagagtgacttgttaagtcgttgtcttagatcgttgtgttagtttgcttgctttaagtttgcttgtgtgtggttcgcatgtgatttacatcagtggtgggatgtaattgcatgtgtttgtttgcttttgagtgttaggaagttggtgagtttagtggtgtgagagtcttcagtttgtaataatgaaactcagttaagatcaataaaagttaaagtaattctctatcctaagtagtttccccgttttctcttcttgtgccctgtccatgccagatggtgaacactcgtagcaatgggaatggtcccaacaaccccaataacaacaacaatggagagaatcccactcttgcccaagttcttgctcaacagacacagcttataaacatgatgatgcagcaatttcagaatcagcaaaaccaagggaataatcatgcacctccacagaacaagttagcagaatttcttcgtgtaaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcgggagtagtgtctctcaagaagaaggagttcaggtcgcttacccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagtccatgccacagggaggttcttcgtctgttgttcgtccgcaacgtcagttcttcaacaacaatgctggcaacaacatccgcaatcaagctccacgtcctgttgcagctccagcacagcaacaacctgccaagagggagcaaggcaacaagcccgtggtgtgtttcaactgtggagatccaggacattatgctgacaagtgtccgaagccccgacgcgtgaaggttgtccctgcccagaataactctgctgtaccagcatccaaggctcgtgtaaatcatgtcgctgctgcagaagctcaagatgctccagatgtgattttgggtacgttccttgttaactcagttcctgcaacagtacttttcgattctggagctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaactgttcatgcattgtcatctgagtctttcaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactatcaagaataagtatccactacccaggattgatgatttgtttgatcagcttaaaggtgccactgttttctccaagatagatcttcgatcagggtatcatcagttgagaatcaaagaggaggatatacctaagacagcttttaccactaggtatgggttgttcgaatgtactgttatgtcttttggacttaccaatgcccctgctttcttcatgaacttgatgaataaggtgtttatggaatacctagacaagttcgtggtggtctttattgatgatattcttatctactcttgaaccaaagaagagcatgaggaacatcttcgccttgcattggagaagctacgagaacatcaattgtatgctaagtttagcaagtgtgaattttggttgtccgaagtgaaattccttggtcacgtcatctcagctggaggagttgccgtcgatcccagtaacgtggaatccgtaaccaattggaagcaaccaaagacagtttcagagattcgcagtttcctaggcctcgcaggatattatcggaggtttatagagaatttttccaagattgctaagcccatgacacgactgcttcagaaagatgtgaagtacaagtggtcggaagaatgtgaacagagttttcaagaattgaaaagtcgcttaatatcagctcctattttgattttgcctgatccaaagaagggttttcaagtgtattgtgatgcatccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcataagagtttaaagtatatctttactcagccggatctgaacatgagacaaaggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtaaaggtttcgttgcagccttagaagcgaagcccactctaattgatcaagttagagaagcccaaattaattatcctgatattcaagagatcaagaagaatatgagaagaggaaaagctattggtttcttggaggatgagcacggaactgtatggttgggtgagagaatctgtgtccccgacaacaaagacttaaaggatgcaattctgaaagaagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccggtttgttgcaacctttgaagattcctgaatggaaatgggaagaaattggtatggattttattactggtttacccagaacgtcatcaggccatgactctatttgggtgatagtcgacagacttaccaaagtggctcattttattccggtaaaaacaacctattccggaagtcgcttagcggaattgtatatggcaaggattgtgtgtttgcatggtgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccctatgcgaattttcatacaacaacagttatcaagctagtttacagatggctccgtacgaagcactgtatggtcggaagtgccgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgcagagatttgagttttgaagagggagattatgtgtatcttcgtgtcacgcctctacgaggagttcatcgttttcataccaagggaaaattggcaccgcgttttgtgggaccttataagattgtcagtagaagaggggaggtcgcttatcagttggagttacctcaatctttggcaggagtacataatgtgttccatgtgtcgcaattgaaaaagtgtttaagggtacctaccgaagaagctaatattgagcagatagaagtccaagaggatttgacttatgttgagaaaccaatccgtatcctggaaacaaatgagagaagaaccaggaatcgagttatccgtttttgcaaagtccagtggagtaatcactcggaagaagaatcaacttgggaacgagaagatgaattgaagtcagctcatccgcacctgtttgccagttcttccgaatctcgaggacgagattctgtttaaggggggtaggtttgtcacaccctgaaaattcaaaatatataaattgttgtttaaatggaatttttagaaataattttaaaaagtcttgaagagaagatctaagtttaattaataaattccaatataaaattgggccagataaaatttcattaaatactttgcttaattctataattcctagatttttctggaatttttttgagctaaggaagtatttttaataatggaattgcatttaagaaataatttaaattgaaaaggttttaaaaagtcttcttttggctttgggccgaaagtcggcccaaaaccgttctctctctcctcggcccagtccggcccagtccgcagccgcccgcgcgagcgcgctgtcgctgacaggtggggcccacccgtcagtcgtcgtcttcctcgggccgaaaccctagtttcgcgccgccgagctgccgtcgccgccgctttccaaatccggccgttcctttccttctccggccgatttgttagaggggaaacaatctctgggatctcctctaccttttctcctttggaatctttggttaaatcgctttgtgtcacatcctgattttcgtttcaggatttataaattatttaataaattaataatagaatttatattaaatgttcattaatttacaagtgaagttaaatgtgggaaataaaatttcctaaatataaagcatggatggatttaatttttattaaattctccatggttaattatactctctggaatattctcggatttttcggagctcaattcctattttttaatcttacaaagagcatttcagtaattacccacatattaaattaatcattaaatggtctaattataattttgttaagtactttgagtgtccaagtattttcaagatttttcttggaattatttgagcataggaagtatttttaacaattcaaagatcatttcagtgattaatttaattggaaaagtatttaaaatccccttctccttttcgggccgaaataggaaaagttcagcttctatcctcggcccattctcccttctttcggctggccttatccctcctccaaagtcttctttgtgtccctttttcaatcgggccaagaagtagaagcccagccaaaagtctagttggcctccctgctacagtgtcttcttcaatctccagccggctggagacagagcccgagccagccgcacagtacctgtatagccgcggttttcccctccaaatccggccttttatctcgtgtatttccaaaattagttgaggggaaatattcctcttatcctcctctatctttacccccaggaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtcgtcgccggccgagctccatccgcgtcgcgccgccgcctccgtcgtcgccgccggtctccgtcatcgccgtaaggtgcgccgaggtgtgggcaagctcggccgctatctccccgaagccgccgaccaccgcagctccgccgccccgtgcaacccgagccgccgccgtcgcctcctcgtcgccggccgtcgtcggtcgtcgtttggcacgagggtgagtatcgttgggttcgtctcgtcgtcctctacgtgttcatgtcctccaaagtcgcagccgaccatccaatctccggcgaggtcgccatcttggtccggccattgatgaggtcatcatgatgtcatcatcgtttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgccttatttataagggggtgattatgatccaggaaaggtgcgctgtaatggattatgttgtgcaaggggtattgtcacaactcctttccgaggtaccgtggtggtattgaggcacatgatgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttataactggtaataatttgcttagctcctggtttggagttagatctgtacagccgggtatggttgttcaggatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaaacctcagttgaagataaaggatccagaaggagaagacgtttggcttataccccagttgagctgcctgtgggagtggagctgaagccatcgctagaccgttaattccgctgctgttttcttttcttttgtaagtatgtaacgttattattatgatggatttgtatattaaattgtcagtttatgtacctcggctgattcctggacgaggattttatgcacaaataagttcggaaattactagtgaatttccgggcgtgacactttggaaagctttggaatcgagttcgattcggatcggttttccctctctccaagccgcgagtttccttcgccgttgccgtcgccgtgggcctccgccgtcgcctccgagcccctttaaaaggatccccggtgtctcctctacccgtcgcagccctcgctttcgcctctcgtcgccggaagagctctagcgccgtgtgccctagcttcgccgtcgccgccgccgcttcagccgtgtgccgccgtcgctccagctgtcgccgccgctcgggaagaccgccgtcgtcatcgccaagtcgccgccgtcctcgtccgccccttcgcagccgtcggaacccgccggagcttcgtcgccgtcgacaacccgaaggtagccgccgcttccttctcgtcgccgtcgtcgtccgttccttttccgccgccgttttggtcaccggtgtgttcgccgtgttgtcctctacgtgctggtgccctccgttggtgccgtggtgccgccgttcgccggcgagtgtccgccgcccgagccgtcttcttcgccgagccgccgccgtcgtcggtaatgtcatcgttgacgtcatcgggatcctctcccgtaagccggtcgtggaccgatcgatct

SEQ ID NO: 44200 - DNA, 7734 bp, Oryza sativa
  unsure (1)..(7734): unsure at all n locations
tcggtgatgtcatcgttgacgtcatcgggatcttctcccgtaagccggtcgtggaccgatcgatctcggccatccgatttggatcggatcaatctcgaccgtccgttcgtgtgaaccgccgcccgtgcgccggtccacccaaaccctagcccgctgacgcaataaatccccttttccttttcaaaaataattcattattgcgtcataattcaatttaaaccgatttaagtgttttaacccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttattacaatttgactagttgagctttatttatattggttcaactagatattagatacaattgcttagccctgcttagaaacattagtacacttatgggataactaatgactcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcatagtaaaagatgctataactggtaataatttgattagctcctggtttggaatggtacattcctggtttggagatagaactgtgcagccggggtggttgttcagagtggttgggcctatacaacagggtatgttgtatagcgttggattaatattgtttaattacttaactgatttgttaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagaactttattgattgagaggaactatctacctctgtaatgacattctattcgcttattaattagagtaatatttgtactctattatcaatttgttattgtgtgcctcggctgattcctggacgagggttcacacacatgtaagcgtttggaattttggatagaaattccgggcgtgacaccaaaccagtacttgaacgaggaagggaacgtggagagggatgcggagaggaaccagcaggggcacgtggaaaggaatgtggaggggaaccaggaggaggaggctagtggtagtcaaccctccgttggacagaagagggcacgcggacaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacagtgtactggcgaagaacaagggcacgcggagatcatgagagctttgtcccagattcggagaaagagatgctgtggaccacaatgctcgagacattcacccttcctgcgggtagagaggacaaagtgaaaaggtggactctgaagaaaatggcagaacagtttcagagcttcaagggagatctgtaccagaagtatatcctgaaggggcagacaccgaacttcgacacattcccaaagctaagggatcactgggatgagtttgttgcatataagacaggtgaacaagggcaggcgatgatggaaagaaacaaagaaaatgccgccaagaagaagtaccatcaccacttggggtcagaaggctatagcgtcgcgatgccaaagtgggaggtgatggaggctagcttgattgagaggggtatcgaaccggcaaccgccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccggacagagatagggacgagctgacactcgccctacaaactccagagcatccaggatgaatacgagggaaaggggtgattccttggaagattggtttcaaggaggacatccacacgtacaggagtcggatgaggagcaagagagataccgaggcgaagattgcagatctagagttccgggtatcgagctacgaactcagcatgcaagaggaggtggcaaggaaggttgatgaacgcatggccgcacatcggtcccatgatccccagccgaccattcctcctgcaatggtgagcccgttaggaaaaccgtagcagctgcgcctcaacggggcaggtaggatcacagagcatggacgccatgcaaacacaggacgaatcgacctgtcccattgatgacatcactcagcggacaccatgtgagctgcatattccttacaagaacttatcaataaaggtaagctcgtagtttatatattttagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacagtgagacgcatctacgacacacaagccagcggtacatcatcctccctgggcgacaagcggcgtctcgtgcaccatctcctcctcaggatcctgcaccgtctcctcctcatgctccgccagcaccgtctccacctcaggctccagcactgactcctcctcaggatcctgcactgactcctcctcgggctcctacacctactcctccgtaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccaatgtcaggaacttcttcaggggtatgtctgcacctgtcaaggaggccatcaagctatcggactatgagcgaacgctgaagaaagcatcttctggaaagtccaaaccagtccctcagcttggagagcaaccaaaccaggagatcgagccgttggtgatcggggaagacatgacgatagaagaatttattattgacaccggtctaactacggatcaattgctaggagttgaaccaatagaaaaggcggaattgaaatacatgtacgaactcgataaaccgcttgtcaagcccgagctggtgcagtccctacccacacaaatgtacaagttccatcagctgtacatggagatgagcgccaccggtagagagatgatcggagcgaggatcagggacccggacttcttgcaaggagatgatattctctagatcaatttcaagggaatctatgaagtataccagctggacgccctcgacgtctctattatgagttgctggattttgtaaatatatcgttcagttatatttcttaattactacgtctcctttaattaattaggtccttgtatataagtaaactatataaaataaaatactcccttttatcgttgtagaatggagattcaaagggcccgacggcggagggttttcaatactggattcatcgaccctcggagagtaaatgtcgcaatgctcgaccaatatccacaagaaacagaggacaatctcgtccatctcctgaaggcgcaacattacaagacgttcatactgttgccgtacaacacagagttagtttaattttactgtcttcctacataccaaatttcattcccgtatgaacttgctaagtgtttcatatgtaatgcatcccacgcacattgcagattccactgggtgcttttactcttcgacctgtcggcctgcactatcaacgtatatgactcaatggataaaaacgagtctacgtttgacaaggttttcgaacttatagacatgtactggcataagttcctctgttaattaagaaattcttgttatgttaattatttctactacgaatcatatctttaaactccttgtagggcttggtatcggttccatcatttggtccgtggcaactggagagaaagacttaggcggaggttcaaattttctttgagtacacatgctctacatttatatttctccgattcaaattaatacatacaagtgtatattaattagatctcacgccgttaatttgtcatttatttgtagtgcgcaaagcaaaagcagggaactaacttgtgcggctactacgtgtgcgagtattgccactgccttgctgaccaaatcatcaccacaagagagctcgatgtacgtacaaataaattcaaaatttcattacgtatcgatttcttgtttaattactaatcaatttcatacattcatatagtttattcgcatgagggataacctgaccacacacaaggaatttatcgcggcggttcaagaacaactcatgggattcatcaacaaagaaatccttgatcccaagggtgaattctactacgacggaaacacaattcaccggtccttagcttctgagctagcagcgagtactactactacgtcgaaatcgtagctagctaggacatataatggattgtaattaatacatgactacatatgtttctatatgcatgtgtacacattttctataatgtaaatatattttggtcatatatatatatatatatatatatatatatatatatatatatacacacacacacacacacatatgcatttgcataacatatatatgtataaatacatatatattatgcatgtacatatgtactgaaccatatatacatataatataatatatatatatatatatatatatatatatatatatatatatatatatatatatatatatatatatatatatatatatatatatatatatatatatatatatgcatatatatgtattgaaacatatatatgcatggtttatatatatatatatatataaaccatgcagcaacagggccatgcaaaaagaaaaaggtcagctcgatctttagtcccggttggttggctgagccatctttagtcccggttatttcacccgggactaaagatagcgatctttagtcccggattggtactcccggtttggaaaccgggactaaagggggttacaaatcgggaatacaaaggtttctccaccagtgtatgcagatactgagcaaacaagaaagcagtattatctcctttagcgatgagatgcagctgtatgtagtgaccgaacaaaaaaaatatagcagcatatactgaccaaattttaaaaaaaactagtatatgctccgtcaatactaatgtattcccttcgttttatattataagaatttctagcattgcccatattcatatactccctccgttttttaatagatgcgccgnngactttttctcccatgtttgaccattcgtcttattcaaaattttatacaaatgtataagatataaatcacacttaaaatactatgagtgataaaacaactcataacaaaataaattataattacgtaaattttttgaataagacaaatggtcaaacatgtgagaaaaagtcaacggcgtcatctattaaaaaacggaggtaatatatgttatgtctagattaattaacatctatattaatatggacaatgctagaatatcttataatatgaaatggaggaagtagtatatactagccagaaatttgaaaacagtatatactgttccaaggaataagtagcacatacttgtaacaaaacagtatatactgttccaataaacagtatatacttatatatagtgcaggatgaatgagattccacagccgatggagagtgacataattggctcattcacatgcataattgtatctattaattagatgtaatgtttggtcatgtattttttatggattgaacgtgacatcgatgaacttgttattgtttaataaatgcaattttgcttgctaattacaaaagtatgccacgtatgttcggaataaacaaatactattcaatatcttttcatggttgaacaactttcaaaaatcagtcttttgggaaaaagacttctggtaaagtcgtacaattttatcttaacataacaaaaattgatttttaagtcattctataactattttcgttatgtgagctactcagattaccaaattgggttcatgctatacacctagaatcaaattctaataaaaacatgtttaaattcagttcaaacttgctttgaactagttagtaaaatagttaatgttaatgctaaacatttaaaaaaatatcatactcattcaaattggatatatactcatttgcgtatttcataccatggtgtctcatatgagtgtcatatacatatatatacatacgtatgtatatatatatgtatatatatatatatatatgtatgtatatatatgtatgtatgtatgtatacatatatgtatatatatgtatatatatgtatatatgtacatatatacagagacatactatactagacccagagtgcataataactaaaatgttacccctcacgtcctaccccccaccccaccctaccacaaccctcccctgccccaccgccgccgcctacggccaaggagtggcggcgtgcaggcgacgggcggccgacctaatcaccgcccactcccaccgggggtcgtcgtcgggttgtggccgtatcggcgtgcggctccggcagcggcagttcaggaatgaggaggagcggcggcgaggcgcatccagccacggctcggagacgaggaggttcgggcggtgaatccg

SEQ ID NO: 44201 - DNA, 2520 bp, Oryza sativa
aaggggaaaaggcttcgtgctcctccagtcgggcgcatttgccgccattccgcccgcgctcgccgaggccatcggcgccgctgggtagggcgcgagtgtcttggaggtgatgggcggggcgcgcagactgctcgtgccggacccgaccgggacctgctcccaactcccgtggcatgcaagttgagtggtgccagatccggcggctacgactgggcaacggctgatccggggaaggcttcgtgctcactggtgctgccttctcccatgactccgacctccctctctagccgccgccggcgtcccccgctggatgcagtcaatgtaggctcgggactcgcctgatctggggtggatcgacgaccattgggctgtcgaagcatagcagagacccaggcagaggtgtaggttgctgcttgcaggtccgccactgcccgtggacagacagtgctcgtcgatcgcattgctgtaggcgccagcgactagtcctgccaggcctgactggagaacggtgggatttggtgctgctgcaccctcagcggcgctggttagttccttttttttttattggatcgatggaagttctgagctaagcttgttactattgtgcttttggctttttgtggtctcgatctagttgaacagagctgttctaagagcatcttaatattattcccttgcttagcagtaaccaagtattacaaatgaatagcgataagtgtatgacatgaaaaatttgcccctttatatctttgtagtttgtaataagcctgctaaattctcaatgttcatgtgttctgttcaaaatttatatgattcagaaactatccaagccacttgtgctagcgttattcataaattaagatgtcatggctgatatgatctgtgtatgtttgaatttcgacagtaatctcaaatttatacaactcaaaacttgtataaaccaccggtgctatctgttagagcttgcattttcagaaatagctgtaattggacatattttcataaatgatcatgtattcttagtgaatttggttctatgtattgttgtgatgattgctgcttttgctggatcaagcatcatgagtgaatagccctgataccagagggtttttttgcaacgcatgaagaaccatgctctcatcttaattttcatttgttcagtcatgaattgtttgtgcaatatattcagaaaagtgttcccatgtgaatttcatttgtttagtgatatatttgtgcgtgcaatatttggaaaactgccaatagcatcatcatcaggttctctgatatgtttgataaatgaaaactctagaagctcaattcggtagcagttctatgaagttttgtggttcaacagagcatatcaattgattttctctgaactgctctgaaattttgtggttcaacagagcataggtgtttgaataaaataatctacaacctattaacgtgatgatggtaacattttttatcagtgaaggattaaaactccttgattcccatttatttatgcgaatgaaaaaatgagccattttttatcccagttttgcatcgcggaggaaaaaaaatctatttttcaaatgttatttactaatgtgtcatgattcatgatctgagaatttatcattgttttagacggatctatttggttttacttaaatgctcaccctctagttttaacccttctagaactgtgccatctgcccatctgtaatatagtgcagcggaatgattcattcggctcagttgaactagaaaatctagaaaatgaaccttgcagctgaatgatttattccgatcatcttgaccaaatagatttatttctggatttggtatttgctttctcattccgctgagttgcacaatgttcaattgtaggctgggagtaaggcaagcccaagaacactatagtccggatttaatttttgctttctcattttcaggtatatgctcatgtgaatacaaccaagtacattttcagatccggttgctagccagtgccatggaggagcagcaacaaccacctccatgacgcgacgccgtcaatgtccagccagcgccagtcatctccgccaccaaccaccgactggtctctagatctatgttatattgtcatggagtaaaatgtttactcacaccatatgattgtttcatggcgtgtaggcttattgtaaaaaagttactattctcatatttctcattgtattcatatcgtgtaggcttattgtaaaacatttaccatgtgctaataagtgtccgtgaaaaatacttgagtctatttaactatatttaactaggtagtaaaattattactcaacaataacgaattaatctaacaatatgttcacgagtaattgatttacttagtgaggctccagtgtgaacaaaaaccaataacttattgacgaaaacaatattgggcgcagacgtaatctcctattaattcttttacttatggctccacgttggaaggaaaacaacagaaatcaattcggtgtgcggtagtgttagtaactcgtttac

SEQ ID NO: 44202 - DNA, 6320 bp, Oryza sativa
ggtttatgtggttggttgccttgtccatggcaggttcattacatgcggtgatgaagttaatatacatcaggtacctaacaggtccattgctttatttgtctgcaaagttcagaggagtctagttgccaggtcggagcgcagctagaggatcctaggtaatctcctgacgcaggcacaattatgctctgatttcttccccaaacttcatccgcatatctgtgaatggaacaattttcttttgttgtcttttagctagaaatttttctttgattaggggggagattgagaaaaatggtaagattgaaacacattattgaggtatgaatctgattacagtaggtactaggcaagattttcaccgggcaggtactaggcagaatattgattattacaataggtactaagcaagaaaatttatgtctcttcaatttggatttttctctcttctcccttctagtctgcgtccctactagatctgatcatctatgttgcagcacaacagaagtggagaacaatctgatttgtacaacaagaaggctgaagcgatgccatcgtcagcccttataaacaacaaagctaaagttcagtttgcagaccttcctgaggtatgtttaccaaagaggaacattcttcagatttctgtttgcaaaaagttatcttatctaaaataacttttatcatgtccctcttgtgcagaatttgatgtgattaagtctcagaaatgccacagaaggatgttgtgagaactgatttattgtcaagttaatggaggtgcatgcatgtggacttgttgcacgaaactttgacttgatggtgttatggtgtctagcgataatattaatgcagtcttgcagcagcactctagtttggtcgaagagtttgaggtgaagtttgaagttgacagcaagctagttgatcactcaatggtttggtcgattttgctgtatcatcacaggccaataaagttgcttttgatttagagcagaggccttccttttttttttctcggatggattctcctgtgtttataaacggcattgccgtggagtaaaatatttactcagacagtaatattgtatcatgctgtgtatgctgattgtaaaaaaattactattctcatattgtcgtctagtggaacattcactacgcgttaataattgattgtgaaaataattactaatgggtggatacatatgactgagcatgcaaaaacacttggcagaaaaaatattactaagacatcgaattagtgagaagtaaagatcattactagtctgtaacatcattattaatgggaatatttagctgccagtaacatcgttactaatagtagctaactaatcgtaaaatttttactcactaccttaaaaaaatgtttcccatacaaatgactttagtaaatgatttactgataagtctacctgtcaaacaaaaggtgcggacggataaactatctaatttcaatatatagtaaatagtttactctatcatgaactatgccaaaaaacggaggtagtatatgttatgtctagattaattaacatctatattaatatggacaatgctagaaagtcttataatatgaaatggaggaagtagtatatactagccagaaatttcaagaaaacagtatatactgttccaaggaataagtagcatatacttgtaacaaaacagtatatactgttccaataaacagtatatacttatatatagtgcaggatgaatgagattccatggccgatggagagtgacataattggctcattcacatgcataattgtatttattatttagatgtaatgtttggtcatgtattttttatggattggacgtgacattgatgaacttgttattgtttaataaatgcaattttgcttgctaattacaaaagtatgccacgtatgttcggaataaacaaatactattcaatatcttttcatggttgaacaactttcaaaaatcagtcttttgggaaaaagacttctggtaaagtcgtacaattttatattaacataacaaaaattgattttactaaaaagaggttagtaatcatttaactaaacagaattctgaatttgttgtgcgggatggttaccaccaaaagtggacgtggggttgagggggtgggtggtgggggagtggggtagggtgggggtgtatctatgaggatagcgttttagttataacacactgggtgtggtttagcgcatccgcatatatatatatatatatatatatatatatatatatatataacacacacggtggcgctacaggcgctgcgcgccacgaatctaaatggcgcgactaacagcgatcagcccctgccgtgttttcggttttcttggccccatccgatcccctcccaccagccgagtaaaaaaattactttcctttctccagttccgcatgcatcccttcctgagtaaaaaagaaaaaaaatacttgtttgcttcagcgaaaaaattactttcctttgcatccatcacccagattcgtgagtaaaaaaattgtactgggagagtaattgttttactggtgggtaccttgactcgtgagtctgatcgcaggagcttctcctggacttttagttttttctccccattgaacgcaattttatctaataactaagattcgtccacgtcatcactagttaaaatttaacttgcaaatttacttaggagtaaaaattttactgggagtaaaatttcacgagttaaaattttactgggagttaaattttaactcgtgatgacgtggacaaatatcagtcgttggatttattttggagggccgagattcaccctatgtaaccgcgtgacatgccaacatctgaatccattcatctctcgtccatcatttagttatttttctactggcaaatttccaatagtaaatattttacttcacaaattacatataatttttttttactctgccaatatactgatatgtgtattgcaatttggttgcaagatatctagatgcatttaatcatacagggaatcacatgtattagaagctaattacacacacataatacaataacaataatcaaagtcacaggacaatgtccaaccaaaatcaggcaaaataattgatgggcgttgctgtcgaccctagcagctttctagtccttctagatccgttgaataggaccgagctgccgatggagagaacaccggcgacagtggtgctcctcactaggtcaccgcctccaccggatcagcatcagatcccatcggcaagagagaggagattcggtgccgcccatgattccgcccctgcatctcaccgtccagtgaagggctcagaagaagacgacaaccacttcgtggatcttggtcatcgtgatggagaatcctgccggaactcgtcgccgccgtcgagccctcgcaagcgagcaggcagatgtgtggcgttgagaaggagacggttgtcgctttctcccgtcgctaatcgccatcaccatcatcggtaatctcctctccgttgaggtttgctctagatccggaaaaaacgggatgaggaagagaggaatggctggatacggtgagatggctggctatcaacggtataaatactcatgcgttagccatgcagtagtcaaaaaataactcatgagacatcgtatgtgttgtagtggagttaccaatacgtggcggtgtgggggtgggactgttgacgtgtattagtcaaaaaatgactaacgtaatcaccgtgcgtggcaacgggaggggagtgaggggggtgggcagcaggtggacatattaaactgtgtcaggtgccgtttaatacatggcaccttaaggtgccatatagtagttctatatatatatatatagactgatatttttttcttctctgaggttgtcttataattagttctagtattctactcatgagaaaagaaaactttcacaaaatcaagctttaatatattttttgaatacttacactggatgaaaatcatatgtgcattacagtggatgttgatctatatgtaaatatatgtgtttgaactactgccctgtgattgaacttactgcattttgttattaaacacctcactctgagtttatttgtagaattttccaatctaaacttagatatctcttgctctaattagcgaagatagttttagttgtaattctgttagtttgctgtaaaatacaccatgaggcaactttaaactgtgggaagaccaagaagtacgtaatacattttcttttgataaggaacgttcagtgactcaattttaaccaggattttattttgcttatggaaaaatgtgttctatcaaaccgattgttggtgtgacctatattcgttatatgtaggggatgcaattgttaccaatgggcatctgctagaaagaaaaacatcgtgtaaactctgtggcgttgcactccaagtgtttgtggttttgccttatgtagtagttattttgctttgcgatatggtgcttgcaggggctgatcactggaggtgtgattttgtttgccagttgagggaggaattcacacgcttctgttcactgaggacatcttctcaacctattgcttccaccgatcatctttaatgatagattagctttctgtgtacctgtatttcatgtggttagctctcaaccaaagtggagtttactttttgtacttctatactgtaataagaagtgccttgtattattttaatttggttttgtgtaatttaatcttgagaacaaaatgtgttgcaataggactcacttgagagattcatatggttcagaagtatacatatgattgtattattttcgccgttttatataaaatgttttctatatctctgaatttatcaaacccacctttttaagactttctcaaacgcatgtgatttctgaatatgaaggtacacttattgaactggatgtatgaaatagataactgcccatctattcctctgaaattatactgaaaaatgaattaaataatcatgcatgccatgtcccaaacaaaggactcttcccctgaattgcggtcttaaaagtattgcatcacagcaatacacggaacccttttacaattagaggacatccatgagtggaaattatttacttttaaaatgcgtgtgaatcatttagattatttttcttgactatgcaaatataaactttatagagaattatcacctttttactctgccctatttcaaacctaggaaattgcatgcgtttctgcagtaactgaattgcttaatgtatatttcttttgattagttaataacagtataagggtgcataatttatatttctgtgcaaacactgttagaagagtttgtgcatgcgataatagcatatattgataggagatagaatcggtttctattttctttcttatttcacaagatgtattctatctctaattgtcccagtttgtacacgccacgatgagggcttttctcatctatattaacacgtaacgcggcctcgagagaggtagaacgcttctgccaaattacatggtatcagagcctcgctagccacgcacgagattgcatctacggcgatggcgagttcctcctctagcggcgcgaatcctctctcagggcaacccgtcccagagaaacttaccaggaataatttcctgctatggaagactcagattcttcctgctatccgtggcgcacgcatggaaggatacatcaccggcgcaaagcaagccccagctgcagaaattgacgccaaggaaggtgacaaggtcgtcaaggtgacgaacccggcctacgaaacatgggtcgctgaagatcaacaagtgcttgggtatatcctggcattggtatcaaaagaaattctcacgcaggttgtcaatacagagacagccgctgaagcttggagagcgatcacgacgatgctctcgtctcagtctcgcgcgcgtgctctcaatacgcgcctggcactgtgtttatggaaaacacgaggcctgggagatctgcttaactccagtgcaggtccaaaactcgccttcggatgtacgagcgtgccagttgatttgatcctataattaacaagaaacaaagacaaagaaaccatgattaaatccataaatgatagccgatcggctagatgccgatgacatatcatttatctttgagccgatgtcatatgtgaatcgatcggcaattattaaggaaacaagacggaactaaatctgctcgatcggctgtagatatcaatgatatataatccttatatcgacatatacttaaatcaagtgattgggatagatcggtcaccttgccgagacaatataaatcacttagattgaaatatatattaa

SEQ ID NO: 44203 - DNA, 6883 bp, Oryza sativa
gatctagtatgtatgggctaaaactccgatactactttatattaagatattaaagcaaataaaatatactaaacagagatctaatatacttaaatgccacaagatcttaacatgaagggcagatctaacatattaattgagcatatagagcaagagcaactagatcagataagatcggctgaaactccgatactaccctaatcggcaaccagtaggcaggctagagattgaaattctaaacacgacttaatagatcgaactcaactgatacagcattaagtatgaaaagaaggacaatatctagacaatcaagccgctggatgtttcatagggtggtggatatctcatataatctaagccaacatcattatttaacctaatcggctgtcttctggtagcagatgttagctgattgtaggttagatgacgatattgtcaaagattatgcaagatatatgataacttgacggattacataaacaagattagagtatcataaagatgtaagcactaatcttgagaacacaagccgtcataacaagttttacctcttgttgaagatcgaaaccgatgcagctcaacccgaaagcaagaactcgttgaaataaaactaaagcaaaaagggtggcgatgcgccgaaattgtattgaacgtgtgtgttcctcattacatagggctcggggactatttatacccgagaattacaagatatgtccatattggacacgactcttatctctaacaaactctaagataccataagtctttgcggcagacttttgcccacatttatttctaaggaatttacataaaatatcctaattaatagatacaattgccttcccaggactctatccttgtgtggcaatcatcttgaagcacatcaactcaaacccaatgtcgcacacgggtcgtattgtcggaatcggctgtatcacttaaccagtccaactcagacttagccgatcccagtcgtagccgattcggactccagccgatccttactctgtttccgcaacaatcctcatcttcgattccgcttcgatcccatctttatctccgatactgatattaccaaatttggtcgttaacacatgccccccaagtccgggatatttggtaatgttccggatttgccgtgtatcgactccgagcaagtttcgcaatcggccgtttccgattgttaccctagcgcttcaaatactaaccgttatccccgagaaatctcacaccgtgacttccgtcttcaccgcttaagcgaaactttaccctctttctctccggcgattccttcgacgcaccaggcgatttcaagacgattccgtccccagccagatctccacccgcggtaatgtcaacttccaccaatctatccgccgcgccatcggccgaatacgcagaggtaagcacccatcagttagatcccttttttccgcagcagattgattttctttcgccttatcttgttttcttctcttccatccctacctgcatctgtagcatctgtccaacctggttgcgtttctgagtctgtcgcatgagaaccattactttctcggcccaatcggcaaccttgaccctactgattttatcactggtgaaaccaacagaattccctttagattagccaaccctaatctgaatcattggaagaataccttcaagtcttggccatctcttgagaaaactgcccctgagaagggttggaccacatggtacaagcgtgtatcggcgaataaagcagcacactgggatgagatcagaatcagcccagcgcttgcccttaccatagctaattctgctaaggacgaacctctaatggctgccgccacctatttctagtccaacgccatcaatgccttcttattcaaccaagggccgatgaccccaactctcatagacatcattatgatcacgggtttggatgtcacctcatcggccaaccctatgagcctgaacacgaagaatcaatatgacttcaagaccaagagcataggcggttggtcaggctatgtagcagcatacatgggtaaagggcccgtcactcctcgagagcatgtagcctttctgctgatgtggctagaaaaattccttttttgtggatcaagctgtagccctactaccaattggcaatttgtagccgaagccctagaatcaaagaaacaatttctcttgggcaaaatcctcctcggctatctatatcaaatgttgaataatgcatcggccaagatagccgtcaactcagtagttggggcaggtggaccatggtggttgttgcaaacctggctaaacttggtagttatgaaagtcgtcaatcggccatctgtgacagaagctgaatttccaagattagagccgattacagaagatgacgaagaacgcactcatcgccgatgtatgtcatatggagaatacgcatccacaccgactgatgctggagcaaagttatcagccgaactgctcaaagattggttctgcagtctctacgaaggctttcaaaaagatgctcaagtttggtttccctatgaagattcagcagaccttgaactcccatcagattttagatttgaagacattaatcatgaaagatttcaaacatccagagaaatcttcacagctgcaatcagcccatgtattcttccagtcggcatccatcaaggaagaaatattcaagcctcttacgagttctatcacccagtgagttcagctagacagcttggaatgggccaactcccaatcggcttattctttgctgacaagatccaatgccgaggagaaatttcatcaaccttgatgatggatcggctgctcaaccttccaggaccccctctgggcagcattgaaaatctggagctagcaatgttcaggagcaaaaactttgatagatggtggggtgaatggaagttgcatctattccaccaaccagcttcaatgtacatgatagacctctttccagatgttgtccctcaagtaagtctctgacttaacttgatttcatttgaacaacttcctagccgatttatcttaactaatcttttctttgatttgtagacaacagaatcctctcctcctcgtcaaagcaacagtggcaaggatatcacctacgccccaggcttaattcctaatggaggtgggccatctcaccctgtcatcggctatgatgcccccaatactttagctcttctccaagggcttatcagagaaccagccgatgccggtaggaaatggaaaaccagatcatcgactgtagatacttcagccccagctccaaagaagaaaatcaaaaagaaagctaaaccagctgatgatctgcctgccctagatccatccattgaacaagctctggatgaagaagaaatcggagaagacgttgatcaagccgcaaccgaagtaagcgatactgaaagaacaccatcggcttcacctaagcagacccctccaactccttctgctccaactccctttacaagagtaagcacccttctttaaccatttttgtaatcgtctcactttatggccgattgctcacattcttggtaattgcagaaaaggaaggctgctgtgaagaagaaatcgactccaatgacatctaaaccagctccaccggtacaataatcttacttctttcattaattaatttcagctgattttatataacatttgtctattttcagcctccttcccctcctattcaacaagcatcaagcgatcgaaccccatcagctgtagggagtcatcacatagaagaagaagttcaaccaattgctccgactattccagtaaatttcttataactaacatatgcagatcggctatgcctgtttaatctctaaccctcttaaatcattactgtaggtcttagccgatcttttttcttttgatatcagagattatcttgatgaggagacagaggttgacactactagcaaagctctagctcctttgtctgacgacgtgaagaaaactcttgaaaatatttctcatcggctagagacatcatcactagacagcctagtagtcaactgtggatcaatcaggactcggcttcatgaagtccaggctcaaatccccgatgagttagctgatattcttactccagctgtttatcttgaacaacatcaatataagctggaaaaggccaagctgagattagccgaacgcagagagcgcaaagacattgaagcaacaatccaggcaaatcggcaacttgttcataaagaaaaaaccagactcgatcaattatctgaaggcccgatcaaatccaatattgaccggcttgaagctcataagattgaactcttagcacaactttaagaatgcaatgccgaactggatttagagcacaagaagttagccgatctcccacaatctatcgaagaacaaagagcaaagttaaaatcggctatcaagaacgttgctgatatgaccaaatctctgaaggtcattcctggaaccgatgctcaagacgcccaagccatagaagaagtagaacaaattagacagagagctatatcggctatccagcgatacttatctcaataatcttaatatgtgatatcactttgcttaaaaatgcttaaaaattttgcactgtatatatgcccccctagttttacaatgtcaaaagcattgataaaaatatgaaacaactaagggcgatataacaatattggccattgtacatcggcaaacctcaaccgattacaacaaaacaactaagggcgatataacaatatcagccatctcaaggcgatgcaaacgcaccggctatcatgtatcggtaatactagccgatcatgcgttaacccaaacacttgggtgatatttcttcaaatacttgccattaagcgctcgcccaaaaacttctccatcaagtccttgcaacatgtatgctcctttagacacaaatttatggatttggaatggtccttcccaattcggcgaccacttgccgaatttactatcacgagtaccaatcggcaaaatcaatttccatacaagttctccttccgaaaaatctttaggtaccactttcttattataatgccgagcaacacgttccttatccctagtaactttagcaagtgctcgtaatcgcgactgaaccaagtcctcccgttcatcggccataagattatagtactcgtcggctattaaatcactttgcaactctgttcttcgtgagccgattcgaacttcccatggtaaaacagcttcatgtccataaacaagcttataaggaggaacttggattgatccatgataagccatccgataagaccacaatgcttcggctaaacgggtatgccacttccgaggataatcagaaattttccttttaatcaacctgatcaaactcttgttagatgcctcggcttgcccattagcttgtgcataatacggtgaagaattcaataatttgatacccatactatcggcaaattgaacaaactcatgagacacaaagattgaaccttgatcagttgtaatagtctgaggaataccaaatcggtagattatatgttcttagacaaactgtattgcatctccagaattagccttcttcaaaggaatcgcctctacccatttggtgaaataatcagttgccactaatataaacttatgtcctttactcgatggtggattaatcatgccgatcatatcaattccccatcctctgaatggccacggtttaatgataggattcatagccgacgctggcgctctctgaattgcactaaatttctgataatcttgacaacccttgtaatatctgaaacaatcttccaacattgtcggccaaaaatatcccgtacgccgaagtaaccacttcatcttatgagccgattgatgagtaccacaaattccctcatgaacttcgccgattgcaactttagcctgatcagtgctcaaacacttaagtaatactccatcaatcgttcgataataaagctcatcatccaataaagcatacttcaacgccttatatcttaacttcctagaagccgactgagatggatttcgtaaatattgatgcacatcatatctccaatcatcggccgttatggcagcaacttcaacctgaacatctttgatcatcggcttatatcccgatgccccttgagctaaatcattggcctcaacattctgctctcgagacacatgcttcaaagtcactagccgaaacgttttcatcagtccttggcacttctcattataaaccatcaacgtatcattcttgcactcatattctcctgccaactgactgataactaacaaagaatctcccataatttcaatagcatcgacttcaacctccttgagcaattgcaaccctttaagaactgcctcattctcagcttgtgtcgcgaccgagaaaatttgcattttcacgaacgctagtgtattaatccccgtcctatgaaaagccggggtacaccacacaaacatgatacaaacgacacatctttattatatcgataatatttacattattacaaaggcacttcaagcctgacaataaaaaataaacagcagcggactagttggcctacggctccatcttcataggcgctcaactggggtataagccaggactccacctaagacttcttctccaaagcttctcttactgaagggggggggggaatatagagcaagaatgagtacaaccacagtactcagcaagtcacaccgggagatgcatgattaatgcaaaggaaacaaggggtaataatataggggattaggttttgcaggacagcatttaaaagacacttagttgcccaaagctattttataaagacgattctagagatacacagtattattaatcaaggccgtggacccacacgaacctgccttaacccaaggcctacgatga

SEQ ID NO: 44204 - DNA, 1174 bp, Oryza sativa
tttgttcaggactagattgagcaccgagttaatccttacccattagacatgtggttagtacagtagtgctttgcaacagaggcccgaagaccggtccttatagtggccgaggtgctactagcaaaaccctgcacctcaagcccagcctaaaaccattttgggggttttgaatagaggggggaggtgtgtgttcaattccatcacaagccaaccattccacagtgtccaaatgatatgagaattcccgaagtctaaagttataaaaccacctactgttgcctaattagtcagcgaagcatctacctagattcatactagtggaactgttaatagagtacccactagttggggttttgtttatcctagggtgaacaaggtaataataaacaatagcaatgataaggctataacaaggattaataggaagtgctaaataaaacagtgattacgcgggaatttaaataaagcggtaatgcaataatttaaatcaaaataattttataaactgggattcaatatgctcaagggtgatgtgacttgccttgctcagagagaacggccttccgaaccttcggcgacgaccgcaaaccatgcttcgagaaccttcggaacgatagaagctacgcgaagcacacaagcaaagctacaagcctataaagaagcaataacaatacataaaaataaagcacacggttctttaggttataacaaacattaggagacttgaacgggtcgattcggggttcgtatgaccaagatatgatcatccgaagtttaatgctgttacatggagatttacggattattgtgattaggttttgcaattataaaacgtgtgtaagcgctagcctggaaaagataggaagactgtgctgttgacatgtggaccccacatgtcaacctaagggaccacagtagaccgagtacacagagacggtccacaggtcgacggaagcggatcccgtgtgtcaaccgaggcaagcggtcgacaaacggactccactagacaccacacgggctgcacacgtggaaaccacgcggctaccgagcgggcacactaacacggacactacacgcacaagcaaacgactaccgacaccagtacacaggtaccggggtcgacaaccgcacaacaggcacgggcgacaccgaaaggactaggacggggcagcga

SEQ ID NO: 44205 - DNA, 7219 bp, Oryza sativa
aggtttgcacgggagagagaagaggccgtgcgggaggaggaagacgaccggcgcatgggccccacgcggccaggcgcgcggtcggcgcacgcacgtgcgcggcacgggcgggagggcgccgctcagcttgggcccggaggcggcccaggaggagaggagggagaggcagcccgggagagagaggggaggagagggagctgggccgggagggggagggaagaggtgggccgggaggaggaggagaggcccgggagaggagggaaagggagggaggagagggagactttgggctgggcttggcccaaaggaggaaggaggattatttttaagtttttctttttaataaactttgatcatagttgttgttgcttaataaatatttccggtactctaaaaattcaagtaaaatttgagggctcattttagaccagggagaatttaacaaaaattctccgggccacattcgaaattttcttgtacgtattttagtgtttgccaatttcttttcgaattttaattaattctattattccttttagaaaatgatttttatttcgggatgaatttatcaggacgtgacagcttgattattcgtcgcataagatttaatagtataagcaaactcaaagcatgcctcccgaggcaaaattataactaagccgataccacaaccatgagcacaaaccaacccatcaaaaagtaaagtccatggcacaatctcaaccgagccgattgaatcatcacgatagtcaactatgaaatcggctatagcttgccctttgactgccttcggcgatccataccgaagatcgaattcagttaatgaaaatatccattttccaacccttcctttcaaaattggagccgacaacatgtacttaaccatatcggccttacatatgacagtgcattcattggacaacagataatgccttaacctcgtacatgaaaaatataggcatagacataacttttccacagaagaatatctagtctctgcatccaagagtctacgacttaaataaaacacaaccctttcttttccttcaagctcctggatcaaaaccgagccgattgacttctcaccggctgacaaatacaaccgaaagggaactcctttctgtggagaaatcaaaaccggaggagaactcaaatattccttaatattatccaaagctttttgccgctctaccccccaagtaaattgttgatcggcctttaatcgtaataatggcgtaaaaggctctaatcttccagacaaattagaaataaaccttctaacgaaattaatcttgccgatcatctcttgcaattctgttttatccttcggaggcttaattttcttgatcgcactgatacttctttgggtaattttgatctccctctcatgaacaagaaatcccaagaactgaccagccggcacaccaaaagcacattttgtcggattcatcttcaagccatatttcctggttctctcaaaaaccttcctcaaatcggctatgtggtcctctatctctttagacttaacaaccacatcatcaatatagacctcaaccaaccagccgattaaatcatgatatatataattcatagctctttaatacgttgctccaacacttttcaagccaaaagtcattacaacacactcaaataatccgattgcaccgggacacctaaaagcggtcttataaatgtcttcttcaaccataaaaatttgattgtatccagcatttccatccataaaactcaaaatcttatgccctgacgcagcgtcaaccagttgatcggccactggcattggatattcgtcctttggggtagctttattcaaatctctaaaatcaatgcataccctaaccttgccgtttttcttgataataggaactatactagaaatccactcagcatatcggcaaggacgaataaaaccagcatcatataagcgttgaatctcagccttaacaggctccagcatatcggctttgcatcttctcggcggttgctgatttagtctaaccccgggtttgataggtagccgatgttgaacaatcgattggctgagtcctggcatttcataatattcccaagcaaagcaatctctaaattcttttaagagctctatcaacttggttctgaattctgcacataaatttttactaataaatgttggtcttggccgatcgcctggacctatatcaatttcctccagatcatcggccgacataaaaccttgaccttgtttgtcatcgagatcatctactgtatccttggtgtagacgttcgaaccctccacgacgccctcaaaataatagcttgggttcttcatcttcaattggctatatatcagaatcggatacttttaaaaaatctccattccaaacttttccagataaacaatcaaggccatccatctcccaaagagctaaatcggcactagcaacattaactgacctgtcggctggcacgatctctatgttgtcgccttgccattgaatcaaacattggtgcatggttgaaggaatacaacaattagcatgaatccaatctcttccaagcaacaagctataagaacccttcccatcgatgacaaaaaatgttgtagggatcgttttactgtcgactgtcagttccacgttcaaaacccctttggtttctgatggattaccaccaaagtctttaagcaccatgttcgtcttgatgaggtcttcggcgttcctacccaattccctgaatgtagcataaggcatcaagtttactgcagccccaccatcgaccatcatcttagacatcggcttcccattgacataaccgtttatatacaatggtttaagatgccgattctctatcccctcaggcttctcgaacattgctcgctccggtgacaaaaccaacttagccgattcctcttctatctcatctacatcggcttgatcaatcccgaattcggctggcaatgtaaagaccatgttaactggtgctgttacaacactcttcccttttgccaacctttttgcctcttcgactgcaacatcatcggctacaggaacctagctcttaacacgccattcctgtcttggctttgctttctttagccgatggttaatttcctattcaacttcttgaagctgctccctgtttctcaacctttgaacccttctcttctggttctttgtgaaaataccagaaggacaccattgatttgtcctaactacctcatccttctgaccgcgaccttgattcactaggcccaatctttgatgaacagacactctttcctgccttagccgattattcccattatatgactggcttgagctctcaatgataccattgcacccagggcagttttcgatggacggtaacctcatcccttcattccagcagaatctaaagaactcacaaccccaatgaggatcaaaaccatcatcgtgttcttcataatgcttctcctgctgcttgtcatacttcctctgatatttgttgatcatcttagccgaattcacttgaaaaccctttgcacggaccctatcagctgtatgtaccatattaataggaaaaggattaccatcgaccttcattggtttcttcgaatcatcaaacttgatttttcctccctcaatagccatttggatttgctgcctgaagaccttgcagtcattagtcgtatgagacccagaattatgccacttacaatacctcttcttgcccaactcttcagccgatgggattgtatgtccggtaggaaattgaatctgtttttcttgaagtagcaaatcaaatatcttatcagccttggttatgtcaaagtcatacctttcctcttttcctgagcccttcacccattggcatggtataacctttttattcctgacccactcggctgcagctattttggaatcatcatcctcatcatccgatccatacatataaggatagacatgattaatcttcctagagttcttcctagcatccgtgaacctttgttcatgcaaagccaccttctgtgtaagatgtaacaagctttcgaaatcttcagatgagaatttttccctgatcggagaaatcaacccttgaaaagccaaatcggctagctgggcatcagtcaaactcaagctgtaacatttattcctcatttccctgaacctttgaatatactcatgcaccagctcatcatgcttttgcttgattgacgtgagatcagacagcttcatctcatgaaccccactatagaaataactgtgaaactgcttctctaaatcggcccaactgttaatcgacccatgtggcagagaagaaaaccaagtaaaagccgacccagctaatgacaaccggaataacctaaccctcaaagcatctacagccgatgcctcaccacactgagctaagaatcggctgatgtgctcataggttgatgtagtattctgtcctgaaaactttgagaagtctggtactttaaaccggttaggtaaaggaactctttcaaaccattcaggataaggttgtcgatacaaattcccagtctcttttggtttaagcccaaattgttccctcattacatcagctatcacgtcggcccatggtcgctgctgaggtgtttgttgtggtataggctcaaactggttgtagaattgaggcggcaccgatcctgtctgttggtactgaacttggggtgatggaggctgatattgataactcaaattgcccccttggcaattgtgaaggttcggctgaataccacgcgccaaatgctcaggaataacttgagccaccaccggaccatccggttgcatatgatgaaccaagtgttccgggaccgcctgatttgcagtgtactgcacaggctggacaccaggcattgcaaacccagccgatgcgttcattgaggcttgctactgaatcggctgaatgacctgctgtctcaacggtgtctgttgaatcggctgtaaagccggttgctttggtggcgtctgctgaactggttgcacggcctgctgaattggggatgcttgttgaataggctgcacaacctgttgcctagacggtgtttgctgaatcggctgctgctgagccgaattaatagcattctgaggaggtagaaacatagatgcaacctggtcttgtgttagctgaatcacattcggtccaggatactgtgattgctctcttaccaataattgaggattgattaattggcctggagccgacgacggcgctgcaggtgctggagctgatgctggcgccgttggctgagctgatgatgcaacaggaggaactccctgagtaagtggatgaacatcggtgatcaaagttcgataatttggaaaagtacccccttgcaagtaagctgggcctgcagcttgatgttcagctattgagccatcggctaccgatttcatcatatttgacaaggtattagtcaacactccagattgattaatcaaagcacaatacacagcatagtcaactcgatcttgaaagttattgaaaaaatcttggaatgcattgtcattctgattaagatttcccccttgcggtccctgagtgccgtcaccttgaaccccatggtccccttgagggtcgtcgccttgatctcctggagagccattagtagcacctttgttactcggctgggctgatccgtctggaatttgtttcttttctccctctttagatgaaccgatcccaaaatcctcaggaaccaccttcaacttgtacttctgaaaaaatgtgcccttgcgagtttgcatgaatgaacttaaaaattgatctcgtgcttgctgcatcattgcattgaagtatttttctgttcatgagtgaacttctccggatcgatgggtacaacgtttccttcatggacgtcaatcagaccgaatttctgggtcttttccttaccactacccgggctggccgacgacggagacagtggtggtttctcagccatgaaggaagctgttcttctgacttctaatcagccccaccgggcgtgccaaaagcgtgttgatggaaaacacgaggcctgggagatctgcttaactccaatgcaggtccaaaactcaccttcggatgtacgagcgtgccagttgatttgatcctacaatcaacaagaaacaaagataaataaaccatgattaaatccataaatgatagccgatcggctagatgccgatgacatatcatttatctttgaaccgatgtcatatgtgaatcgatcggcaattgttaaggaaacaagacggaactaaatctgctcgatcggctgtagatatcaatgatatataatccgtatattgacatatacttaaatcaagtgattaggatagatcggtcaccttgccgagacagtataaatcacttagattgaaatatatattaataatgagattatacatattcatagcatagccgatcaaatagatctagtatgtatcggctaatactccgatactactttatattaagatattaaagcaaataaaatatactaaacagagatctaatatacttaaatgccacaagatcttaacatgaagggcagatctaacatattaattgagcatatagagcaagagcaactagatcagataagatcggctgaaactccgatactaccctaatcggcaaccagtaggcaggctagagattgaaattctaaacacgacttaatagatcaaactcaactgatacagcattaagtatgaaaagaaggacaatatctagacaatcaagccgctggatgtttcatagggtggtggatatctcatataatctaagccaacatcattatttaacctaatcggctgtcttctgctagcagatgttagctgattgtaggttagatgacgatattgtcaaagattatgtaagatatatgataacttgacggattacataaacaagattagagtatcataaagatagaagcactaatctcgagaaccgatgcaggttttacaggttttacctcttgttgaagatcgaaaccgatgcagctcaacccgaaagcaagaactcgtcgaaataaaactaaagcaaaaagggtggcgatgcgccgaaattgtattgaacgtgtgtgtgttcctcattacattgggctcggggactatttatacccgagaattacaagatatatccatattggacacgactcttatctctaacaaactctaagataccataagtctttgcggcagacttttgcccacatttatctctaaggaat

SEQ ID NO: 44206 - DNA, 1535 bp, Oryza sativa
tccaccctgccttgccgccgcctcgcctcctccgccgccgcactccgttcgtcgctgtcgccgcccctccgccctacctcgcgctcgcctcgccgccacctctccgccatgcctcgcgctcgcgctcgcctcgcctcctctgccacctccgccgccacccctccgccctgcctcgctgtacgcgtgagagagaggaagagtgagactgagagtgagagaagagagagagaagagagagatgaagagtgggagaagtatgataggtgggtcccacatttttttttataaatagaatgctgtatggactgccacgcgtacgccacgtagatcaaaaccaccgcggattgggtcgaggggggtaatttgtccggtttgtatagttggggtgaagaatgtccggttttgtggttagggagggtaattcggacgaccgcgatagttcgggggggtgattcgtactttttccaataaaaagttatcatagcattaattgttatgtatatcagccttgtatataaacatttaaagatcattgattggatatttcatatttataatataatatagtttaactacgtatatttacataaatttgtagactaatatatttatatttaaattgtagaaaatattaagaccatcgatctatttcagtgacagtatttttttgttttattgtttttatagtattccgtgcgtagatttttcttttcttcccatggacagtactaagaaacctttatttcttttttccagttgtacataagtacggcatacttatgattttttgtctttttctagctgatagttatatagttcatatagtaataaggtatttctttttttaaataaaataaattagagatctaatctaatggtataaaaaattgggatcatcaattttggtgaaaattgacggtgatatctgtttaaatttatgttgtcactagcaaaggtgcctgtgcgttgcaacgggaagtgtacagaaaaaaaaaaagagaaaaatttacattatgtaattaattaaaatatttggtatttttaagtaggtaggtgtataattaaatcaatttacaagtaaagcacgtctgcaaaataaaatgacatggttaaatttaattttattaaattctccattattagttacgctctttgaaattttattggaattatcagagcttaaattgctaatttttaataatacaaacatcatttaacaattatttaattggaaaaaaaaatcaaaatccacctttctatgtttgggccgaatatagaacagtttatatcccctcccttttgtctattcaatgtgtctggcctgttttctttctccattgaagtccattttgcgtcctccattcggtggcccaataggccggcggcccgatacaggagctgctggagccgttcgatcgaatggatggtccagattaatcctaacctaaataaatatacccaaaccctaaccctaaccattcactccccctggcctcccgcgccgcccaccccgagcgaagacggtggcggcgccc

SEQ ID NO: 44207 - DNA, 968 bp, Oryza sativa
atccttcggtgattcggccacaacgcgaggcgcagtggctacatgcaatccggcgacgacggcgtggtggttcatcggccgatcggcgtcacgacctaggcacaactggcgtcggaggagatcgtcctcctcgttgttggtaccaatccttgatttctgactgctagatatatattctgattccagatattctcgggcctgtgtacctacacaacatgtttcctttcgagagatgcatgggcgttctgaagaagtatgttcgtaaccgtgctcgtccagaggcaagcattgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttagctctagttcacgccaggaacatcggtaagtccaatgcatggattacacggcatcacattgatactttccccacgtggctacgacaacatctcatgggcacgccggagatcaaccaacaacttgccttcctgacgaggggaccgtctgggtcgatagcgacattccagggatatgagatcaatgggtacacattctacacgagagcccaagacatgaagagcacgaaccaaaacagcgttgttcgtgtcgatgccatgagacacgatggaacaactgccacgtattacggtgccatcgaggatatatgggaacttgactatggtcctctcaaggttcctctgttctggtgccaatgtgttaggttgactggtggaggagtaatgattgatgacagtggtatgacaactgttgaccttaacaaggttggatactcggacgaaccttttgtcctt

SEQ ID NO: 44208 - DNA, 1346 bp, Oryza sativa
ttattactcattttcacaattcattattcatcaatgttttcattattcagatattagaaagtattgatgatttgacactaataagatatctaattaagtggattcctgcccaaccttgggccgatggggagatttatctgtattctccagatacacatagttggtcttctcaaggcatgaagatgaaattctttatcatggatgaaaagtataatatggaagccaaagggatttataagaagattgatgagttggtcagcctggctaatcattcaatgtttctggctccagtgtttgctttgcatgataagaagatcggtcgtattattctgtgttatccaaaatttgatcaactgcttaaagattggctgcctgctcaagccttttaaaggccggtttataccacccatatggatgcatcttataaagtaagtataattttattcattctatttttgtatctctctcggttgatgtgatacttatatcttgctctatatacacaaattctatttttgtatctctctcgattgatgtgatacttatatctttctctatatacacagagatgtcatatcttacatgagcaacattgataacttggctgcaagcttaggaagtattgactcatatgtgttggagacaaagcccgagagaataaaggtcatcctttttccttttgagtcaagagaagtaaattggcgaaaagattttgctacatttctgatagacatcttcggaacaaatggaaatccaccatgttggatcacttcatcaacatcttacaaaaagatttcaagtacgtaaacagtcatatcgtttctcttatgcttttgcttatattagtaacggaaaaactaagttgtgagcaaaacttttatatacgtgtacttattgattcaaaagtaaatattgtaaaataaactatgatgaaaaaaactacaaaaatcaaatacaaaattaagttctagaattcaaattttggcttataagcataagtgaaatggtagggctgaaagagtcctgttgtggtggcagcgaatctgtcacccaccattgtttttttgtagttcttacaaagtgctcccatatattttttgatattatgaaatagtttggtatttagttcaaacaagtaaataccatatgttgataagcaaactagtgatactaagatattttcaccattgttttttttagttcttacaaagtgctcccatatattttttgatattatgaaatagttcggtatttagatcaaacaagtaaataccatgtgttaaggtaagcaaattagcgatactaacatactccctccttcccacaatataagggattttcagttt

SEQ ID NO: 44209 - DNA, 6133 bp, Oryza sativa
gggtaagtataaaaaacattatatgtcataatataacaatgcattatattaattccaaataagtttaattttagaaattaatttataatgtcataaatgtttgattctaaatgtgcattttttgagtgattgtagatatgcaataggaaacaggtacatccaattgagataatcgaagaaatctggccaggtgctattgaagaaatttatgagcttagtttaaaatctgagtggctcatgacttgacttgtgaatggtgagagtgaaaatatcaggtaaatgcacagaactatctatgtgttgaaaaattctgcaggaactttcaacatagtacctacagatcttgatggcctaattacaactatgtgttttgtcccacctagcatcttgctatacccaatagcagttttcattgcaagtaatagtattcttgtgttctttttgtcacttaaaaattaaaattagttttggggctgattacaattgacttcttttagtacgtacaattgtattctttttatactacataagtgattttacatttaactgcatgtgccttttggggggcaacatacgatttgctttagtagcccttataaatgcttgtaggagtacgcagaagcacccataaatttgtttcagggtgccactaatttgaatggttctagatttttcatttgcatggttgagcttcattgctgcctgtcaaaacacagctgcagttacttatctttcgtgttttccctttttcagtgctgaaggatctggagtactctgaaaatcatgaatgggttagtgttgaaggcgattatgcaacaattgggatttcagatcatgcccaggtacatatttagatgttctatcactctgagcaatttttttttaattttgcgtaaaccttattttgcttcatgatactgtcaccttgcataaaatggatttaccaaaatataagtcagatatataaggatgatgatagatactgggaggggcagttccaacacttactactagaagggtagagggtatccatgactgcaagtgggaccctttacatacagatataatataaggaataaaatcactcacttgtatatgtgtgccgtataaaaatcgtgtcaaccatgtccttgtcgcaaggcgagcaacgctttgtattttatcaagtccttacactccacatggtgcgtaatgatagatagtggtaagatggaagatgattttaccccatagaacgttagtacttggatttggatgggagatgatataaaccccatcaagatagtagcacgtggtggactagagtgtaatgtgctgaaataagagaagtgcattgtactctaaatattacaaatacgcgacttgtaatatatagagtgaatatgggtacagtgatacaagcctacacagtgctcaattaaatcgtgattcacgcatgtctcttggattagaggctacgggagcctattgtggtcctttctcactatgcaagtgattagtagtttttcttataaattaaatatggactcttcttacaagaatatttttttttgaagaaattataattgagaaatgatgaattgatatgatttatgaaatcgcatgccatacatccttgcaattaatactgcttgctgagtgcttgtactcacccttgctactaaccctccttgtttagatgcaaacacgttcggcaagctagcgagttaaatggtgggttggaagagctctacaggaaagatgaggcagaactagctctacagcaaaagatgaggcataacttggttgaacgtttttttgtttctcttttttttgggtgaggggatcgccttttgtttctattgcatgctatgtaacggtggagagaatcattatcttcactatttgaaaaatgattctacagaagatgattgttttttatggcagtgcttgaagggctctgcttcgtggtaaaaaagaacacttgcgaaatgttggatcatccttgaaccatttgaaacagatttgtttttttactgcctaaaatcacttgcaaagttcttgagcaatttattttgtttgggttcaggtttaaaaaaatttttacatattggctttactgtgtcaagttttttaattggttacacatttttttccgctgaaagtgctagattgatcagacgactgaagcataatcacgcatgttttgatcccttctgcttccatgagcttgctagtcggttctataatttgtgatcagattgttatacactcactgtatgctacaaggtttctgtgtatgtattcaaatttaacattcatctactaaaaaaatatgttgcaatgtgtaggtctcatctagtagattaaaaatcaatgctagatcactggaattttacctcaaattttcatggaaatccatttttcactctgagctacaaaaccggttctttttcactgttaacttttaaaacctagcatacatgccaatatgcgattgaaccatcgtgttaaacctgttagtcaaaacagcacaatcctattcaaaaatgacaacgttattctactcctaaaatgattgtcacaatgaaatttgatcaaatgtgatgaaactacaaaggtcataaaattacacccaccaaaaatatcacgtatttttttcaaactagaaaccaaatttgtattcttcaatcaactacaaacaagtcgggaagagaggtgaacctgtccaaatcaccgaaaaaaatagtcatttttacccaaaatttgaaaccattttttattttttagtgaatttcagcctaatttggtgtccactaaatttgattgaattcatatgaaggtttcactttttgttttcaaatttggttgaaaatttggaatttaagtgatttgggtaattctctccataaataaatcatacaaccaacaaaagtcgatggctgagtcaaaggacttcaataaacaaatattcagtcaagtacatggcattttaacataagatcctctgtttttctcttttcttctagtagtataaaatagctctgggtgaggagttcaacttaaaagtcggtagggtatttgtcgggtttaaaccacaaggagaaatcaattcctttcttcttaagatcttctgtggcagggccaatccgatccaaaagctgcaagtcaagtaacagggttgatcagcaactccataaaatttctccaaaagacgaccaaaaattatcattactcttggtgatgcatactactaccgtctcacaataggttcatttttcactagtcccacatatatcaatataaaaccaaaaagactacaatagccccactttatcaaatcccaatacggttattcttctttttatctactccgaatgaatttatctcctactttcacaaactccaatacaatgattgctcaaaataaatgaacttattttgagacaaacgggatgggcaaaaaataatcttattctgagatagagggagtacagcatatacacactgaacaggcagcctaagcctggaattctcctacaactagtatgataaatctttcggttggaattcttaagttcgcacggttggaattcttaagttcgcacaattggccctttagtggtatgacaatgaatgcttaagatatgagtattgtgatctttagcatgagagaacaaactacttgttaagacttaagaacaaacctgatcatgtacaacaccattggaaacaaggacagaacgatcaaagacggtaaactccccaccatccatgcgtgacaccatcccaccagcttcttcaactatctgtagtaaaaaaaaatgccgaattcatcaagtaattatactgaaagtgtgcataactttagcccaactatcaggatttggacgatatgaaaaggaactcataaaaatggattatatgactgaaaatgtgtatttaagattgaacaaaacaatcaaatccttgtttttactgaacttggatatcttttcttttatcaaagtttaattccaatcatgaactgcgggttctgatagggtaaaaaaagattaccagaacaccagcagccatatcccaaggcttaagtcggtattcccagtaggcttctgtaatgcctagggcaacgtgggacatgtcagcagcagcagaacctagtcttcgtactccctgaaaaaaaataataaaggaggataaagcaaaagtcaaagggggtaaatttgttgtgtaataatgaagggagaattcactttaccctgctaatgtctgtgtattccttgaacaaatttatgttggtcacccatgcatcatcatgttcataaccaaaaccagttaccagaagtgattgttccacctagagaatcaattagagacaatatctttcttcagtcaaatattctgacaaaattaaatcacaagaactctggttgcatccagaaccactacaatcaatagatagatacactgagcgtatgatcaaagagagattcttatggcttcataaaaaaagagctattatgacacgcatatgcgtgcgtgcacatagcaacatacttgtataaaagaaaaaaaaagttaccttgtctgtcttactgacatgaatcttttgcccattacaataagcaccaccaccttttcaaggagaaaggaaaaccttaaaaataattctgtagtgttctataaggaaaaaaaaagcattgcaactacagtgtttgaccaaagattataccagatgatgctgaaaccgtacgagtgctccagcacataggaccaccacaaaattcgacctaaataagggtatatgaaatgtgaataatccagagggatgcaatgaactagcatgggaagtttgatgatccaattgtgtctccggcgtttaatgaatcatatgattcaagaaaaacacatgcacatacataccacagtggaagcagcaggctttccgcgaaacagaactccaatggatacagaaaagctagggtaaccatgcgcaaagtttgttgttccatctaaagggggtaaaatcactgcattagatcccccaatgaagaatactacagaaaaagtctaagtttccactgcagtaatacaagttcagataaaccttcagttaaaaattaaaatcaatgtgatcccaatcttgtttcaaatttatgaacagttcaaatactctaacatccatttatatgaaaggctttttccaacatccattctcctaccaataatactatatactagaactaataacatcctgttcagttaccagcccatgcaatcgagcatgttgcctctactaaatcaaatatttcagatacttaatcaagagagcatatggaatcacccagtattcttaaatgattactaaatgatcaaactccactacaggaacaattggttaatgacttcatcatagtagaattacaaagtacttcctccgtttcacaatgctagaatgacttacgttgtgaaacggagggagaataaagtggccaaacctaaaggatcaatgcaccagagatactccgacaaggcatctccaataagtccaccttcctccccaagtatgaggtggtctgggaaggtcttcctcacaacttccagaatgaccgactcactcaatttgtctgtgctgaacaaaagtagagaacacactaaattcaaatgctaatgttttatttagattatagagatacatagatcataaaatatgatattagcaagtagcgacatcaagttccaatttacaaagcatttggagattgtaggatgataacttttttcttttgaaagatcaagaatgataaataacaaccaagttagcatcagatggggaaacaacaacacaagtaagaagcatccttactctgtgaccaggtctgcaactcccttgtagtgaatattgcgtggcttattaacagcttccattataacctaaaatgaggagaagacaatgtaagctgccttgagaattggcacatcaaaaaatagagttaaaaggaaatgagcttagctcactaggtgagatgtgtaccggtgtacaaccccaccaccgaagtccaatttttttttagagctgggatgattacatttcaaacgcctcggcctttgcaagaaagcccagaacacctaagtttaatttttgtttggctcg

SEQ ID NO: 44210 - DNA, 71375 bp, Oryza sativa
  unsure (1)..(71375): unsure at all n locations
tacagtagttcatgcaaaaaaagttttttttctaataaaagggtagtatatttttttgctgctggtatggataatgcctatgctgcatgaatcttaatttgcgtacgcgtgtggcattatcttaagggcctgtttggcatagctccagctccagctccacccctcctggagctggagctcagccaaacagtttcagctccaccaaaactaggagtgaagttgggtggagctctctcacaaaatgtactagagttgtggagctgggtttcggcaactccataactccactccagactcaactcctggagttatatttaggagttggagctgtaccaaacaggccctaagattcatgcgagcttaatttcactttcgatcttaattattttacctggttcatttgatgatttgcttactgaatgtctcgggtatttagttccaagagaacatctcagttctattggtaaccttcaagtaaactgatatgctcttttccaccattttgcaggttaaggatagaccgcatgaggctcaaagggcacgccagatagatatttttcagttttgtcctcttgcaactcctgcacctctctactcactatagtagcagtgaccacacaagcttacctgagcttgagagctcagcattatcttctcagtcttgttctcccttcacagtttcagatttatgctctttggctgtcaagactcgagcagtctgttgccttcaccttgtgcttatgtgagttagtttctgtcttctctcaattattactagtacttgattcttcagaggtcatgtgggtttgaccaattagcacattgcagttttctgtttgatgtccatggtgaatttgtggatacaccttatggttttcaaactagtgttttggaaacaacttacatgctacgcattgaaatgtttgctttctgaatatcttgggtagaagttctcaaagaacatacaccagctctattgataaccttccagtatgctgacattccttctcccaccattttgcaggttgaggatagaggctctgttgtattatcctgtcacaaggccaagatggaaaattaatgctagtcaagatgccacgcaagaaactggcctgattgatgcagaaattaattcttatgcctatagtgaaaggaagaacaggaaatacaacggcgcctacatcgataaagatggtgtatcaaggaccttcgatcgaaagaaaatatcaagaaaaaggggtaaatgctaaatatattatctttccagttgttcttccctttgttcttttgttcagcacttctacattccatgaagtatctaatcagtatatgtttgcaagtaaattgttttccctccttcaaaatgatctaatgtcttcaggtttcatgcagggggtgctatgagaggccggggctggaagtatggctctggttttgtagatggagtcttccctgtgctcagtccaatggcacaggatatcttagaatttgttcagaagggaacagacgttgcaaaaatctgggaatctttggataacattccttccacacacaatctttttgatgatcttgtgaatgtcgctgtccaattccgtatgaacaagaaatgggatctgatcattccagtaagtctgaaccctgcacattctcatcattaactaatcggatattcacatctcaatgtttcggttacctttgatcagtattttgatgtttaatttgtcaaaagtggatataggtctgcgagtggatcctgtacaggagctcattccgtcctgacatcatctgctacaacctgctcatagaatcctatggcaagaagcgtcagctgaacaaggcagagtcaatctacatggctcttctggaagctcagtgtgtgccaactgaagacacctatgctcttctcctgcgcgcttactgcaacgctggatcgctgcaccgagcagaaggcgtgatctcggagatgcgcgagcacgggattcctccaagtatgcagctcaattcccctatattgccaagagaaagaagcttgtaggttgacatagttgcataactcatgtcaagaacaatcttgcagatgctactgtatataatgcttacttggatggattactgaaggcaagatgtaccgaaaaggcggtcgaggtgtaccaaaggatgaagagagaacggtgcagagctaacacggagacattcaccctgatgatcaatgtgtacgggaaggtcagaattcagagcacaatattgtttttcagttcactgtaaaaatcttttcatttctctttctttgaaaacttacctctgaagaatttctgacatatattttttcatggtcaatttgaaaggcaaagcaaccaatgtcatcgatgaaagttttcaacgagatgaagtcgattgggtgcaagcctaatatctgcacttacactgccctggtgaatgcatttgcgagggaaggcctgtgcgagaaggctgaagaagtgttcgaggagatgcagcaggcagggcacgagcctgacgtgtatgcttacaatgccctcatggaagcttacaggtgaatatcaaattagcatatcagtcatccatggcttcacgagcccaagtttctgatcacaaaactccagtgaaatttgatcagatttttttgtaagtttgaattagcaattaatagcttgcaacctttcaatgcacccatagccgcgctggattgccgcaaggcgcatcggagatcttctccttgatgcagcacatggggtgtgagcctgacagagcttcatacaacatcttggtagatgcatatggaagagccggccttcatgaaggtacattttgcagttggtgatggaaaattttggccaattttgtggtcaaagaaaccaagaacatgagttccatgatgctactatgaactctgaaagtgaaagcctccgaatatatataattttgcccctgtctgaactctgaatatactctctccatttcaaaatgtacgacgccgtcccaaaataaggcaacggcgttatacattttgaaaaggaggtagtagtataattttgccactgtctgaactctgaactctggaagtagtgacagcttcttctgagaatgtataaatattcggtgttttcagatgcggaggcggtgttcgaggagctgaagcagcgggggatgtcgccgacgatgaagtcccacatgctgctgctggcggcgcacgccaggtccggcaacgcgacgaggtgcgaggaggtgatggcgcagctgcacaagtccggcctcaccccggacaccttcgcgctgaacgccatgctcaacgcctacgcccgcgccggccgcctcgacgacatggagcgcctcttcgccgccatggagcgccgcggcgacgccgacgtgggcacgtacaacgtggcggtgaacgcgtacgggcgcgccgggtacgtggggaggatggaggcggcgttcgcggcggtggcggcgagggggctcgccgccgacgtggtgacgtggacggcgaggatgggggcgtacgcgaggaggaaggagtacgggcggtgcgtggggatggtggaggagatggtggacgccggctgctacccggacgccggcacggcgagggtgctgctggcggcgtgctccgacgagcgccaggtggagcaggtcaccgccatcgtcaggtccatgcacaagaagcccaagacactcttcaccatataataataaaaaaaaacccaacactttgcatatataattgcattattattacatgtataataatacagtataaatgtacattacaatactaccttagttttcttttaatgtatgccgccattaattctaaagtagcggctaaccattcatcttaattattttaaaaaaatattgtaaatatgctactatctctgttttttaatataactaaccaacgtcatatatttagggatggagggagtaaattgtaagtcataaaacatgtgacaacaaaataaataaaatttatatatttttaatagcatgaattgtcaaacgtcatataaaaaatcaacggtgttatttattagaaaatgaagggagtatattatagcatagagtataatagattgatttagcatcaactttgttgctgtagagtgtaaaacggtgttgtcttgacaaatataatgtaaacaggatgtgtatgcaatcaaaccttaaacttttaaatcattttatgtataaaaatatatgtgatttggtcaaaaagattactgtcatgtggttaggataggagtatattttttaacaaattatgaatacattggtcagataagacaattattaaaccgcacattctttctattccttagggggacttattttagtccctctcaaaaaccataaatgcttgtccctactaacagaaactattaacagtaatagttttgactcggcccactaacaatttttgaactgttaaactacgatgaacgaacgaaagtaaatgcttacaaaacactcaggcaactgatctttttaaatatttaaaaaagtttcataaaaacaaatagtctaaatataatctctaatactccctccattccataatataaggcacaaccacttttttttagatgttccataatataaggcatgcatgtatgtaggcaattaactatgaccccttcttcattaaattattacttttttaaatcctccactctcatgttctttaattctattagatacatgcattatatttattaggatgatccaaactacaatatgataataaatattttcttggtctttgggttaggggtgtgtcggtgacatgggaccgggagtatcatgacttaaagacttgaggcagacgcgatcacccacgtggcctaaccccctcggggggggggggggggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccacatgtaacgcagtgcagcgcactcgtttatccggtctgtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagagaggggaaaaacgatcccagaacgatcgggggctggctcgcactttgtagcttcttcatacatagatccaccaaaacacaggagtagggtattacgcttctcagcggcccgaacctgtatacatcgcccgtgtcttgtgtgtttccattctcgcgaaccttccacatacagactaggagcttagaatctcacccagggcccccggccgaaccggcaaaggggggcctgcgcggtctcccggtgaggacccccacgctccgtcatctggcgcgccaggtagggggttctgtgtgtgttcttctaagctctcgcactctttcgtgtgcgccaagcttttcctgttcagcccaatggctgaacaagcaaaggcgcacaacctctctccgagtgttagcggtgacgacggggagccaaacccacgccgtcgtgctcgtactccaccgccccctccacgccaaagtcctagacgggaggaggcgctcgagagggtcgaaggatccgcgacttcgacatccacgggtgatggaggagggcgccgagatggggagcgtcgcctcctcgtctatggcgacggcagcacgccccagggcgcgctccaagctgcgggcgcgctcctacgtcacccgcccgttgtccctgacccggagtctccagtccaacgttggctggacgacgtggccaacttggtcatgacggcacggcagcgcctaggtgctggtgggcggtcctccgccaccaagacctctggcgctgctaccaccggctccgtgtcgtcaaggcggagggcacggcgagcggcggctgttgctcgccattcggccgccactccttcgtcagcacctccgacccaggaagatctgcgtggggggccggatgcccgcatcagtatcgagcgccggcgtaatggccgacgtgctgcccatgcaacggagggcgcctcctcgtccggagtgtcacatcaacacggacgcggggatcagccctccgtgcccccggttggtggtgtcggctgtagagcctttgtggcgagccttcggaacgtccgttggcccctaaggttccggcccaccatcgccgaaaaatatgacgggagcgtcaaccccgccgagtttctccaggtctacacaaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacaccataccatgcatccctgcacacgcggtgatctacgcgttcagggggggtgtgcggcacaaccgcatgctcgaaaagatcgcctccaaagagccccagactaccgcggagttttttcagctcgcggaccgagtggctcgtaaggaagaggcatggacctggaacccctccggttccggtgtggcagcttcggccgcccccggatccgctgctcggacagggcggctgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaatattgaatctccactgatcaacgctacaccacgttgaacaggcccaaccaacccacctaaactacagtgtattgggtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggatacttacgaccatgaagcatggccagatgtctcgagcacgcagctcactctgatactaaaaaggtctaatactgcaattatcccatcaactgagctagtggtaattaagcatggctaagcataaagttctagctaggtcatcaaagtaacacaagctaggtgatttattacccaaggatgacaaaggacagatatcaagtaaacatggcacaagcgagcagataggtaaaaccctgaccccatgtaattagcaaaacatgcatatttgtttgcaaacagtaaaacatttgtaaattaggatcaacatgctcaaggggaatgtgtgacttgccttgcttcttcactttgatcttccgaactcttttcctcgcgaccgcggacttccgaaacgacggaaactacacgctggcacgcaaaacgagaaaaaactctaataaaaaccaaggaaacagtacataaaaactaaacaaacatgtagagctcaattttagatgaattttgcaagttgaatggctcaattcggagttcgaatgaattagatatgaattttagaagttttgagccattttaatggatttctataattaaactcgatttattgcgcaattattatttaatttttcaaaggaaaaaggctgccgctgacgtcatcaagtgaggccggcgccgacaggcgggccccacacgtcagcgggtcaagggaatcggtccaccgtggaccgggaccacggggtggtccaccgccggtccacgggaaccgacggcccagatcagcccgagctgatcgggcggccacgaggcagggcgcccagagcacgggcacggctcagagccggcccgaccgagcgatggcgcgcggcagcgcggccatcggcgacgacggccggcgacggcgcggggaggagaggagggatgctcaccaagggcggcgacggcgagactgcaacggggaaaccggtggcgggctcctcggggaggcaacggtggtccggtggcgtaccacggcgcgaggcggcggacggtgactgggacgaccggggcgcggagagggcgatttcagtggttcccggaggcgaggaagcggtggccggggtgcggctcggagttgccgatccgagggaggaaacggcgcagtccggcgtcgaccggggaggcggggcgacacagatggagacggcaaacacggcggcgatctcgggttggtggtgaagttggtgctcgggcagcgaggggcgacaaccgagcggcggccgagcttgactttgaggcggcgaaggtaccggcagtggtggcgcattggggcgacggctagggcggcggtggcgcgcggctgaaggcggtgaaaggggcggcggcctcgggtgtacggtgggagtggtgctcgaggggtggagagggggaaataagaggcggccggacttccccttgcggtggcgaagctggcggtggcggtggctcggcgcggcgacggctgtggcggcgggaaacggcgaccgaagctcgccggagtgtggcagcgcgtgggtgcggcgtggggagagcgagggagagtatgccgggctcgggaaaaaaatggggaaacggacgaggggagcacggggatgctttttatgggctcgggaaggcgggatcgaggccggacgtggcggaatcggccggcgaagtggagcgccgtcgtggggtggtggaggggttaaccggcgccgtttctagcggggtgagtgggggaaaaggtggaggacgtggagggggtcgtgtccatgtggttggatgcgagctcgggtgcgggaggtcgccggattttgcggcgacgtggggcggctcaggcggccatggcggttgcagccggccagccagaggaaggaggaggagctgacgggtgggaccgccggtcccacctgtcggcgaagggagagaaggagggacgcaaaacagacttttgcaagcgggccaaggaagaagggagccggcccgagagagggaggaggcgcgcgggccgcgggagaggaaggagggggaggaatttgggccgagcccgaaagggaggaaggggaagtttaatttgttttctttttattttaattgatacaatgatctttgtgttattaaaactatttctcgagctccgaaaattcacggaaaattccggagagtattttagggcacaaagaatattgcaaaatattcccggccaatgatttttaagggaaaattttaattctcccattatttcacttgattaaattgattaactttttattcaatttctaggaaatgcatcattaaatgatttttaatcccgaacgaaaatcggggcgttacagcggcgtgacaggaggaggaagaagaggtcagcccattccgacgacgagggtcatgtcctcaccgtcgagggcgcttcgcgggccacccgaaaggggaggcctgcgagcgacaaaaagaaggaggccggcgctcccagtagggagcgcccaaccagcaagtggtgcatcgtccacaacacctcccttcacgacctcgcggactgccgcgcagtcaaaagtttggctgagcggacgaggaagtgggaggaggagaggaggcaggagcgccgagagggcaagtccccggcggttccttctagcaatcggcgaagtgaggccaagcagaaggcccccgccgaggacatcgatgacggcgatgatgacctaggtttccaagagcccggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccatcgtgcgttgcccggggaggacagatcgcaatggtggtttcccccactgtttgcaacgtaaagctggggcgtgtcctcattgatgggggagcagccctcaacatcctttcccccgcagcctttgacgctatcaaggccccggggatggtgctccggccgtcccagccaattatcggtgtgacgccgggtcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcagtccactacgcctacctccagatgaagatgccgggccccggtggccccatctctgtccatggcgacctcaaagtcgcgcttgcttgtatggagcagcgcgcggaccacctcaccgccgtgtccaagcccgagggaggcgacgagaggcttggcacctccgcccccgccgccccgaggcagcggatagtcacatgcgacgaggtcccggtcaaggaggttgccctgggcgacggcccgtccaagaccacacggatcggtggtcttctggacggcaaataggaagacgcgctcgtctctttcctacgggcaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgccccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcccgggagagagcagggaggagagcccccgagccgaacggtggcccaaggcccccgacgaccggagcaggccctctgcccgcttgtcagacggtgctaggtgcccctgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcccccgacccccaggacggccccgaggccactatgggaaggccgcccctgtcatcctccgaccccgaggtcgtcggcacagaagacgagtgcaccccgcgaggccgcttggacaaagagcgccccagggatgtggcccctagcgaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcggccaaatcttgcataatcgagagggtactggacgggtggtgaaatgggcaatcgaactttctgagtttgatttacactttgaaccacgccacgctatcaagagccaggccctcgccgattttgtggcagagtggaccccagctcccgagcccgtctcagtccccaaggccagctcgggcccctcgcagctgcctcacaccgcccactgggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcatcggcacgtgtccagacgggataacacggttgccgacgaactctcacggctcgcttcctcgcgagcccagaccccaccgggcgcctttgaagaaaggcttgcccagccgtcggcgcgacccgaccccttaggggagacggacgcgcctgataggcccccgatgcccgtcggagtccaggcctcgggacccgaggggagcgctcccagctcccttagattgattgcttggatcactgagatccaagcatacctcacatataagactctacccgaggactgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaagccctgcagatcataccactttcatggccatttgctgtctgggggctcgatatcctgggaccgtttaggcgggccccgggcgggtttgagtatctgtatgttgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggtgattcgtggatcgaggagttgccagcggtgctctgggcgaaccgaaccacgccaagccgagcaaccggggaaacgcctttcttcctcgtctacggtgcggaagcggttctcccatccaagctcaccctgaggtcccctcgggccaccatgtactgcgaggctgatcaagatcagcttcgcagagatgacctcgactacttggaagagcggaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaccacatatgcatattcttatttctcttatatctgtatttcaataaaagcattttcgatttcctaaaggctgtatctatgctgttgtttccttttgaaggattttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgagggctaggacctgggcacgagcccttgttcaagccaagacacaaaaggaccgcggcacaggcatcctcgtctcatacacacaacaaatagaattgacaaaaaatttcctctttatttgattgcagattaaattagtctatacaagaagggggcccgaaggcctcgaaagaagaaactatttaaagattggcgggggcctgggggctcactccgatgcacccgggtcgccagcctcgtcgccactgtcgctgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacaaaagcagcagcagcggaaaaaggcgatcctagcggggcttcagctccactccacaggcaaaactcaactggggtctgagccttggtcttctaacttcgtcttcaactcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaaatctccactgatcaacgctacaccacgttgaacaggcccaaccaacccacctgtactacagtgcattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccgtgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgctatgggtgcgactcgcaaaaccatgcacccacagcccaccattcagtcgcattttagttggataattacgaccatgaaacatggccagatgtctcgagcacgcggctcaacaagatactagaaaggtctaatactgcaattatcccatcgactgagctagtggtaattaagcatggctaagcatatagttctagctaggtcacataagtaacacgagctagtcaatttatcacccaagtttgacaaaggatagatatcaagtaaacatggcacaagcgagcagataggaaaaccctgatcccatgtaattagcaaaacatgcatatttatttgtaaacggtaaaacatttataaattgggatcaacatgctcaaggagaatgtgtgacttgccttgcttcttcactttgatcttccgaactcttttcctcgcgaccgcggacttccgaaacgacggaaactacacgctggcacgcaaaacgaggaaaaactctaataaacaccaagaaaacagtacataaaaagtaaacaaacatgtagagctcaattttagatgaattttgcaagttgaatggctcaattcggagttcgaatgaattagatatgaattttagaaggttttgagccattttaatgaatttctagaattattaccgatttattgcgcaatttaaatcaattatgacgtcatccgacggggagaggtggcgccggcaagcgggccccacctgacggtgactcacgggtggcgggcgcaccgtggaccgagtccacgcacgcgctggtccgcgggcgcaccacgtggcagacacgtggcggccacgacggacggctagcggaggtggcgccgacgtggcgccacagaggcaccgacgcgggcggcacgggaaggccacgtggacggcccagatcgccccgaaggaggatcgggcggccacgggcgagcgggagccagctcaccggtcggccggccgggagcgacggcgcacggcccgatggtcgccggcgacgaccaccggcgcgacggcacgcacgggaggcgacgaaaagaggggaaagggaaaggagatgaagggggtcctcaccgaggagcgccggcgacgggacgaccatggggaggcgaccggcggcggaaaggatggcggcggccgacacgggaggcgacgggaacggcggtccgacgacgcccgaccatggcggagccgcggccgagggccggcaagacctagggaaattattggagcggttagggagggaaataggcgaccggagcggcgagaataccacgccagagaggagaggaatggtggggctcaccggcgaccgagagataccacgttccggtgggtttccggcgatgaacaacggtgaccgaggtgctgcacggcgctgcgaggcgagaggtgaagacggagcgacgcggcggcggctaaggcgacggtggcacacggctggaggcggcgtatggtggaggtggctcgggatgcacggtggaagcggcgttgcggcggtggattggcgaagaggagcggtggacggggtgcgcacggcgactgcggtgccggggagggcgacggcgcagtgcggggtggacgggagcggcggcgcggcgctgctggagttcgccggagagcggcggtgcttgggctcggcgcggggagagcgagggagggcgcggcggcttggggaaaatggggaaaatggatgaggggagcacggggatgctctttatgggctcgggaaggcgggatcgaggccggacgtggcggaatcggccggcgaagtggggcgccgacgtggggtggtggaggggttaaccggcgccgattttcgcggggagagtggggggaaaggcggaggacgtggaggggatcgtgcccacgtcgttggatgcgagctcgggtgcgggagggcgccggattttgcggcgacgtggacggctatggcggttggggtcggccggcgagaggtaggaggaggagctgacgggtgggaccaccggtcccacctgtcggcgaagggagagaaggagggacgcaaaacagacttttgcgagcgggccaagagagaggggagccggcccgagagagggagaaggcgcgcgggccgcgggagaggaaagaagacttgggccgaaaatggcccaaagagaggaagggggaaattttatttgttttctttttattttaattgatgcaatgatctttgtgctattaaaactatttctcgagctccgaaaattcacggaaaaattccggagagtacattagggcacaaagaatattacaaaatatccccggccaatgatttttaagggaaaattttaattctcccattatttcacttgattaaattgatttaacctttatttaatttctagaaaatgtattattaattgatttttattcccgaacgaaaatcggggcgttacagtcgcccactccgccgtcatcgtcctcctcgtcggagttgagggcgaacgcgagccgaggggccgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggcccccctggttggcggcgtacttcgcagtccgcccgccccagaggcccgcctgccggccggcgcggtctagacgggagacggcgtcccgaagcatgccgggccctacctcgcctgccaagcggagggcctcgacctccccggcggacgagtctagcgcgccctgcagatcggcgatggtgtgttcggcagctgcgaggcgggcggttaagtcgctttcgcccgcggccgccccgccgctacgcgcccttgcatccagctcccttgcctgcgcctcgagttcagcggcccgctggttcagtgcggccctctcggcgcgggcactttccagattgcgacgcgcttgttcctcttgcgcagcctcgcggagggacaggctgtccgccagccattgcgccgcggcctcggcctcctcgagagctcgctcccgctcggtgagcgcgtcctcgcggaggcggagcgcggactcttcttcggcacaggcggcttcgtgcaccgccagtgtgacctcccgaatagcaacggcggcctcgcgatccgccaggtccctctccacggcgcaggcacgctcttccagcgccatggcacgggcctcaagggcttcttcgcgccgccgggatgccacctcggtctccgccgcccgccgttctcgggcagcggcagcgtcaaggaccccccgggcggcgtcgagctttttccctagctccgcctcccagctcccgtattgaagacggagggtgtcctgcgcctcgttcatcatggtggtggcgatgagggcagccccccgctcctcctccacctccttggcgatctcccccagcaccttccgacgggcttcgagctctgagacgtgccggcggtgtgccttgcggcccacctccaccatggcctccaccgagcttcgcccctcttcgacacgcgcccatgcggcgtcaagctccgcccgctctgcttgcagggcctccacctgggcacttaacccgtccaacaccgtggtgtttgcgacggccaaggcctgcagaaggggttctgcgctcagtggagcaacggaaggcgtggggaagagccgcctcggtgaggatgccgcgcggctcggcccgccgatggacgtgccggactcagggatgtcccccggacctggcttgtcctgagcgtcgcccgagggagtgggcccaagcgatgcgcccgcggcctcgtcgcgagctgcctcggaagtcgtcgccgcctcggcctggcgaagtctggcctcctcccgagcggcttcttcagcttggcgagctcggacggccacctgggcggcctccccggcttcccgtaggcgatccgcggcttctcgccggtcagattcccgcctccgagcctctgtggtcgccgggtcctcggcctcagactggccggacttggaatggcgggaggaacgcgacgggatctcgctgaaacagaagaaagaccagaagacaaacaagatggatgagtgaaaactcgcgttgagggaatgaatacggccacgatgggcgtgggacgaacctgcgagggggtcggttaaacgaccaccttggaggggaaatgaggtttccccgggatggttctgtcccccccatcttgcggagccgtttcttcttccgctccccctcgggctgcgacgtcggcgtggccccctccgggcgcctgctgctggcacgcgccgccccgccccctcggggaggagatgggggaggggttccttcctgcttcctcttcccccgggcgtcggcagggcgaccgctccccgggcccccgtcacggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcactgcagagggggaggactccttgaggaatgagggatgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagtggcgcgatccggcgacgaagatagtcgccgaacaccatggcccctgtgagcccctgggatcgcaggcccgccaggcggtcgaggacggcgtcgtagccatctcccagatctaccggcgcccgccagttggaggcctgcgctggaggctggctcggaagtcggaggcgcgcttcgtcggcgaggggggtgtagaatcagtcgctcttccagtcatcccacttcttgcggaggacgcagggaatgtagcggttcagcaccggcccccgcggctggaagtagcaaccaccaaccaccgacggcggcgacactggctgtacggtgaagaactaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgccgggcatccctcgcccagccagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaacaaggagttagggcgcaagcggcgaagacaaggggaataatggcgaaaggaaggaagcaaatctcttcctcgacgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcaccatatctccaggaaaaacgaaccggcttgtcccgatttttagaccggccccacctgtcaccaggccttaagaagtggcgtcacgcccgaccgcttccctcgaggagggcgatcgccctggcataacgccgggggctactgtcggtgacatgggaccgggagtatcatgacttagagacttgaggcagacgcgatcacccacggccgcccttctctttgtctccccgaggggtcggaccgctcccgtctcggccgcgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcactcgtttatccggtctgtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagagaggggaaaaacgatcccagaactatcgggggctggctcgcactttgtagcttcttcatacatagatccaccaaaacacaggagtagggtattacgcttctcagcggcccgaacctgtatacatcgcccgtgtcttgtgtgtttccattctcgcgaaccttccacatacagactaggagcttagaatctcacccagggcccccggccgaaccggcaaaggggggcctgcgcggtctcccggtgaggagccccacgctccgtcagggtggttatgccttatattttggaatggagggagtaacaagtactctcactctctctcaagataaatttatctttaatcccttccatacatatcaattaagaaaaatactaaaataccctcacattatcaaatcctaatacaattatccttcactttctctactcccaatatatctgtcccttgcttttacaaacactaatacattgattattcaaagataaacttatttttttaaaaaaagtaaaaataatcatataaacttattttaagaacaaaaaagggtaaaaatgatcatgttttagtaataggatgaatatatatagcatttggaaatcgagaaaatattaaagacgccaaataataagaacggagtgattaatctcgctaagagcaagtacaatacacttttttaaaaaaaaattatttttgtcctctttcaaaataaacctaattttaagtaattattgtattggagtttataaatttgggaacaaatatattagaaatagataaaatgaaaacaattattctaggatttgataaaattaagatattatactctctttttttttcttttatactgatatactactagttcgtgggatgggcaaataaataaataaaattatttaggaaccgacgtactgcccactagaaccaattgttgccgctgttgtgcctagctgcactctgtctgcatcagccaccaacccctcattggcatcagagatcagattcagagtcacacagtatttgtactcgccatcaggcccatcaacagcaccatgccagattgttaattactcacgcacgaattcctaggccatatactagtacacatctccaagcccgtgatggccaagcagacagcagattaagaaacagagaactcatctgatttgtgggtttggttggtagtaagttgttggttagggcctccctgacagacagcgttccaatcagtttggtgatcacatttttttctcatcagagcttttggttttgcaaccaatggcccctcttggcgatacagcatctgatgcttaatcttctttaataaatgatccttcctcattgtggttcaacacgcactgtaacaactgtagtgttatttgacattttcatccctaacctagttagtatttttgtaaatatttctcaatatctgcaatatattcgcccttgtgaatatgtccatcagagttgagacctcctaacttcccctttgaaacacaggcgttttacaaacagtttatacttcgtaagtgatataaatcttttctatgattgcgaaaagtaaaccagatatggctcgaaaaatggttgccatttttttgaatgatactttttcctaaatcatagagaatattaagggtataactgcaaacacaaaaaaatgtaggaaagtgccccactaaggccaagagcccaccaaaaaatttttttcttcaatttgcaacctgcactaccaaccttttctgcatcttgcttatatttttgccaaaaaaaaagaaaaaaaaaagagagaaaggagccaccaaacccagaacccgcagagaaaagaagagagagagagagagatcagaggagagagagagacagacagagtgcggcgccgaggaggagaggagcaataatccaattccaatccattcctccgcgacctcgtcgtccgatcatggccatggccgcctccaggttgctgtgggcttcccgcgccgcctcctacctcaagatctccactttccccagggccttctccaccggtatctctctctctctcttcttcttctctttcggtttcttgttttgcgtatgtatttttcgtattctgtggtctgtatattcgtgggatcacgcgtggttggtggtggaatggcgtgatctcgttgcctgttcctcgcaaagattggattttgggggcaaggatcactgttcatcttatcttcttttattttgggttcagttggtggtttaggctgtgaatccgtctgcgtgaatgggaaatttggttggtctgatttgatctcttttcggcgaaatgtttcatcttttttttttgaaaaaggaatcttgtgtgattgttcctgctcttggtaacagcgtgtgcatggcaggtttatgtttctgcatttggatatgtgaatgttagcacactgatttctgaaattcagattagcctattgtatgtgttgatgaggaaggcaaagttttttttttagcctaatttctttctttgtcctgtttattcgaagtgttaggacgtttgacaccaacatatgaagcatctcaggaagatgcttttagtagctattaggagaaagctactaccgaccaataattggcaatattgttatccaatatgaaaatgttacaataccacggttgtttgtttatgaatttaaaacttgtgttgctaaatggtgtgccacaatcacatatttacagatctgaattaggcacaccaaggaaatgaattaagggaaagtcttattatagcagactttggttttaaaactttggtagtaggaaatgaaaaccatatggtaaaatatttatgcaacttaagaagtgacaaatagtcaattgttaatttgcctggccaagaggctttggtttctaacaagcattggacaaatggtcataggaaaatacacctaattttcagtttataaattggcttctaggggggggccattaattccagttgttctggaaatttcgtatgctttctgtggaaaccttgtttcctcactgccaattcagtattttacacatctgatgaagttgtgcatattgcttgttttctatttttttcagtgctgaaggatctgaagtatgctgacactcatgaatgggttaaggttgagggtgattcggcaaccgttggaattacagaccatgcccaggttgatctattcatacgttatatcacattcattgcttcattctgtacatacgcataatataagcattccatttcttaaacattacagggttccaatatatgttatcatgttcagtacatgtagcaaggactagcagtgctaaagttgatcatgtgttgtttttttttcttttttttgcttccagcaccatttgggtgatgttgtgtatgtggagcttccagaagttggcagcagtgtatcccagggaaagaactttggtgctgttgaaagtgtgaaggcaaccagcgatatctactctccagtatctggagaggtggttgcagtgaacgatggactaggcgatgaacctggattggtaacttttaattgcgtaatagatcattgtgagtagattgaacacttctatgaactgtgttttttttttttttgcataggttaatacaagtccatacgagagtgggtggatcatcaaggtcaaggttagtgattcaggtgagctcaattcattgatggatgacgcgaaatactcgaaattctgcgaggaagaagatagcaagcattgaacaaataccagtgacttgtgatctgcaaagaatgcgccttgacccttttgtcaatgcttgtgatgtgctatcgagcacttatctttaccaccggctgctcctgaaatcagcaccgatcaacacatgaataaattagtgttggcattgcctcttccacaaagagttgcaaacttcgaacctgtaaatgacatgagtttcgttatttctttgtagtatcgcgtgatttcatcttcaattgtagctctgccgcctctgctccgtttatttctgaaacgtgtgcttcgtttacttctgaatcgtgtgttcttggtgtctacgagcctgcattatgctgaggaattggggatgattggtagtagacgaatagctaaatataaattggggatgcttgattgcttgagaatcgtcaatatttcagaattaggaaaaaaaaactcatcccagattatggccttacttttcctagatcctagatagtctgcaattctacagctctgttcttagttcttacattatcagtatttacattcaggtgatgagaaagaataggctacttggaggattccctaatcacatagcaagttcatatcacaattcacatatccttctgtcatagaacatggacgccaaaattatcaaatgacacaaatggatgtgtaaaatcaccacgagaataacaacatatgggacaaaaacagtagatacttttatcactataagtatatgtcaaacttaagtgatggtcagcaacattagtgaacagtgatacagaactaatatatatgaatttagatacaaaaacctaggcgatgaagataaatactacccttagcctgacagaacaatgtcctcaacaaaatacagaaggcctcaggttgcatcacactttgatgttccacttgtgtgctgaccgtggaccacgagtgatcccctcataatattgggatggaagctttcctttgttccaagttttcacaaacttctcgaacagatcacgagcagactccgaagaaagatcagagaaaaatttgcctttttcttccttcaaccaggttgcgaactcattgttctttgcgaaatagtcatctttggatatttctttgaaatcctgtttcagtaaaacaaaagaacaatgataagcatggtctcaaggagaaaggaaatggagagctcaaagggtgcagtatgccattatgtatgttctcaacagtttaatacttccccaaaattgttgttagtctcaaaaatataaatggcatacatgatacaactcctgtccacctgtccagatacagataagccattctggttcttgtgaactgtgaccttaaacaagtacctgacttggtatcactaattttcatcacagacacacaaaaggaaataacctacaaactgatatcactaattcaattcgatggcaacagcaaaaaaaaaaaaagcttttcctttatattcagtcttcagagacaaaatacattctggcaagcttcagcaaaatttcattgttcaggaaaacaaaaggggctcctactcaggctgggtaagatggctacagaacatataccagcccggcgaaaaaaaatggtcgtaagaaatctgcgataatctatccctgattcacgcactgaagaattaactgaactagggacgttctccagtttggttctacttgtaaagaaaaaccaacctcgttccagtaccatagttatacgaaggctcaagcttgtagaacaattcatatatgaaaaaatgtggcctaaatagcctattcagatagcttaactgctaatatgcaaaatcatttgattgatgatgcccagtagattcatagcatcattcagacttagagaactcacatcatccttgtgctttcgcttgctcttctccttctccttggaatgcttctcctttgaatccctctctgtcaaaatcacacacacacacacactgaattactgacatacatcaaagctaatatagcaggtacgagtgtatcctcagcataatttgcacacttccagaatagttgagcatgatttcaagtaagaacaatataactgttttagaacaagaaatcaacaagtgccactgccaagccgtgaaggcaaaagatgaaccctagttccctacctttgtctttgcccctgtcgccatgcttcttcttcttcctcctgcgcctctcctcctcctcctcctcctcggcttgttcgtctcggctgctcctcctgctctccttcttgtccctcctcttcttccgctccctctcctcctcctcccctgaaccaccaaacgcaccaagaagattggcaaaatcaacacgcggagaccagatacgccgatgcctcgagagggggggaatggatagggggcctttgagcacctgacgagggtgacgagcgccgcttcctcgacttgccctcgccgcccatcgtcgccgccgccgccgccggggagaagaatcgaagagggggttagctcaggtgaggtctcgggacgggtttagttggtattacagatgagtccgagggctcatatgcaaaattgtcagaaggctttcgggcgcggtcgatccaagccgttcacgtctcatccgacgttggggagagagtacagcaatacgaagcactcacgctctacctaggcaaatcgtgtggttaacatcaagtttatggttttgcgtaaatttcaccctggaacacattttattactgaaattttcttttgtaccacactttcatcgatttttttttattttggatcaaatgttaatagtcttaccattgttatactctagaccacaccgactctcttatcaagtatacgaatgatttcgattataccagttactacttgtcattgaactcaaaatatgttgtacgaagtgagtgctccctttgtccaatgatattataatcatgaacggattagacctatcctaaattgtaatattttgagatgggggaaatacttagaacatgcatctatgtcctctttgcgaatattaaaacatattatttattcctcacattaaaaaaacgttttaaaaaatttcccacttgtattatttaaacaacttttcaaagctatttgtcaagtttattttttaaaatatttaatttatcattataattaaatagataattcgtaccactaatatgtccaataatctaagtactggtactagttaattaattaggtagtaacaggtaatctgcgtcataatttatagttcaaccataattaacaatctacagaaatggcattaatcctcaagtaaattaattaagctttgtcgttgtgttacatcctaaaaacctcaatgatctctctgctaattaaccatgcaaatgcatggagaccttaatatccaactccagttcagtagttcacacaccaacaaatcaaaaggtacttagcagctgtactagttaactaggtagaaaagcttgattattctgatgtgctaattagacacacacacacacacacacacacacacacacacacacacacacatatatatatatatatatgtccagaacgatgaacaattgaacaacacagcaacccaactcgatcgtctatcatcagctgatcatgcatcttcatggtctccaagttactcctagctcccagaatcgacaatgccatcatgtgcttaattagcaagcaatcatctagatctctgcagaatgatatcaatgcatgattaattcgcagctgtgttgcgatgaattatactccctccgtttcacaatgtaagttattctagcatttcctacatttatattgatatatatatgtattcattaatatcaatatgaatatgaaaaatactagaatgacttatattataaaacggatgaagtacataaactagtagataaaatcattgcgatatatatattcacatcacacacctgatgagagtatcaggatgtgccatgtatgctttgcttcgtttgttcttaccacagctgcaggccgtggccggcggcggcggcatggaagctgctgctgctgcagccggggtcctgcaggttgggctgcgtcggctgcagccggaacccggcggcggcggcggcgtcgacggcgtgcagcggcggggtgagctgcagcgcggtgctcgacgactcctcgccgtagtacgccggcgccgccgtcagcatcgacagcaccggcgccatctccaccatcgccttcacgtcgccgccgcccaccgccgcctgatgatggttctcgttgatctgaattcatatatagtttcatgtacaagaatcaaccaaacaccataattaatgtacatatatgtgcttcaagaatcaaaacattttaatgaattcttgattactgattaactaactatacgtataccatgcggcacaggaagctgttctggtcttccaggatgtgctcctgttcatcaatttcatgcatagaattgaatcaatcattttttttttcatcatcatacagcaaagtatttggtgtttcatgatcagtttagtagtgcaaattaattaccttgcgacgaaggttgtccagctgctggttcaggagctgatgctgcaacaagcaagaattaatgtgaaacaactattttttatttttttaacgaatcggcacttagatacacctatttcattgaatataacaaaataaaaaacttacgaaagcaaagctttacagaaaagaggaaaaaactatgggatcaattaatccctaaaccctaaacttaccatttaccattgaatcagagactgatcattctaaattaactctgaagaatgattcattcatcaaatactatcttcttaatcaattactagctctatttcatattacaagtcattttaattttttttcttttaagtttgattaaatttatagaaaaaaatagcaacacatgtaataccaaattaattttattaaatctatcactgaatacattttgataatgtttgtttttgaaatactaatatattttttataaacttgattaaacttaaataaatttgtaaaaaaaattaaaacgacttataatatgatatggaggaagtaattacctttctcgcacggactttggtgacggagaattcgagctgctgctcgagatcgttgatgtcggcgagcgtgaggttggagaggtcgtcgccggtgaacctcctgatgccaccgtccagcttctccatctcgttcctcatccgagtcatctccacaaatatttgctatatatatgtgcacattaattatatttgatcagtgcatttgaaagaaaatttcatttcaactgctggcagatagatcgatatatattctgatattgatcagacattgtgttgctgattgtaaaattaatgtatacctgatcgtggttgatctcctcgaaatgagtgttggtgacggtctggtaatgctcgatgagttccctcaaactatatattgtcaaacattgaaacaagtaccttgattagttgtgagttaattaatactttgataagttcatgtatctaattggaatggtgcatgtgtaattcttttgcgcattcaaaaaagaaatgacaatctctgatgtacaaatcagatggtataaattaattttgtagctagaattttctcttggtgatgtatatacttacagagagtatattattttagatcaaaatgaaacaaacgaaaatttcttaactaataacaggaatgaacaggggatcggaagaaagaacttcacatgaatattcacatattaattaactataatatgctgcagaacagtataaaatcatgtgagaaacgtctggggatcttccggctagctccacaaagtggtggactagacaaccaaggttcgaaacctcacctcttctaattatttaatattaggtcattctcttatattcgcatctttttttaagtataaaaacatgcataacataagataagatatggtcgtactgtcgtacacttgttcaaattatattccctgttgatatacatcttttagtttgattaaattagccacatatgaaatagttttttggggaaatccacctaaaaaacccagctcgatcctagaaatcattagaaagagggaaataaggattaattaactagttgactataaattcaggatcaagttgcaaatctacatacatatatgttgctcagagatgtaaaagacaagtgcgtaatcaagtcacaagagacactagggcatatagatcattgcttatgtatgcctttgatcatgatttaattttgtaatagattcttggctcttcgaaaatatatcaaaggaaactgcagatgcatacatatacactgaaaatagttaaaatgaaggtaggaaaaactcgatcgatcaggagttcaggacaagaaaaatagttcagatgaagaataaatgcaaggcatccatccattatatgaacagatcaaatgatcataattaaacactcttgcccaaagaaaacaaagggtagaaactgcatgagttagttaattttctctgaaaaacaaaataaaggccgagagaaacttagccgaaaacttaatctcttggttgacaaaaaacaagaaattaattaacccatcaaatcaagcactaaaaagagaacaagagacactaagctggagaaaggaaagattgaacagcatctgataatataagagaacaaaacaagaaccgtacctgcaggtagggctgcagtactcgaacatcttgccggtgctggagaagatgacgacgccgacgcgggcgtcgcagagcacggcgagctcgttcgccttcttcagtagccctccccgcctcttcgagaatgtcacctgcctgttcgtcgcgttctcgatcctcttgatctcgatcttgccgcgccccatgcctgctataccttcctgatcgagtttaatttaatttctgtgttcttttgtttctccttcttctgcacaagaggaaactgaagaagaagagaagaagaagaagaacagaaatggccaagttatgaacatatcgatacatggacgaattttgttaaaatcaacataaggcatgggtgctcaaattggatttccccccacagctatgtaaagggtgcaatcagaagtagaaaaaatttcatgtagagaagagaacaactagtagctagagatgtaaaaactctttgctgcgaaaggatgaagaactagctagaaaaggtgtccttttttttttcttgaattactcatgaacagggtagatagatagggcaggagtagtaatgtgctatgtacataccttgtgaagtgctaagcttgcttcaaaggctaaggcaggaggtgcagaaggagagacatatataggagagagagcttgtagtaatgtgcaacacacaatgctttctctctgtcacacactctcacactactactcctgcaaatcaaatcagtgtactactccaaatcaaatcaaaagtagatggagggagtagtaaatatccagaaagcaacaaactacatttttaactgtaactaatatgctagctagtctagttttacatttacccctgcatcagtgtgtaattaggatcagatagtgagtcaaagcaagaaacggatgcagacataagcatgacttcatgatgatgatgatcagatcagtgtgcatatccatgtgtgtacttgcagcatgcaatgatgatgcactagcatatactctctggtcgatctctgcacaaatacacgagcctagcttgtgacacaaaacacacactgcaacagtgcatatatcacgcacacaaaagttcagagatatcagtgtatgtagctcatgcaatataatgcaacagtattactcatcagagcacagtgcagctatatatacatgggcatggtataaaatcatgaacactacatgcaattgcgaggaaggtgtatgtagctatagcaactctctgcatgcccctcacaaggcaccatggaaagcaacatgtgtgtggacttgtaaccaccctctgacagtgtgggcccacccggtttcctcctccttgccgatcttggcagctaggtttgttaggttggccatggccatgaggagctctccagggacagggtacacttgctgcttatggcaacagagccaagaaaaccctagctcccttgtttgttgctagctagctaagagagagagagagagagagagagagagagagaggtatatgtgcagctagcatattgatcactatggttgcttgcttgccttgatgggggactgccactgcacattgtaccacatggggtggagggggggtggactgcacccctcatttgggaaggaagaaataaatttggcagagattttgatctctctccatgatggcttggctaattatatagtagagagctagggttccctatgtgatcaagttccgcgagattccgtgtttctcctttacagtaagtttagttttacggttttgctagctagccgtcgacagttttggaggctgaaaacttttgattttctggccgtgcgatccacgccatgattcgtgcgagatttggaaaaaaaaatctgcgcgagaattaaggtgtgtccttgcaagggcttgaacctaggatatccatccccaagccgtgcgtgctagccacttagatctgttgcatgtttttaaaaaattaattgagttacatgttagttatactccagttgcaccctactataactgcattgtgtaattgcattgtaactacgttatcatctctatataatttagatataaagttacatatattattttaatacttatatacgagttacattatagttatagtaaaattatattacaattatactatagttagatttgaaagttttttccttaaaaaacttgcaacagttttctagttagtccctagttttattacgcacatgcaagtgggttttttaatatgaattcagtgagatcggggatatgttattggttttcatctctttgaacgtgtattaggaggcacattcgctggtgtgtgtgagcgtcatggtgcatgtgcgtctatcgtgtaaccaggaaaaaaataattttaattttattaagtattcttaagaactaatgatatctaagttattatgcattttatttgctttcagtcagtcagagggtcattggctgttaattgttggttgaccttctgtttgtccaaatcaatacataatttttgggtggacaatttagtatagaagtccatacgataggggcaaaaatcaataaagaagatcattcagtaacttattatatatcctgaggaatattcagtctagctagctacctcgatctgaatttgacgaatcagtaatgctaaagtaacaacgcattcatgatcatgttgaaatgttaatggagagctggtggcatatattcggagcatatatacatatatatgcatatagcagcccttttttttggtgaggacatgtagcaaatatataatgaccatatataagcacacaatataaacaaatatgtactgtagacaagaatacaaaaaaaaacttaggctcagaactgtgtaagcatgctagttagcttttagaaaatcttacattaaccaaaagtaaatgggcattcttacccacatatatatgatcagcattttcaggctacttgttgcatgaacatccaaacaatcttaatttgcacatatatttgtacatatatttttcatctcatccactgtctgcaactgttgcatatgtagaaagcgaggacttccatttatgaaacactgattgtgaaaggaaacggcctctttgcatcaagttctgtggctttcctttgtcgatgaagcttggtttcagtcccagattctttctcatatccaccaaatgtgcaaattcagagagatcacacgctttacatcgtctgattgatcgactgccggttcagattgagacatacacaaattacacgaaattctatatcactgtatatttccaaagtaatccatccaaatatgcatggttgatttctcatccaaactgtctgcacatatacaaacgcgtgcaattgagttgatccactgcagcaaattcaggtaactcaggagatcagtaaaagattggaagaattaattatcacttgccaacactaatgaaattctgatcaacttgatgggctaacttttgttcagagttggcagaaatctgaacatcattaattagatgacatttgccacgtagttgtgtgaaatcagatggcaacagaaatggaaaaaggttatgttgaggaagcttagcaagaaatcttttgccatagatgttcctgatgagttgtaaccaccaccactttacagcaatgacaattattgatgtgccaactgccaaagtattcaagaaagatcagcttgtagtatatattgttttcaggggtgatttaatttatgtgatgagaaagtaattaaacaaattacttacaatacttgatagtaatcataaatggagtccgaatagtggatccaccaaactcaaaataattaatcagctttagtcagctaggaaacagattcaactatataagtacatactttggacccctcttctgaagctgtaacctgttgattatcatgaaggcaagatgtgaattcatatacacatggtctgtgcgtatgaattcacatcttgtctttgtctgactgatagctacagcctgatacttgcagcagtacatgattacacattacatctactaccattgaggaaagggagagaatatgagtgactcatctttcctaactcacacaaaacaaggactcaaggatgacacacaaactagtagtactattcatttggtattctgttgtgtgcttgtgccttgtgacatatgcatttaataatacccaactctaccattaaaggaaaaagaaaatgttgttttccagtatgatacatggacttatgtaacttgtgcaaggaaacccacctcatctcagtcgatttttccatccatccgatagatcaagatccaatggtccaggtcaatcaaaccattcaatacaaataccaatttctaacacccacctctcttctactccccagctgccgctgccatgcatccacaccttctgcttcaacaggactcctccaacgatgctagacgccgatgagccctccgccgaccaccgctcaccattgattctacctaagctttgcgaggtgcccccgccccatccacgtcctcgtcctccgactctaccatccgccaccacctaaccagttggacgagattcgtccaccttgttctcctttttcttagttggatcctgccacgggatctaccataaccgtccaccgctacctaaccactcgaccgagatccccctaacctataccctcccccttcgtcttcaatggctcccatcattagatacgccaccactactacccccccccccttctttgtacccacgggtccgatagcaccaccgccgcctcgtacccttgttaccaccacccaccattgggccacacatccccgggcttcctctaagccggggaactcccttctcttcctcatcctactgtgacctccaactgtgaattgtattctaactgggtggggttgttgtagccagttaacagagttcatcaaggtcattgaagatggaggagaagctcaccgaagcacggtncaaagtaatccgaaagccagaaatctgtaagatttggaattctattttctattgaatgtacgttagcagttctgtatacaacattttcaagcacgaatgatatggcaactggtctatatatacatagtaaattaatgaagtgtgaaaacttgttttgtgcttaagaacagaatctaaatttgacctgaagaagataaacttttatgaacagctaacgcggtgatgaatttgagagtagggaaacgagctagctagagaatgaaacttcatacaggatacgttgtggacatggatcgattaggatatatccatcacaaagaaagcaaccatctgctcttccatgcttcagcagcagcagtcctgaattcctgatgctttgcacatcgatcagcctcagctttggcccttggggactgccaaatcgagtgcaagatttttgtaaagcaggaggtatgatggccaatgaaagctattacccacgatcccaaacatcaagcgaacataataagattacgctttggttgtatgcatcgatcctagttatgcagaggccacgattgttctcaccgcagttatatcaccttgatataatcgattagttcaataaaaactttcatcatctaaaactaattaataagagtacgcacacatgatcctaataattttgaagttgcttaaaaaaatagcggtctaatattatctagttctggtcaaaactaacgagggttcgtgaatgggggagtaattcatttgtcgttacaaactcaatataagaaaatagggatggtacatactagctggtattcccttgttattttattgtgtactgatatcttgtagtctgaccatttagtactaatatgggacacatactggattgaaggaaagaaattgttttccactatatttgccccctcttaaccagtaaataggattggacgaggctcggacaaacaaagcgcatttgcactaaccttatcccctcctcgtgccaaccttatccccttcccatatgatgtacggaagctcctcgtacccaaaggtgtccatggtgaggtcgaagtccaccaccgcaccgcacatgaactcccacagtagcactgcctcggtcacctgtagcggcggctccacctaggacaccctcttcgactggacgatggcctagacctcattgaggccatcatcagtttttccggtcacttggagcaagcaccgccgggaaggtaaccccctcaacgagccaccgttctgggatggtggcctcttggacaaagctcctcaccggcgtcatgtcccaaggctaggttcgattaaatccgctgtcaattaacccgccagcgccagacgtcgtcgcaccaccgcgggttcctgaccctaccccatgctcaatgtcaactacggcacaacgaggttcgagcgtggcatccccttctccttttttttgttttggctcacgagctaaataagctggctctggctcaagctagcacacaagccgagccaagtgtttagcgcgttagcatagcaagctgagccaatccaattcgttatcctaatgagcccggatgaactgagttgactcgatatccatccctacattgatatttgaaatgaatcaatgcctgcatataccagcaagcttaaatctggtccctattaatcaaccctatcatatctattattcctagtttaattgggtatgatttggctagctattgtacatatacaatcagttattaatggcattatttatttgtgcatatcttggtcacctatatatgtgtatatatagaaaatgttgattacaccataaagataggccttttattatttgcaatcataacttttttccaaattattaagaaatcgaatagtgtgtttcaaaaaagaaaaggggggccatagcagctataaaaagccatgccaacccaatcagatagccatcaccttcacagccaggattagcctagctaacagcacccctgccgcagcctcccttttgcaattcgccgtcaattcatacgtaaagcagctatagccatgcataggatggtgaagctactctgcacgctgctgctggccctttctctcacggcccactattcgggtaaatttctcgtcgtcccaaaataactccatttcttttctcttatccaagttcatatctagaaataaaatgaagtacttgtacgatcgatggaggtagtactgtttatatatcgatttatatgacgaagatcgtcttttctttttgattatatagaatacgcacatgtgaaaacttaataagttttgatttgatctgaatttgcagatatgtcgatgaaggtgtcggccgattgtcagagcgtcaacgtacccggcccctgttctcccacaacgtgcgatgataactgcaagtcgcaaataggtgctggggctgttggcgagtgtacgtccgggggatgccaatgcaccttttgtactctccctcctccaaagaagaactgaataattaattatgatgatgatgcatcatggtctgtgatgtatcatttaatcctagcataataaaattatacgaaattgtgtcgacgatatatgtggatgtcttttggttcgagcgacgtttaatttggtgcatctcttacttgaagattcttgtttcgtggaattagagttgtactaaatatttttgagatctcgaataatacagaaggatgttgccgctccgtttctgaaaattatggcccgtttggtatacagctcctacactccgagattcttgtttcgtggagctgaagctgtaccaactgtagctgtcatatccactatattaatcataatttaattcgctttattttcttcttctgctgagattttttattgattagattttgccatatttgcaagtaattaattttttattttttatttttttttgcgaggacaagtaattaattatttgagcgtatcttggttacctatgtatagaatatgctaattacaccataaagctaggccttgttatttgcattaattctatatcctttcgaaagaaaccgcatatatgtttttccagaaagaaaaacctagcgtcaactatgcaagagtatatatgtgtctataaaagtcacatctgtcgttcatcctcacagtaacagctatccctcgcggtctactgttggggtaaaattcactactcccatattataagtcgtttattttttttaagtcaaacttcttttagttgaatgaaatttattaaaaaaatcaaacgatttataatatgaaacagaaggggtttcatttttattgcacataagatacgtagtgtaaacttaaaataagcttcgatatgatctgaatgtagtagctaggtgtgtcgatggaggagttggccgatggagcaaccccaaaggacttacgcaaaaccatcaccatatatatccggtctgtgttttccgaagttaagtcgtgccttgtttacagcaacaagcaagttgatgcagcttctaccagcgggatgcctatatacctactgtctctaaactttaaagagaataaaatattttctttgtctcaatataagtaaaatctagtacaaatataacatatattaaaactatgaatctaaacaattttatagttctataatatattacatctgtattggattacacttatattaggacggagggagtagctacgttagataccatgcatgtacaatggatccactaattaattagttcttgctaccagcacattacccatgttcaagggctccacaaagaaaaattagaggaattttgaaggatttgattcgtatggaaaaaatattcatgtgtggttctttggaacaatagagaataactctcctaaaatttataggaatttcggagaaattcatggttttctcttccagtaacataaagtttgtgtcatccaaacagtaattttgaaattttatatgttttaagttcctataggaattcaattaatgggcatgacgctttactcatgcattttttatgtttctatgttctcacaatcctgtactctgaaaagtcctaatctacctaaaactgtggtaataaaaatgccccatttgggttggagcttcagacatatgataaggtgtgtagcaagaaatcttatgcttctgatacgtaacttgatggctatcatataaaacggagtcgaacttgtagatccaccaaactcaaaaccatccgcttgcttgcctgctagcagctaggcacaaattcaggcattcagctacaagtacctggactgtagataccaaatgaagtgcgttttgtgcttatggactgtactacaatctaaatttatcctgaagaagacgagcatttatgaacagtaaacccagaaatttgagagttcagtgaacaagctagagaatttgcccaaagtttatacaggatatgactatcgatgcaagggtacttgtcccacccactttcatccaaagtcaatacacaggcagttaactttcacacatacaaataggaataggattcaacagaaagaaaccaaccatctgttttttccatgcttcagcagcagcagtcctgatgctttgcacatcagcctctgctttgatgactgccaaatcagggaggcaagattcttgcaaagcaggaggcatgatgactgataaatgaggcaacagactgatgcatgacatgaacaaacactcaattcatacaagggtctccacatgccagcacttttgagtattggattagaaactgatgaaaggtaaggtacagttactacattagttgcaaatcacctaccaaatcacaatcttttttttttctactgctgccatagcagagcagaactaacattaggaaagcctaagacctaatcagattacccgtttcagccaacaatcatgggaatagttttgacaagagcactgagttttagaggccctaagttcacaggacaatgtatatcaatgtcacaacttcactgtatcatctttagctactttctggcagagagtgctgctcttcaggggcctcttcctgttgctcttgaggctgctgccacacatacgtcaccgggtgaccttgctgtccaccgtacatcattcctgatccaggcccctgctgcgctggcacgtagtaatatggatatgtgtctgctgcgccccccacattaggcggtaggccaaccctcggaagcccaagcccttcttctttcatttcatccctgggaactatgtccaccaagaagtcatagatatcagtcctggtgatggcagctgcaatgtcattcttctgcaaggtccggcgcttgttctcctccgtgtgcatccacgacctcaatgttaactctaatatgaatacctcgcatgcctttgcgaagacaacgggggcttctgccgagatcatccggacatcctcatcagccttcattatcttctttatccttgcgagtggcaagctgtggttcttgaagtcggttgtttgctcaatctcttccatttggttagcccagaactcacggagttgctgctgttgctgttgctgcagctgctgatgaaattgctgggcttgttggtagactagctggtgctgagcactgagttgagctggattagtggggaatggtgctgatggctgtgagccaggaggaacaacagcaggagctccaggaaccatggcttgaggtggatatgcagcagcaggaggaggatatgcttgtgacccaccagtggcaacacccatcacaggctgaggctgtgaggatggttccatgtcagctcttgtccgtccaaagccaaaggccctgtcgttgtgggaaacagttgcaagtattgatcagttgatcttttgtatagattaacgagaaagatcatgataggttctaaatttgtattttgtcaaatacaatacacatgagtgagaataccttggtataagaatggaactcactgcttttcctttacaaaattgtatctgacatacaaacttgcatgcagggaaaaaaatgattgaaggaacaaaggcaacttgattgcgacttttgttgcttatagtacaattaatgagcaacttgagtgctgcggttccatgtagcttgctgttgcactttaagcacaactcatgatctcaatactttcatctctattggttcattaagcattctaaacagaaagagacttccattgaatgtggaatagaattacagatgcataactaccagtatatgtgatagaacatgtgcaagctaaacagaaagtagaaccttccattaaaatcatccctatgatttgtgatgggatggtaaattaccttttgtactcctactatccatattgtgcaagtgggtagttgcatgaacattcaagccctgccattatcggtcaaactggttacggacaagtgaatttgtgggctgctattacaaaccaacatggataagtatgcatcatacagagtttgaagcttctcatgcatgtacagcataaatcacatgtcttgatgttttccggtagaagcaggtcccaaagataacccacaaaaggtagctatgcccccatggctccagttatgacttattagtctcccagaatgatggcatttgtgtccagagggcacagatcggctagttccaagccaattgcacaggttttagctcattgactgacaaatcaatgtttggataactgagatgggagatgggaaaatacggaatgaattgtatttctagtcaaggctttttttctcccctctactgttggatatccaacactccaaggatggcctggatttggtgtagttacccagctgcagttgcagctgtcatggcagggcagttcataccatggctatgtgttcctcctaatttactcgcagcatctcatctacttacatcaaaccgaattaagtctatgacacccagatgccaaatctcataaatatttttttccatgtcaaccagaagtgtgtgtaaaagaagactacaacattcaagcaagtaggaaaaaaaatgcacacttaaatatgtaagaaatgttaaaaatgatccgctatgtcattattaactttgaacaacatatcaagaagccaagtgatccaaattgccatcttactctctgtttgacacaccatcagtactaaaataaagtgctgtcaggttaagcttaaggttggggtgcaactaccttaattggattctttgaagaatatgtcaatcttgtagttccaggaggtccacacatttgggacaaacaaggaaagttggcacgtatcatgtcacgtgacatttgaacacagaaaaaggcaaatttagatacattccaaaactcagactcattaaatgcatgggaccaatcacgtctttttttagggaaaaaaaaagagaagagagcagcgtcctaacacatacgcgatgtgggtgatcatgtaattatgatccatcactaagagaaaatatcactccaagagaaaatcatcatatcacttcatgaaaaaacaatgcaacgaatggtaggaaattaggagtgccctgttttgacagaacatctagacagcaaatcatgagatcctaacagtatgaaaacaacaccaaaataaacaaatttagatgtggcatcagaacagtactcttgcatctaggaagtttgcactcgtggcagaactacgttaagcgcgcgtcagcaatccatcatcactgaccatggtaatggtttcctacgagttgacccactgttcttacaagaagatgcaggtgcggacctaacacggggcaaggccagggtggtcatccatccacaccgtgcttcttgctagtcacgcaggcgaggaactccagctcgcactgcagatcggaaacagaggagagtacgatcgcgatggtgaaggagggcatcttggttatctcacttctttgaagctccatttcactagttagtaagctccattcccaaatcaaagagaacatcaaacctaattctcctctacagcagctccttccaaggctccggcgcggcgccaccacaccagcaactacaaaccctccgcctctccggcgagctcatgaactccggcaaacaagctagggttagaattctgggcagtggcaaggcggccatgacacgggaccaactcaacactcatgaacacaaatttaccaagacgagaccgcacgtctctccacacatatagcaaactaaaaatccaaactagaactaagcaggatcaagcaatcgaaacgaagccgacgactaatcgaaacctaaccatatgctgccaggatcagctccacagccctagaaacagaggcgatgattcctccctcagctacgagccgagagagaattcccccccccccaagctagcaacacccaacccacgcatgcagccaacaatccaaacgggatcacccacggaattgggaacagagagatcgaggaaaggtggcgggaggcggggcttaccgagagacgacgcccggatctcccgcgccggcgggagcgggagcggcggcggcggagagcgctccctccggcgaagggccgcgccgcccacctccctctcgtggagccctcggcgtcggcggcggagagagagagagagagggagacgcggtcgcccttgggtcagaaggacgcgaggaggaggaggagaagagtcagcgcgaggaagacgaggagagaggcagcggcggccgcgggcgggggtggtgggctcggtgggccggaggtttctctatgtgggctccaggcctggtaaaattccgcgttgtttctgttggagaaaaaagtctaatttgcctcccttcgttatagcccatttcgcaccgtaaaaatttctaacgcgcaaccaactctaaactcacctcacgctctacacaatcacatccattcacaaagcctctgatgggttatcttatcagccgtagctcaattttgaaatttctaatttgattctacattttttttatcttagcctatttttaatattagattttaaatcaagaataacacaaatataaattttatatctgtaatttattttgttggctttgttcatttttctatgccttatcagctataagtcaaaacgatcaaaacaaaacaaaagctggagacttcgcaaaggatataatgaatctcgatgctaatgtgaataaataggatatggatttttttaaaaaaaaaacattatggacacaagtgctcatgtacaattgcgcgcagagagattactgtatttctagtattataaaaaattaaaaagtactgatatacgtacaatccgattatacaactcatatatagctagaaacttgcaaccatagttcaatctttaacacatttccccgcaaaaaaaacacacacacacattcatatgcactacaatcagcatgcatgcacgggcatctcatctgagaagattgggaagatacgcaaaacgaggtaagtcattagcgcatgattaattgagtattaactattttaaaactcaaaaatggattaatatgatttttttaaacagatttcctatagaatttttttttaaaaaaaaacaccgcttagtagtttgggaagcgtgcgctcaatgtatctggaacgaacgcagccttcctcctctacccccgtaatttttgcagtggtggacagaaccagcagttacaattgtttgattttgagtggctaaggccttgtttagttcgtgaaaagaaaatttttaggtgtcacatcatatgtttgaccggatatcggaaggggttttcggacacgaataaaaaaattaaattcataactcgcctagaaaccgcgagacgaatcttttgaacctagttaaaccgtcattagcatatgtgggttactgtagtacttatggctaatcattgactaattatcctcaaaagatccgtctcgtgatttccatacaaaatgtgtaattagtttttgtttttatctatatatgactttttgagaaaaaaaattaggaactaaaccaagcctaaatatgtgaaccctatagcctgtgagttgtgagcctatcagggtttcccaaaacgccggggccagagttaccgcgctccggcggtaagcacggttaccgtgcggttaccgcggtaaccgtggaaaaccataaaaaaccgtgcaaaatttatcaaaaattcaaattattttttaaatttatttaaatttaaggaggttaccgcggtatttatattaccataccccgcggtaaacccgataactacggtaaccaccggtaacaagggaaaccctagagcctatacgttactaacccacgtaaaaaaaaaagatagtacgtccgatgagcttcttccgtggtgacccactgaacctggtgcgtcaaccgctagctagctgagctctcactcaactggagagaaaatggtgatttcagggtgaagcaataattgaaattaaatttgaaaatatactttttattttttttcttagaaataccctatatgcaaattttgacacaaatatactgatggtttctctgaaccgttgtgcgaaagtgacgatgtgaacggtctcgcgcaacaagtctgcgagagtatttcaaaaattaaatgattaattaattataatcagttattaattatcttaattagtctcgcacggtctcactcattctccacgtgacaccataatatcgacatcataatatcaatggtatatttgtgccaataaaattacatctagtatatttctgagaaataaaaaataaatggtatatttttttaaatttaattcacaataattgtgttgctccactattcccttcgtccgaaaatattaaaactagaatcgaataggatattttctaatatgatgtatctagatatatgacatgtttgattggagggagtttttataatggattggaagtttaaagtgatgaggttattaactgttttgtttggttgggatacatagtaattttggtgggatggccggatgtggatggggaattgaggaaggaactacctcattttcaatacctgggtaggggtggtaattgggagataattccttatttattttgcctaaataaatcttaaccatctgtttttattaatgacccgatctctaaccaaacttcttatcgactttcaccacctctaccaaataagatattgggattaaaaattaaattttcatcttaatctcatcatcaatggatcatgtaaactcctaattctcttccctcgtgttgccaaacaagtcgatagagtttggtttcagaaacgttgtaataaacgtcacattcattcaatcctatgtgagcatacatctttgtccaccaaagctaggtaggcagttagcccatcacttatcgtgtctagtattcccttcgcatccatccacgattcatctatcgtcaccatccagctgatccagcgaacgcacgtatatattccccttctccatgccatacgcaatcttgatcaacatgttgatcaactaatcacttcaattacactctcagatagctgcttgggttccccaagatcggtgcacgatcgcaattaattaatcttaatcacatctgtacagtacacatccatccgacaaatgaacggatcttcgcttgcaggagatagatagatcgatcgatgtcgtgctattatttctcttccaatattcacaatttcatccttcccttcgatctcatctcatttgcagccatggctgggagatgcatggcgatcgagaagaaacaaaagaagaagctcaaaatcataagaaaaagcgaaaagaaaaatctaatgggtggccgtggctggagcagtgcggccggcggcgaggctgctcgggtgggcgcgagcggcggcggcggcggctgccgggacgacgaaccgggaggagaaggagtactgtagagagctgcgcggcgtcggagtcgtcgtccagcccgccggcgacgtagactccgccgcggtcgaagttgcgcgcgtagctgagcgggtcgtactggcaccggccaccgcggagccggctcgacgccggcgccggacgctccgcgcacagcgccgcctgacgccggaggcgccgcaccagcctgcccagaccgcagccgcaccgccgcgccaccaccgccgccgccgccaccgacgacggcggctggccgccgacgccacctcgcccatccgccattgccggcttgccgctgagcggtggcagagtggagtagtgagagagtgagagtgtgtgctggctggctttcttggtaggtgaggtgaggtgaggtgagatgtgtttatttataggtccaaggttaagtcaaataaaatgtgtgtctgtgagactgtgaccatattaaaaccatacaaaattacaaatcatgatttcaaagatgtccaaagatactggtgtcctagtactccactagtttgaacaagtgccaaatttggttctatttgtaagggctgtttagttcgcgaaaagaaaattttagggtgccacattggacgtttgaccgaatgttaaaaggggtttttggacacgaataaaaaaactaatttcataactcacctggaaaccgcgagacgaattttttgaccctaattaatccgtcattagcgcatgtggattactgtaacacttatggctaatcatggactaattagactcaaaagattcgtctcgcgatttccgtcctaactgtgtaattagctttttaaaaaaattctatatttaatgtttcatatatgtgtctaaagattcgatgtgatgtttttggaaaaaactttttgggaactaaacaggccctaaattgaaacaaattcagcacacaaactatgtgggtttatgcctggactggggcactaggtagcagtaactcggagtaatggtaagcaggtcatcgtccgtagtacgttgctaaacgctggaaactccatgcagattggtttcttggttccagaaaagtcgaaaacggtgggcagcgtgtggtccaacagcaataccatggattagtgccgctcatgcttcggagaaaaatgagtaactgacacgtggacccatgatggatggtgagcctcagcagtcaggaccttctccttccgttttttttttttaaaaaaaactctaacgataagatacatgacgttgagtttcactagttaggaatttactgtgtccacgcacaagcggcgcatgcagccacggcggacgccacagtcgtcatgggccgctgcttgtcgcgccgcgccaccgatgcgatgagatccccccatcacgcaccgccgtggcagcctcaccgtgcccacccacgcatctgatcccatctcgcaaaccgtttttgtttttttgtttttccccttttttgagagagaaataaaactgcgtaaagtttttcaagaaatttccaggcagacaacggtttcatcctctgctactgcgacgtcacctttgaaagaacaaattcttctccaacaaaaatcgacccaaatttgcagcagtggccatgcatacacatccacgggaggacagacagtgtgcatgtgaatatgctgtgatctaatgggcaggcaatgggaggacccacgttgcacacattcttccctaaccaagatgccctgtctctctggattatagtagtactaatcacactcccctgaattctgcgaatggattggactgatgagctgagcttgttgatgagaagacattgcttaaagcgaacggctccatgattcctaaccagtgtagttgtagtactagaaaagttggaaaaagttcatgcactttagggtttaatccatccatcctggaaggcaactgccgacaaggttgccctggagcccatcatctccagtagtacgccgatgagcaatcgatctgatgatccccatttgctttggatcctcagcagctggtggttcatgctacagttctgcttgcttgtcaagatcgagctcacatgctcgcactgtttggtttggtgattgtcactgatttgaactggtacaaagttaatggttaacttaactcaggcagtgagatgagatacaactggggaaagtgtctactagttgcaggtattctaaataagaatcacatgagatcagcaagtttggaagaaatttttttttatggtaaactggcaggaataatcatcagatggagtcaaacatcgcaatttggcatgggatcaacagatttgtcggctacgattcaagctgccaccatttcttgctgcgtgatatataaatgactgtgaattcagtactgggggctctgcaatcctaacacgataacatggcactgttcagaactgcaacgtaacagtgatttttgggtcctgtttcaaaatctaagctgaaatcgcctatagctgacaaatctactccaaaaacatgtattggaccatgcctttctttagtaccaaattccagggctcatcataggaatgatataaaaaataaaaaaggggaccctaatttcatttgagatgtataatgagccataagcaatatgcctgaaaattttacattctctagtctgtaatgaagaactaacaatcctccatgaaacatttttcctaaaacagtagtcttatgtaattgaacctttttcctttttaattttgtttgagtcaattccttttgggtatctatatatcaaaagtgatttttataacataccggtatgcagaaaaaaaaaggccgttaatatatttagtacagaaaagcaaaatatatggacagaagaagaggagggcatagctctgtgagcacccagtggggatcaaccacagttgaaaactggaacacgagcagggtatcaaatgaccaaatatgtacaaatggaatccaagcaagcccgttgctagttagcgttgaatcctttgagtgggagcctgaaattttgcagaacagacgccattaatagttcactaatcatggatatacctccgccgtttcacaatgtaagactttctagcattgcccatatccatatagatgttaaggaatctagatatatatgtgtctctaaattcattaacacatatatgaatatggacaatgctagaaagtcttacattgtgaaacggagggagtagcatttttcttttgatattaatttatatagagtactgatgatacttttcaaatttaatgtgcagaaacaagagttagataaatacaaacaaacgagaaaccaccactgaatgttggtatagaacttatgagtaatgactgcaactggtgcccccagctcaactattccaagttgactcaaattaaagaaggcttagcttactacttgcgatcagaattatctggaaattaaaggtgcttttcttttgagaacccacaggaaatctgtgtgactgcgccatagtacttggaagaagagaaaaactgtggcagacaaacccagaccagcaaagaagaaaaaaattggggcatccaaaacaaaatcacatctacccttatgcttaactgcaagtgattaccttaaaatatataatactagatggactgccatatcatctcatatcaataaatgcatttttgcaataatacaatccaactgcattctctgacataaaatgaggagagtttatgcatcaatgtcaaaactcacatccaagtgactattaaagattccaaggtactccctccatcccaaaatataaggaattttgggtggatgggatgtattctagtactatgaatctgaacatacttcatatccagatttgtagtactaggatacgtcacatccaaccaaaatcccttatatttagggacacagagagtatggaataggtcaatctgtcggctagaattgcctatctgatgtgctactgctcaagtagtaacttatcccttatctataagaataaaaatcagcatgcactagtctgcacaaactgttaaaataaatattatgccaactagggagggactagctagacacactacacaaaaccatacattgtgggatgaagggtctcgtaagacaaccatatcagtaaaataacattttcatactatgcagtccttgctatgctcagacgtatttgaattgaatgagataatacaatgagaaacatgcacatcttgtaaatttgaggtagcaaaataggatgaaaattgtacttaggatcaaataaataccttcaccaaacaaagacataagggcacatcaggacaacttttacaaaatacaacagcttgcttgtccctgaaaaggtacaatcactcagttattttagtatagctatttcataagacatatagttacaaaaattagagtagttttaaagctaaactttaaaaacatgtcaaaattgcatttttgagtaagtttgaatatttgatgtcaatgctactaaaaatgttgatgagagctactcacacacttatgctctcattttttgattggtcagtaaggcccaccttataaacaaaaataccattttaagttaacagcaaggagaagcatacttctttggatcttggtatagtcttaaggcctccaggaatttgttccaaaatgggccagtctcctgaaggctaacgttttctggtcccccaaggtatgcctgaacaatgaactcgtgacttctttctctgaaagagagaagatagaatgtgtcagttttttttttcatttcgctagtacatttattcactatgctgaaaacatgttagcatttaatctcactaaccttccttcatattgtgacaaccatcccaagtaagctgcgccaaagtacattgatgtaaaaggattgtatagatcatctacggagctgacagtatacgccctatggccacaatctctgcaggaaaaagctaactgcaagtgaagataacttcatgaaaactataatattataaccgaccgagagtaactgcagtgtgtcttctgatagcctaagcagctaacttctcctatgcctatttgttttccagattaatcttctctagaatatgattgcctgacatctgaagtaacataaactagacaagtagtagaccaaaataaattatcatagtttaaatcaccatatgaatatgtatgaaggtatagtccaaacaatagttcagccatcctgaacagtgcattactctgtaagcattcataactagtaaaagggcaaaaggaactggtaaggtcctactaggattaagcaaatagctcaccaaaactgttagacaaaaagcaaagctttatagataattaaaacacaactgtaaacttaatttcatgcttgcctgtaaagccatgctgcagtagggtagtctattcccatcaagccagtacgagaacgaacaccatggacaaaacgcatactgcacacctcagcaagagcagctagggcttcctggcagatatgaatgagaatagagaatttactaaatatctcaagctttcttggaatgctaaaataagagtaaatactgttattgtaacatgcacccaaataggccaacaccatctttattcaccattttgaccaggacatatatactaacacaatctatggacatttgcataattttagaatatccacaaaatagagaaaatgctttgttgacaaaatatacaacaaatccattaactaatgcaatgatgttacatgaatcgacaaccaaaataagatgagttttatgtaaaaaaagaacaagatgagtatcagcactgatgtgatggataatcatgctaaagtactaaatgtatgacttagaaaagcaataccatgcaacaaagcaaataggttaagagccaaaagaatttcttcagtttgcctaaatgttggcctcatcacatatttaaaataagggagggccatgttataggtgatacagaaagcgatataaaacaacaaatttaatacataattagtatcattatacagatactatatgttcactgatttataaacaaaaaaacttactggtgttactccttttgagctcaaatgacgtgatatggttatttcagcaacagcctgagaaaaaaatttacaaccacgtaagtctgagatggatggaaattaagtattggtgaataaaataacaaatacatgaaacctgcaagacattttactggtgagcagatataggattattgtatcaaacaaggcatgagtctgggattgttccaaaaagaaggaatagctatggcaccaagtataagtaatgcttctgtgaacaatatttgtccatgtaatttgtatggcatgataggaaatgtatagcactgcagccacacctacaaactacaaagttgattttattacatgccatccacacgagcagttcacttgatcaaatcaaggatgcaattttaacagcacaagaatattaataagattatagtggtagctttacacaaaaacatatgtatgtcaacattttagcatggtaaaaaaaggtggcccgtatactgcaaatgcaaagtaactacaaaaaatttaaagaatcatcttttaccttcacctcaactcgagaaagataaggcctcctcttggagtcatgagaaaacctcacatttcctcgcctctcaccagattttgtccactccttaatcacatcgggctgactccacatcgcatccatatctacctctgataccttggaatcccaataaatcaactgtccttctgactcaaatgtgataacaagatgtcagcttgaatgttagaagcatatcaattctctgggaatcataaaacgaagggaaaacaacttcacatctaaatcataacctagtatttgctaacatctcgacaaaccacaaaccttgaatagcagaaaattatttaaataaataaaaaggtaacacagtaaaatttaacctgtgctcgaggaattggctaggagattaggagttaaatcattaaaactttctggctgtctgcagacaaaatagcaagaagcagtttgtcagcaagttcagaactggaactaaagtaaaataaaataatagctcctctacaaacataacttttggatttcgatccattgaatatgtttctaaccctaacggaaaactcagaagagcttgaaattctgaatatatttgagaggccgagcaaatgatgcaaccatcaagaaacactcatgtttgaattaagaaatatcagtgttttaattaacttggtatttcgacaggtcaggtgagcatgaattacagtaaagaaagtcactaaacatattgctgtccatcatgtgtttaacctgccagcatagaaggtccacatagcacagctcaggggtcaggttcaggggttcaaacttgagatgaaaactactgttctttaaattatgtgacatgtcataagtaaaattttaggttttttacctcaaatcttcaatggccagttgttttgagaagttcaaaccaattttctccaacttaaaggtttgctaggcttccaaataacctcaatacctctaaaattggaccttggaggttcacaggtgctaagagaaacgaatttgtttagtgcttaaggcacacttttcacagaataagaaagttagaagctgaatatggaaataaattattaagggtgaaacctcatagacagcaaggcctccttcacataaagatagcgttgaaagatgggggaagttgatttgtgaacagccttctttttgcctcccttgtaagctctaacaacgaattcttcagttctttctctgaagtgtttttggcaagtaattatgtttggcagtagaagataaaatatgtcaaaggaaattaattgcaatggtcaagcataatctgacaatcaaaatacatacttatcgtcacatgagaatagccattttgcataagcagcaccaaagtagacattcacaaaaggccaatagagcaaattagcatcttcttcaatgtcataatacttgtaacccaattcccttgttaaaggtaaagaaaacaaatatttagtatgaaaacatagaagaaaagatagttactaaatctgggttatcaaggtttcatggtacctgccaagccattgagcaacttctattgtcacctgcattatgccagctttgatctccttagtctttcggtcataattatcgacaaagagtctccttccacttgcaatttctgcaagggcacctatcatatactgcatgagtgatgaaagtaaaaaataatgtttaatgtacttcagcagtgtctttgatacatatacaaatccaaatattgataagtcataaagcaaaagaagcaataccgggtctagctgtgacttgaaatgcttatgaacagtaattgcagccaccgcctgaagaatcaatgaatttagttttaagccaaaattgtacagataagtagataacaagtacagttttgaaaaagaaaataaagcaaaggacccttaatttgttattgtttccatagcttcgaaaatttgtttagatcagcgcagcagtaacaaagttgtcaacagtaatttagtcacttggataaatataggtaaaaactattatgttagactcttaactcacagcactgattgatttttgtcttgtttaaacttcggtgaatcaatttgctggcactagtataacctgcatttaacgccactacagcataggtacaaggaaattattgttcaaaagtaacaaccaagtataatataaactgctcaaaaaatagacacgatacgtacagaaatacagcttgcgaaaaaataaatacaatgatttacatgaactttggttttttttctttttagataatgacatgaactttggtttgattgccactaatgcaggttttagatgtcaagatacactggctacagctgatcactcaccatcatttcagtttgtgtgagatatgcctcaccatcaggatcccgtgacaggtgaaccttctgtcccggcccttccccagcatcaatccactctttacttacatgaggatcagcccacattaattgcatatcctctggatccaagcagtcatcccaatatttgaagcttatagccattttgtactaattagcaattgtatctgtcgatctacactgggagcaacaaatatgaaaattatatgcaataggataacttccttaaagcaaaaggaaatccaatgtgccaatctgcattttgttcagggttgacatagagggtgatggaattttgaacagttagaagccatcaaataattaggaatgggaacgttgccaaaacaaaaacaaaaaaagaaaagaagtgagcaaacaataagaatatgttctgattgcatcgtaatagatgcgaaaagcatccgcgcttctacaaccaactatgcattcaatttgagctcatagcaacaacatggagtaatcactgaaaagtgacagaaataattgcttcaatcacagttacaggataagtcaccccagaactgcatgctgaactcatcacccaaaaaagaagcaaacagggttcatgatcaaaccacaacacaaccaaaccaatcatcagagacgcatgaagcacatataaccggggcaattcaccccagaaacaaatcagcagaatcaactccagaggcactgtatacacaaccctctgaaatttctcaaccatgttacaccgaactattcatattacgaccgaattgacaaaaactacttccactccacaggcgcatgacaccttataaatcatgatcactgccttccaccgcaacgcacctcaaaatcacatgtatgcacaatcccacgacactaacaagtaccggaatcatgaaatcgaccatgggattggaggcagtaaacaaccgcatgcctgcatgatgaagcaacgcatacacaacccaaaaaaaaaaacgcagaatccgatagccacacaaattgaatggtcaccccaacccagcagcagcagcatcgccgcgtcacggaaccagatgcccacacaccaaaacaccatagcgtcatgcgcacgcctccgcgtccagcgagaccacccgcaacaaacaaacagcagccgcaaccgcattcgccgaaccaccacgagactagacgcgacgacgaacgccgtcgatcccatccatgaactccatgctccccatccaaaaaaaacaccaaaaatcatcgcctcgctcgctcgctcgctcgcgcgctggatcaccaaataaagcgcaaaaaaaatgaaaaaaaaaactgaggcgggatcggaacgggagctcaccggcgcgcgggattgggagacgattcggaggattggattcctctcgcgtcgacgggggatttggttttgggagggaatggcgggttggtgcgtgcgttggtggaatggggaattgaggagagagagagagggaagggaaggaggggagagagagagagagagagagagagagagaggcgcgtattgccgtttggtatacaacgagggtaggggtggcaggcgcgacagtttaaatgtcggggagcggggacacgtgtcaggtggttagggcgcaatgcagctggaatttttttcgcgagcaaattgcatactttggcttttttttttttttgcaaaatttgctgtaggacatctaaaaaacgctaatttgctataggacaccacaaaaaattggtaattagctgctggacacctgcagaattattttattatatccggagaaattggatagagaaacaatcattaaagacaagttgcccttggctcaaatgagtacaaacgtgggccccacatgtaagctcaaatgtaagccccccctctttctccccacgcagggccacgtcgaccagctggaacacgccattgcatacccacacgaggacggtgagacgccacattcttcttcgaggcgtcccggtgacactcatcgtgctactgctaccgccgcagccgacctgcctccaccgcatctctctcgtcaacagtcggttcccgccgcgtgctcactagccgccggttcctccaccatttcagcgacctccacatcagcgcgccaggggctcccctcgtcgggttcttccacaaccacaaccatggcgcctgggcgaacaaccgctccatccctatcggcatcaatgacaccggggactgccgtcggagccaccatcgcggcgccacgacgcgtaatcctgacggggtgttcgccttgggcgacgccgccgagtggcacgtcgtcggctcccgtggcgggcgcgtcctcctccttagccccacccagctccgcctcctcgtgctagagcccatgcttggtcgccgccagtacatcccggtgccaccggcgcccaagtacaggccgtcatacttcagcaacgcgcaacaccgttccaaccgaggtgcccgcactggcccgcgcctcgtcgcacgatcaccagcgctccctcgggctcgcttgaagagcagagagagaaagagagaaagaatgagatagagaagaataaggaagaaggagcagagaaggatagagaaaaaataaaaagaaaaaaattcgaagggtagaatcgtacttacacagttgtttctctctgcaatttctccggatataataaaataatctcgtgggtgtccagcagctaattaccagtttttggtggtgtcctatagcaaataagcgtttttgcagtgtctcccagctaattacacgtttttttgatgtcccatagcaaattttacaattttttttactattgttataacttaaactatgtatgtaaatggaccatgtatgtttaccaaaattctgccctacaggctacacctgttcttctacctccagttttttctcttctctagttctcttatgtttctatggagggtgaaagaaccaccgatgacagattggtagctaatcgagcatccaccggccaccattgccatgcgcttgagatgaaacttgaatctccccagcctatgttttcacttgagctaaaaaaataaaagaaacaaacaaaaaaaaccaattgctaggatagagggggacatgtggagctcgagctcaagcgatgcgtcaatgttggcaaaggttgagatggagcatggcgctgatcagtcgaactagagctcaagtgcaacatgaaagctagtaggactcaaggtggagcacatcaccgatggaggcaaaagatcaactgcggtgatggtgcctacggagctcaaggtggagtgcatcaactaagatgcttgtgctcaaggttgagcacggggcagaggtctaggttgagcgtggcaagcacactatctactagactctagctaaagacaacatcgacacttgtggcaaggttgaggtttcccgcacgcactacactagctagcctcagaactcgaggtcatcattgacggtgccactgatgatatgaagaggatagagcagagggagggagccgttggtcaaaggaaagaggagggggatccagattccaggacagagccatataaggcaagagtctcacgtatggttctcttgagaagagcgtaataccaccaccgatgagagaggggagggagggagctggagaaaaaaacaagtccaaattgaaacaatttgtcaaaataggtggtccaaactagaaaggtttggttacccttgatccaacacgtaagtgtggtaaaaaaattcatatcaatccaataggcaatttactgttatttctcatacatatgagcatgcatatccacaattaatccttctattcacatgtttaaaagaagacgaccaatgataaatatgtgatttttttactgtatttatattttgtataggaagatcatacatatgttcaaaagaaaatcataatgttgtgaccttactaaattactattttatatttaatacatgggtggtagggtttgataatggataccagttccgctctcatgtggctttgtttattgccatttcagatacgtaatttcgaaactctgcaatttcacagcattattgtaatatatctaatacaaaatatactagctcctatgagataagaattttgataaacttcatggattctttgcaaggtacaaacaattttgtttcatttcagtccaactttatctgtgcgtttttcacattggaattcttctccccatgtttcaaaatagaagagctgtgctattgtcttctgacctagcaccacatatgcaaaatatgaaaccatgcaaggatgcattcactattcgatgataaacaactcaggttgtgatattacttacactgtactatgaagatagcatttgtatggcgtggtacgttaaaaaatcggagggagtaaaattgttttctctcgtggcagagtaaatttgaattttgcaccgctcaaacatcaaaagcatggtcctgttcggaccagaatggtacggctctgatgctctggcacaaatcatgttcttctcgtgtaatccctccgtcctggggatttttgatattttacttttactgtttgactacccatcttattaaaaaaaattatgcaaatataaaaaccaaaaaagttaggctcaaagtactttggataataaagtaaataaaaaaataaataataattccaaaatttttattatcaaccaacaaatcagccagccaaaaggcagcttgtcattacaacttgatcgattacttataaataagctgtatcatactattatgtgatgaaaaaaaatgattaattaaggatcctttcgttcaaatggatccacaggggtttattcgccagaaaaacatcgaggtgagattaattcaaaaggtggttcacggcaaaaaactgtgaaacatgtaaaacttcaccaaaaaaaaaaagattctccataatgagttgataagatcttacattgcttgtccttttcaattagacatgttgacatggcagtaggaaaaaaaacatttacatttattttgaacagtgtatggtttgtcattcatttgggaagcacccgtttggccagttcttttcttttcctctccttttcatttcggtccttttctgctttggttggttcgcctcttatatccttttttttctttaattaatttcttaaagattataaaagctcaaatctatggtagaaaacagaatgcccgaactttaaacaaacaccaaatacactcattcgtcaacgatgtaatggccatcatagacgaattagcatttagcaaccagactattgacaatcccttcttctccttctccaccttcccattagccaacaaaaaattttaaacaaagtgaatgaaaacgagaatctttcttccatttctcaatttaaaaacaaaaacaataatttaatgacaggagaggtgaggttgggggtccacaaccccagagagtcgggagggcgagagatccgattcggtgcggggtaggcgacccacctacccattctagtaccctctctccctcccattttaaacgtagctataaattttcgtgtttaattttaatcgttcattttattttataactaataattttatatagttattagatgataaaatatgaatattactttaagtgtgactcataattctattaaataattttttaaatataacagacaattaaaattagacacgaaaactcatagctgcgttttttaaatggacagagggagtattctacagtacaacattttccttttataaaaaggagacgagacgagtcgctcgcctcgccgccaccttccccttccccccctccgccgcctcctccgccgcgaaacgaaaggcgagctctctctctctctctctccgcggcgcggtcaaaaccctagcgcgcgaggaggccccccccatggcgcagcagctctccgcccccttccgcgccgccgcggccgccggatcccgcgcctccgccgccgccgccgatcccgccaaggtatcgccctcccttccattcctcctgtgctccctctccctcaccttcttccccaccccccctccggaattttccggtttgttccgcgtcggggttcgattggcagagggttgggacgtcttcgttcgttgtgtgactagttgtgttgctgatactgcgcctagatttcgtcttaagcttggtttccgtgaatctgggaaccttgggttggggggggggggggcaaatgctggggttcgtttcttgtttatgtgcgttctccctggttgcttcgtactataatctgttcatttctgtgctggagtatggaggttacttttatacatactagtggagaatcatgtacccaggcgctttattgttatcagcaaaaagttctgtactgttatcaacatagttgattcttggtcaaagaaatcctattcacactcttcaattaagatgttaatactattcactctcttcaattatgtgttgctcatagttagtttgttggatttttagttttttagtagtagaaagatgtccctcctgttgatgcgatttgcctgctatggaacaggtgttacgcttgagaagcgctggctcagctcagttcacctccatcgcagcttcctcttcattgtaactgcctgcttctaatgcctatttcttcctcttcgttgtaagagcgcttttttgatctgattatgttttaacgcatctaaataatttttttaactcaagtgctaggaacattgagccgctgagagcgatagctactcaggcaccccctgccgtcccacgtaagtgtctggtttcccaaacaaatgtgtaataatagaattgtgcaggcagcagcatttgattattcctttttgtttctgtctgtagaatattcgagtggcgagaagacaaaggttggcatcaatggtgagttgcttctgtttattctaggaactagtccattaattttaatgggatatattaatctgtttattctaggaacctagtccattaaaaaaattgctataattttaatgggatatattaatctgtgctggccaatgcattttgtcttgcatgcgttttttcttttctttttttgcaaatatatgatatcaattgcaactgaatgtgttagttcgagttccatgtctttaggttttccaaaagcaatttttagtgctcagttaggtatatgctacagcaactgaatcacccatggcttgttggcagaagtagtttacagtttattgtaccatacatcaaaagtaggcgaaataatttattgctatttgtttgtaatgcttgtcttatttttttggtatcatagggtttgggcgaattgggaggttggtcctgcgtattgcaaccagtagagatgatattgaagttgttgctgtcaatgatcctttcattgatgctaaatacatggtaagaaaatagttcaaattatttgcctacctcccatatttcataccttggttgcttcatttaatcaatgaacattatattttcaattttggggggatgaagttttgcttgcatttgctacactgcattagcttatatgatgccatgttacgttcttttaggtttgtaagtgttataaaccttgacgaaaagattggccttttctcagcttaagctaaattaagattgatgcagataatattttatttgaaatcattgaaaaacctacttaatgtgcattcaccttaagttacttaaatatgctatgcagtccattgtgctacatttcaatttgctagttatatattggcacagtttcttggttcttccatataatcacacgaaactgcatccctaccttatgtgttcggttcaatgaccataatagtccatttcaatgttttactcctaatgcaacataattcctgtcactgtgggagtaccaacccatccttccatgcggatgcaacatttggttgtgccttttctttctgtagataatctctttcttttttccaggcctacatgttcaagtatgactccactcatggtccatttaaaggctccattaaggttgtggatgattcaaccctggagatcaatggaaagaaagtcacaatcactagcaaaaggtaatatcaagtccacttagggactagtacatgattacatagaatgtcacaattatttgttatctaagtattgtgtttgatgattattagtaaaaaaaaaccctcttgaaacattgctagtaaatttggatctcacaattattgaggtattgcatcactgtgttcccatgccatcatggattcaacctaaaattctttggatcactggaaaaataattattgtagcctaacgtataatctggtcttttgtcgtatcactgcttacttgtatagtcgaatatattacaatgtgcagccttgtgaaataaagaaaagtaaagtgtctttacgactctaaccatatctggagtatggagtgattgactgaacatgctatacggatttataattgagtaccttttagtcctagctcctaaagtaactcagtattgttgtgtacgttgtacatttggggtacttcacaatcctttcttcaccgtgcccctgctctcgatacacaattatgtttctgtgactacattaatttctgttagttcttgcatttgcacctaagaatttgcccccttcttttccagagatccagcagatattccttggggtaactttggagctgagtatgttgttgaatcttcaggtgtttttacaacaactgaaaaggcatcggcacatttgaaggtttgtacaccatttctatacattgccatctaactgagaaatggcaagcttttatattggataaaatggtgatgtttttatgccttgtttgtagggcggtgctaagaaagttgtgatatctgctccatcagcagatgctccaatgtttgtcgttggagtaaatgagaagagctatgatcctaaaatgaatgttgtttctaacgcaagttgtactaccaactgtcttgctcctcttgccaaggtaacttatctatttctaatcctgttactattttcccattttaatcataacaaacaatttgctcttgtgatttttcatattttcgtccatccaatggagctaattgatattccatggggtatgcaggttgtccatgaggaatttggcattgttgaaggtctcatgacaactgttcatgccacaacaggtttctttcccttatgaattttgtcattgtcaaggatggcgactgccatttttcagtctcctcatatcatgttgttcattaatcataacagacttgcttttctatattcagccacccagaagactgtcgatggcccttcaatgaaaagatagagaggagggcgtggtgctgctcaaaacataattcctagttccactggtgcagccaaggtacgatgaaccaaaaatctaccttgcttttctagatttctgttttggctgactgttttgattccttattaggctgttgggaaagtcctccctgagctaaatggaaagctcactggtatggccttccgagttccaacaccaaatgtgtctgttgtcgacttgacctgccggattgaaaaaagtgcatcctatgacgatgtgaaagcagccatcaagtatgtaggactatcatttgtccatgcacattatctgctgtttctgtttggtcaattgttttaagtcttaaaatgcttgagttggtatacagtagccttcaataatttgaacgtgaacagaataatacttgtgttcacaaatgaattgcaaaagtaacatatcccttgttacgtcttttgactgtgctagaaactgcggtcatgcacttgtaccgtctgaagattctgtgatgtgcctgtatgtaacattgtgaatcttttatcagatttactcataagctgtgtgtttcagggcagcatcagagggtgcactgaaaggtattctaggttacacagatgaggatgtggtttccaatgacttcgttggtgatgcaaggtaagtacttctagatgtaccgatgtaaattgtgttgtgctcaaaagggagtggttgacataactgcccctttctgcatatcaggtcaagcatctttgatgccaaggctggtattggactgagctcttccttcatgaagcttgtgtcatggtatgacaacgagtggggctacaggtgagtgtctatatttccattaaggggcttaactcttcatctttttttccaattgttctattgtcctaatgattctgttccattctttgtttcagcaaccgtgtgttggatctgattgcccacatggctcttgtcaacgccaagcactgatttgttgaaaatcctcctccgatagtatctagctaggaaaggctgcaattttgacggtctctttctgttgtcttggaataagatgtaaacttggaaacaaagcaaaaaaagaatggacattgatgtccatgacattgtttgtagcaggcggtgaaatttactctgtatcgacctgggcaagcggaactgttgagtgaaccatatgtcggcaacctgattgattcattgagtccaatgctatgccattctatatttactttaaacatgcttgtttcatgccagaaatgttcaacagacaattggcaatttacctcaactccagaatctgcagaattttgtttcaattcagcggcttgttgagagtaacagcagagaattatgtaggctgttaccaagagggaaagtttccggctattcaccttcaataaaatcagcagcagcagcgatcgaggagaagccgaaggtgtgccagagaagccgtgccagaggagccgtacgtgttggtggccataagtcggaagcaaggctatacaattgcatagttccagtagcttcataattactgcttttcattgaccatggttcccattcgttattctctctatccatcccagttttatatcatatttgtaaatggagccgagactaaagcaacaaaatctccttccttcttaaaattaaatctcatcggtcaaggtacgcaaacgtgcagacatgtaacgatatcatttactcctatacacgtaaatgaataagcatgcagcgatgtcatttactcatatacaaataaacgattagatgatgattaaaaagaccttaaaaattttagacaatgatcaaattggaatggagga

SEQ ID NO: 44211 - DNA, 5453 bp, Oryza sativa
aatcgatatatttttgcgatttccattacaatcgtattatttttttaaaaaaattcgctcatgctattgacacctcgtataatcgtatacatgagacttgagagtactaaacaagcaaattcacctcaatgctatctaaaaaaaatgaaaatagttagcaacgttacattttgtggcccacttcattgtaaagatgagcccgacccctctatatttggctcaaccgttaatctatcatcaatcattaaattttctctttaatgccaatttaaacgattctattattgactatactatccatgcatgttaaacgcctatttattttctctctaatgccaatttaaacgattctattattggctatactatccatgcatgttcaacgcatccttttttttcctagttaattgtatcgtcctatggttaatggatagcaaaccataaattctttccaatgttacacattttatccatatacccattttcaaaaaagaattcacctttcttgtcctataaataggcatgatatcctacccttgtgcttagaaaaaaaaaactacccaccctttgggttctgcacctaatagcaactggtatctaaggtttcgtgtttcgccatggcttgcaaggttgcctccatatttgcatccatcctaatattgtcggtcctcgtcatgtcttgcggtaatatcatagtatacgtacactctttttgcgtattttatgaagcattgggggctagtaattaactaatttctcacatatatatacttctcacaaacaaaaacttctcttaattttggcttgaacagatgcagctggtttatcctgcccaactgtaagagcgccgaatccgacctgcctgagccctcaaatttgtgctaatcagtgtgtagcagctggttatttgattggattctgtgagttttatggtagtcgattgggtgactgcgtgtgcaccaaatgcacaaatgctgtgcaagccggccgtcctcctactattgctcctactcctgcagtgagaaggttgattctgtgagaaaaatacatggcatcatcaatttgtgatggatacaccatgggaataaattaacttgtgtgttgacgattgctgaatttgttgaatcgagttgttttcttgaccaagtgttgaatcgagttgttgagaattaagaaaataccaactatatatatggtgaaattctaccttatttggtgaaattctaccttattgtgtccggcgaaattctaccttgttatagaggaaaaacctgagtatttttcgccccttaggccttgttcggttaatccctgtgagggagggattggagaggatttattccacacctactgcggtgtggaattattccccctcaatcccctccaatccaatcctcttcaatcccctttaaactgaacaatgtcttagtaggggtgttctatgttttaccacccgtacatgatatgtgggtcatgatcaacctatagtggcaatgactaagtttcaactaccagtgaaccgcaaatcctagagttcgactaatagtgggcgtgttcggctggcagtgttgtggctacaaccgtgtatcgaacgcaccctgtaaagcaggaaatttctaaaaagaaaatactgtgcatattatgtttgtttatgattttagtacgatccatcgctgcgctgcccatgtggaaagaggaatccaattttgcgttgaaccgaaacttgcagccgttaataaacgttaggagagaaacatttgatcatacaaccatcataaacagaaatcacgtataatcggtgctcaatcctcaaatcccccgtacaactgatgtttttcctcttgtgtatttacgattttacatcaaggtgatgctgaagttagcactggaaaatttggataagttgatatctgatttttttcccctggagaaatctgtattctgatgaggattgcataatgggcagtcagtgcagtaaaaaggggaaaactttactgtccaacatgattcagctgcccaatttcttaagaaaaatgggatatacaagtgtaattggcttgatcatttttttttaaaaaagcgatttcttcactacaagaataggcagggcacacatatataggttctcatcttgcaaaaaataaataaacaaataaatttcgactactacctattacgtcttgagctcttgaaggactttttaagtcctgaacttttttttaatacgtaaggagcgcatttttttatcaagaaggaataaatgtacggaaatgctgcgtgctgggcgtccaacggcagaagaaaaaatcgggcgcccacgcctcccaccgttgctactttaaatagttttaaaatgatttttctcctaaactaattatccaatttacgatccgatcacgccgttgtattcgttgcaattaaatctttacaacaagactacacatgattatatttcgataaaaaaatattttagcttttttattgatatgttttgaatgttacatatgatctttttgatgtttcgaccagtagttttacggtgtttcagttagtgtactcgcgatgtttcactatgtacagatcaaatgttgcatcaaatgttgcagtggattttgatattatggaacgcgccgttgcaacaaatcacgcgcatattatggaaaccctctattaagggaatttggtttattttttattctacacaaaatgtttcatctagtgcactcacaatgtttcactatgtatagatctaatgttgcagtgaattgaaatattccattgcaacaaatcacccacatattttggaaaccctctattaatggaattcgttttattttttgttccacacaaaatgtttcacctagtgtactcacaatgtttcactatgtatagatctaatgttgcagtgaactgaaatattttttcactatttgttgaaacattgtttttatataaggtgaaacaacacctgatttaaacgagtgagacattttcgatctacttagtgaaacaattccgatatacctgtggaaaatcgtgcaacatttaaaaataattcgataataagataattttttttcgtcggaatatatccatgtgtggtcttgttttgaagatttaattgcaacagatttaatggtgcaatcggatcatgatttggataagtaatttaagagaaaaatcagtttagagtaattttgcacgtaaatgttttggataatcatgttattctcgattttaacctccttctatcggccgcccgagccggagtggcgtccataaatgtatgtacaaagcgggccaaaaagacaaagcaaaagggacgaggtacaagaggagaaccaagaaccaaaagcctaatctccaactaaattttgcgacccttctccactaacatgagctgccaaaacagggattgcagctctagctagctgccacagctccgtttcacccgccataacccttgcaacctccgctcaagttctgctcttctggctgaagactcgattgtttctttcttttcagatcgtccatgcaaccaacgtcgtgatggtgtcaaaacctcggcgatcgtccatacaaccaacgccacaatggtgtcaaaaccccggcgatattcctttaccatcttcttgcgacagagtcctgaacttcctaacctcgttctcgaagaaacgtgccttgtgttccttccacgccgttgaaaagctctggtgctatttttttttcttacttagattttttgtagataacttttgttaattagataccaaggagcagctgaacctgaacgaaagcaatttctgcttcagaggacctcgatgaagtaaaatggaacaaagtcacacatagcctaatcagggaatgcatgccaagtctcaaataagctggatcatcctgcagttagcaagacactaagatattaacacaatcctaaatgccattattagttagctgtgtggatatagagatcatatttctattcattattaaaaaaaataccattattagacacagggttaatacttaccccttatccacttatacatcttgatcaagatttttatcaaatcatcaatgccatccatttccaatcagtggctgatttcttacaaatagtcacccctgcagatcaaatcctgaaagtgcatctaggaccctaatgattttgatgattgattacaatgcgattagagaggactaacacttttattcaagcaaatgtgaaggttgttatgtcctcaacatgttgtaatgagatgcataccccatgaatgcgacatcacgatgcaatgcggcaatgatcaaatggtatattgtatcttttaccttacattgtgtcgtaggaatgtcgtactattaagagggataccacatgcatattattggtagaatactagtgctcaaaatgcttcatctttgtgtgagttgaaaaacctaagtcaaaatttcaatcccgagttgtttcacttgtcacaacacttacaccgggtttctttgcaagtttttcaacatctcttgaaggttttggaccatgttttatgttgggtttgatagcccacgaaactagctttccatagagtccaagatcttcgaaatcggagttcggagtaaaaagttattgcagttttactttagcaacatcagactatccgatttgaaatcagactatccgatgtatcggactatccgatttttcacagaacttcactctctatcttgatttgaaaaaaatcctatcgagtgagtttttctaagtatcggagtatccgatgtcggatcagatagtccgatgatacagagactccgaaatttcatagaacttgagtctctgtttgaggacaaagtttttgcttctaaaatatcagatactccgatttaacatcagatagtccgatgtctcgaaaagtccgaaatttcatggaacttcgttctctatttctcgttgccttggaggtttaaaatatcggactatccgatcttgtatcggactatccgacgtgggctgaaagattcccctccaacggccacatttttggggggtctataaataccccccacctaacccttttctagggttacccaacccatttcattctcattcactttgggttgagcttggtgctaaggtgctttggatctttgagctctttctccctctctcaaatccctccttgttctttgtgtggtggatcttggtggttgtggatttggtgtttgagggcctagtgtgtgtttcactcgatcttgagcactagggtttgaccaagagttgtgtggtgtttgttactcttggaggttgagtactcctagacggctaggtgtcactcccgagccaccgatctacgtgtggttggctgagagaagtttgtgaaggccggatctcacctccgcaaggaaaaagataccccttagtggaaggaggagtgcttagtgcaacctcttgaggaaag

SEQ ID NO: 44212 - DNA, 1053 bp, Oryza sativa
tagctttgcttaattgtgccgctatagatctagtcgctgtttgtgctttactcttgtttgtgtgatagatctacttgttgtgcttcattggtggatcggacagtctgatccaacatcagactatctgatattttcggatagtctgactgtggatcagactttccgaccttatttcagttttagcttctgcataaaattttaaattagcctattcacccccctctaggcctaattgaccctttcaaatccaaccaaatccaataactccatcccctaaaaaaaatccaataactccagagatttcagctttcaggcttttagccatggcttattgcagctgcaagctcacaccagcagcaatggtggcgtccatattattcctggccctcctcctcctctcccctccctgcagtaagtacacatgccaaaacaaacagcagcaaaaactgaattttgatttggtttacattcactctagtgtgttcatagggaagcataagtggtgtggtagtgaagtcatggatgcataactccacctataaatatttatatccgcgaatattacgctgttgacagaaaatacgaggcctgggagatctgcttaactccagtgcaggtccaaagctcgccttcgaatgtatgagcttgccagttgatttgatcctataatcaacaagaaatagagacaaagaattcgtggttaaatctataaatgatagctgatcggctaggtgccgatgacatatcatttatctttgagccgatatcatatatgaatcgatcggcggttataaatagatagtaaggaactaaatctattcgatcggctgtagatattaacgatatatagttcttatattaatatatacttaaatcaagtgattgggatagatcggtcaccatgccgagatagtataaatcacttagatcgaaatatatattaataacatgattatatatgtttatagcatagccgatcagatagatctagaatgtatcgcgctaatactccgatactactttatataaagatatcatgatgaactactgtac

SEQ ID NO: 44213 - DNA, 35345 bp, Oryza sativa
gtccaccccctcgccgagtccgccgaccgccggaacgccgtcgaccccgtcaacccgagccgcgccgccgcctccctccgctccggccgcctttttcgtcgtcgccgtcgacctagggtgagccgtggaccaccgcctcttttcccccttcccttctcctctctcggccgccgctccgccatgcctatggccgccgccggcgaccataggggtgcgggcgccgcctcctgccggccgcgccgagtggccgccgcgtggggcccggccgtcagccgcccgcgccctcgggtgcggctgacgcgtgggacccacggcgccggccagtgcgagcccgggtgcgcccggtccacgtggaccgtgaggctgccgcgtgggccccactcccgtggacctggtccgcgcgcctcctcccctcggctgacgcaataaaccctttttaaattaaaatttaaatacagaaattcgcaaatattcatttaaagagcatataaacttcaaatggccataacatggccatttgaactcggaattggaccgttcaagtctctaatttttccttaagaactcaagaacccatttttgtgctttgttcctgcttattatatggagtttattagagtaaaagcccttttattttccgttggtcgtgtagacgttgcagcttcggaagatccgctcttcgtggaggttgaagctgacgtttgggaaagtgagcaaggcaagtcacatcatccttgaacatattgaatcccagtttaaaaaattattttgatttaaattattgcattatcgctttatttaaattcccgcgttatcactgttttatctagccatgcttatttacctttgttatgaccttattattgttattgttattatttccttgttcaccctagaataaacaaaaccccaactagtggacactctactcatggtaccactagtatgattttaggtagatgcttcgctggttaattaggcaatattaggtggttttacaactctagactttgggaatactcttatcacctggacactatggaatggttggattattatggaattggactcacacctccccctctattcaaaaccctcaaaatggttttaggctgggctcggggtgcattgttttgatagtagcacctcggccatataaggaccgatcttcgggcctctgttgcaaagcactaccgtacttccacatgtctagtgggtaaggcttagtttgtggctcagtctggttataaacaaaagtacacggatggagatggatgaagtcgggagtcgatggacatctctagggcaaatgaaggctacacgagctgcggcccggtagtcgagatgtcatggcacagggccggtgtcctgctgttaggggttcaatcctgcctacctgtcccgggggttccggccgtaggtggggttgggtcggtactcttgtttatggctaggatgggttggaaactatgtcatgtcttccgtccgtataccgtggtggtatgtggcacgtggttacacgtgagaaagatgtgtcttgtgggtaaagatgtacacctctgatcagagtataacctattcgaatagccgcgccctcgtttatgggcaagccgagcaatgtacccaagttagtgttttaattcttaaaacctgcctaacagctaaaatgtggaatggttggcctgggttggcttgggacgagctgggacccagggtcgggttgccagttcggtctgaatcatcgtaggccttgggttaaggcaggttcgtgtgggttcacggccttggttaataatattgtatagctctaggaccgtgtttacaaagtagctttgagcaactaagtgacttttaatgctgtttactgcaaaccctaaccccctatattatggctcccttgtactcccttgcatttattctgcacttgtgggtgtgtcttgttgagtacggtggttgtactcagtcttgctcaatttttcccaaacccagaagaggagcccctggatgatgaaggctttggtgtctagctcgtgcctgtcgtcaagcgcctgtggtcgtcgccctagtcttccgctgtttttcgtttgtcttcttgtgtgctgggccttcgccgcccatgtaataaattaattaattacgcttccacttgttaaactctgaattgtatcaatttttggtgtaccttgcctcctgggacaaggaataatgtacgcacgtaaggaacgcccgttgggttatttccggtcgtgacaacatgacagatctattccctgacgtcataccccgggtaaactttgtcatcactaaatttcataacggttagccgattcattacttgactaatcttttgttcctgttctgtagacaacagtgtcctcccctccacatcagagcaatagtggtaggaacattgaatatgccccaggtctgattcctaatggaggcggattgtccccctctatcatcggctatcatgcccccaaggtctcaaccctcctccaaggtgccatcagggaaccaaccgatgtaaccaagaaaagaaaaactagatcatcggctgtgaacaccttgactctagctccaaagaaaaaggccaagtctaagaaaaccaagccaaccgacgacctgcctgctttggatccatccattgaacaagctctggatgaagaagatattgaggatgatgttgatcaggctgcagccgaagtaagtgatactaaaaaaacaccatcggcttcgcctaagcagataccttcaactccttctgcccccactcacttcttcagagtaaaacatctttccttgcaaaccctattataatcattatttttcagccgactactcataggttttgtagttgcaaaagaagaaaactgctataaagaagaaatcagcagcaccaattctcaaaccagcttcaccagtaagacactctcaattttactagttgattttagccgattttgtctaacacttgtctttttacagcctcctcctccttgttctcctgtacaacaatcaccgagtgaccgaactccatcggccgtggggagtcatcatattgtggaagaagaacaaccggctgctcctgctatcccagtaagttttcctttgatgcaagaatttagatcgactatattgacttagctctcaaactttctgaacttatacctgtaggttctaaccgatctcttttcttttgatatcaaagattatcttgatgaggcagaagaagatacttcaagcaaagctctagttcccttatctaacgatgcaaagaaaacacttgaagatatctcgcgtcggctagaggcctcttctctggatagcttagtggtcgactgtggatcgattaggacacgattgcacgaagttcaagctctaattcctgaagaactagccgatgtcttaactccagccgcttatcttgagcaacatcaatttaaactagcaaaagccaagctaagattagccgaacaccgtgagcgcaaggagattgaagccacaatccaagtcaatcggcagcttgtgcatgaagaaaaagtcaaactcgatcagctatccgaaggtctgatcaaatccaatatcgatcggcttgaagcccgcaagattgatctctttgcacagcttgaagaatgcaatgctgaattggatatggagcacaaaaagctagccgatctcccaaaatctgtcgaagagcaaaaagcaaggctcaaatcggctatcaagaatgttgctgacctaaccaagtccctgaagatcatttctggaactgatgctcaagatgcccaagccattgaagaagtggaacaaattaggaaaagagctatttcggctatccagcagtacttgtctcaataacttttgtgtaataggacttaaaaattcttgtaatcggctaagataccttaataccctgctgttttaacaatccttcgtgccgattaacataagttctaattttcactttcatttttggtatatatgtgccccccaattttataatgtcaacagcattgataaaattagaaaaacaactaatggcgatataacaatatcggccgttatatatcggcaaaccataaccgattacaattggaaaaacgactaagggcgatataacaatatcggccatctcaagacgatgtaaaacacatcggctgtcatgcatcagcaacactagtcgatcatgcgtcaacccaaacacttgggtaatacttcttcaagtatttgccattgagcgctcatccataaacctcaccatcaagcccttgcaacatatatgcccctttagacacaaccttatagatttgaaacggtccttcccaatttggtgaccacttgccgaacttgttatcccgagttccaatcggtaaaatcaacttccatacaagttcaccttccgaaaaatccttaggcactactttcttgttatagtgcctagcaactcgttccttatctttggtaaccttagtaagggctcgtaaacgcgattgaaccaagtcctccctctcatcggccataagattataatactcatcggctgtcaaaccatcttgcaattctatccttctagagccgattctaacttcccatggcaaaacagcttcatgtccataaacaagcttataaggaggaacttgaattgatccatgacaagccatctgataagaccacaatgcttcggccaaccggttatgccattgccgaggataatcagaaatcttccgcttaattaatttgatcaagctcttgttagatgcctcagcctgcccattagcttgtgcataatatggtgaagaattcaataatttgatacccacgctatcggcaaactgaacaaactcatctgacacgaagattgaaccttgatcagttgtaatagtttgaggaataccaaatcggtaaattatatgttcttgaacaaattgaattgcatccccagaatcaactttcttcaaaggaatggcctccacctacttggtaaaataatcagtcgccaccaatataaacttatgccctttacttgatggtgggtttatcataccgatcatatcaattccccaacctctaaatggccatggtttaataataggattcatagctgacgccggcgctcgttgaattgccccaaacttctgacaatcttgacaccccttataatatctaaagcaatcctccagcattgtcggccaaaaataccctgcacgccgaagtaaccacttcatcttatgggccgattggtgagtgccacaaattcctttatgaacttcgccgattgcaactttagcctaatcggcactcaaacacttaagtaacactccatcaatcatccgataataaagctcatcatccaatagagtgtacttcaacgccttatatcttaatttcctagaagccgactgagatgtattatgtaaatattgatgcacatcatacctccaatcatcggctgttattgctgcaatttcaaccttaacatctttgatcatcggcttataccccgatgccccttgggtcagatcattagcttcaatattttgttctcgagatacatgctttaaagtaaccagccgaaattccttcatcagttcttggcacttctcattataaactattaacgtatcattcttgcattcatactcccctgccaattgactgattaccagcaaagaatcccccatgatttcaatagcatcggcttcaacttccttaagcaattgcaaccctttaagcactgcttcatactcagcttgattattagtcgcataaggtttaatagtataagcaaacttgaaacatgccccctaggggaaattataactaggccgataccacaaccatgagtacacaccgatccatcaaagaataaagtccatggcaccatttcaaccgagccgattgaatcatcacgatgttccacaataaaatcggctatagcttgtcccttaatcgccttcgatgactcataccgaagatcaaactcagttaaggaaaatatccactttccaacccttcctttcaatattggagccgataacatgtatctaacaacgtcggccttgcatataatagtacattcattggacagtaaataatgccttaacctcgtgcatgaaaaatataaacataagcataacttctccacaggagaatatctagtctctgcatccaagagccgacgactaagataaaatacaactcgttcttttccatccaactcctgaatcaagactgagccgattgacttctcaccggccgacagatacaatctaaaaggtatccctttctgtggaggaatcaaaacaggaggggaactcaggtatcctttaatattatccaaagccttttgctgctctgccccccaagtaaactgctgatcggccttcaatctcaacaatggtgtaaaaggttctaattttccggacaaattagaaataaaccttcgaacaaaattaatcttgccgatcatctcctgcaattcggtcttgttttccgggggcttaatctttttgatcgcattgatacttctctgagttatctcaattcccctctcatagacaagaaatcccaagaactggccagccgataaaccaaaagcacactttgtcggattcatcttcaagccatatttcctggtcctctcgaaaacttttcttaaatcggctatgtcgtcttttattcccttaaatttaacaaccacatcatcaatatagacctcaaccagccagccgattagattatgataaatataattcatggcccgttgatatgtagctccagcactcttcaagtcgaaagttataacaacccattcaaataagccgattgcaccaggacatctaaaagctgtcttatggatatcttcttcagccataaaaatttgattataccctgcgtttccatccataaaactcaaaattttgttccctgacgcggcatcaaccagttgatcggctactggcattggatattcatctttcggtgtagctttattcagatctctaaaatcaatgcataccctcaccttgttgttcttcttgatgacaggaactatgctagaaacccactcagcatatcggcaaggacgaataaaactagcatcatataaacgcttaatctcagctttgacaggttcaagcatatcggctttgcatctcctcggaggctgctggtgcggcctaacccctggtttgataggtagccgatgttctacaattgatcggctgagtccaggcatctcataatactcccaagcgaagcaatctctaaactcttttaagagctctatcagcttggttctaaattctggagacaaattcttactaataaatgtcggccttggctgatcgcctggacctatatctatttcttccaaatcatcggccgacataaaaccttgaccttgcttgtcatcgagatcatctaccgtatccttagtgtagacacttgaaccctccacgacgccctcaaaataatagcttgggttctccatcttcaactggctgtatatcagaatcagacacttttagaaaatctccattccaaacttttccagataaacaatcaaggccatccatctcccaaatagctaaatctgcactggtaacattaactgacctgtcggctggtacgatctctattttgtcgccttgccactgaatcaagcattgatgtatagttaaaggaatacaataattggcgtgaatccaatcccttccaagcaacaagctgtaagaacccttcccatcgatgacaaaaaacgtggtaggaatagtcttactgccgactgtcaactccacatttagaacacctttggtttccgatggattgccaccaaagcccttgagcaccatatttatcttgataagatcctcggcatttctacccaacttcctgaacgtagcataaggcatcaaattcaccgcggccccaccatcaaccatcattttagacatcggcttcccattgacatagtcatttatatacaatggtttaagatgccgattctctgtcccctcaggcttctcgaacaccgcctgttttggtgacagaaccaacttagccgattcctcttccacctcgtcgacatcggcttgatcgatcccgaattcagttggcaaggtaaaaaccatgttaactagtgccgtcacaacactctttccttttaccaacctctttgcctcatcagctgcaacatcatcggctacatgagcctgattcttaacacgccactcctgcctcggttttgctttcttcagccgatgattaatttcttgctcgacctcctggaagcgttctctactcctcaatctttgaacccttcttttctgatttttcgtaaaaataccaggaggacaccattgagtcttcttattttcgtcatcttccgaatcaccacgttggtttactgggcccaatctctgatgaacaggtactcttgtctgttttggccaatttcctccatcgtacaatcggcttgaaccccctgcaacatcactgcatctaggacaatcctcgatagatggtaacctcatacattcattccaacagaacctgaagaactcacagccccaatgaggatcaaagccaccattatcttcttcatgatgcctttcctgttgcttgtcgtatttcctttgatatttgtttataattctagctgaacttacttgataacccctcatgcgccccgtatcagttgttcgaccagctgtgtgtaccatgttaacgggaaatgggttaccatcgaccctcatcggctttttggaatcatcaaacttaatcttgcctccctcaatggccacctgaatctgttgtctaaacaccttgcaatcgttagtagaatgggacccagaattatgccatttgcaatatctctttttgcctaattcctcatccgatggaatcgtatgaccagcagggagttgaatttgcttctctcggagtagcagatcaaaaatcttgccagctttagtaatatcaaaatcatacttctcttcctttccagaactctttacccattggcacggtatgacctttttactcctcacccattcggctgcagctatctcagagtcatcttcatcgtcatccgacccatacatgtagggacaaacatgattaatcttcttagagcttttcctagcctccgcagacctatgctcatgcaaggttaccttttgtatcagatgtgacaagctatcaaagtcttcagacgagaatttctccctaatcgtgcaatcataccctgaaaggccagatcggctaactgagcgtcagttaaactcaagctgaagcatttgttcctcatctccctgaatctctgatatacttgtgcacaggttcatcatgccgctgcttaatcgccgtcaagtcagataacttcatctcatgaaccccactttagaaatagctgtggaattgcttctccaaatcggcccaactattgatcgacccatacggcaaagaagaaaaccaagtaaaagctgatccagacaaagataaccggaacaacctaaccctcagagcgtccacagccgatgcttcaccacactgagctaaaaatcggctaatgtgctcataagttgacacaccatcttgtcccaaaaatttggagaagtccggaactttgaaccgattggggagaggaactctctcaaaccactcagggtaaggctgccgatacaagcttccagtctcttttggtttaagcccaaactgttccctcattacatcagcaatcacatcggcccacggtcgttgctgagctgctccctgtgactgttgttgcatgggctcgaactgaccgtactgagacacaaactgaggttgagccagtccccctgactgatattgggcttgcggggaaggatgatgattttgataattcaagttgcccctggtaattatgaaggttcggctgaattttacgtgccaaatgctcgggaacaacttgaggcattactgtgccatccggctgtacatggtgaaccaagtgttctgggacgacttgatttaaaattgttgtacaggctgtccaccaggcgtcacaaacccggccgatacgctcattgagccttggtgctgaatcggctgaacgatttgctgtcttaacgacgtttgctgaatcggccgcggaggctgttgccttggtggcgtttgctggactggttgcacaacttgttgctggattggttgtacaacctgctgactcgggagtgtctgttgaatcggctgctgctgtattggatcaatagcaggttgaggcggcagaaacatggcagcaatctgatcttgcgttggccgattcacaacctgcccactatgctgtggctgctctctcattaacaaccgagggtttaccagctggcctggtgccaatactgacggagtaggtaagggagtcgatgccggctccgtcggctgagctgatggtgcgacggggggaactgcctgaatagatggttgggtattagtgatcaaaggccgataatttggaaagacacctccttgaaaataaactgggcctgcagcctgatgctcaactattgatccatcggctattgacttcatcatgtttgataaggtattgactaacaccctagactgattgatcaaagcatggtgcacagcatagtcgacccggtcttggaaattattgaaaaaatcttgtgccgcatcactattctgattaagatttctcccttgcaacccctgagcaccatcaccttgaactccatgcactccatcgccttgaactccatggaccccttgagagttgtcaccttgacttcctagagaaccgtcggtagcccctttgtcactcagtcgagccgagccatctggagcttgtttcccgtcttcacctttggaagaactggtcccagggtcatcggcaactacctttactttatacttctgaaccaatgttcccttgcgggtctgcatgaatgagttcaagaactgatcccgggcttgctgcaacattgcttcaaaatccttcttctgctcaggtgtgaatttctctggatcgataggcacgacgtttccttcattgatgtcagtcaaccccaacttctggatcttttctttaacagtgcttgggctagccgaggatggcgacagcggtggcttctcggccatgaggaagaattgcttgctgacttctaattggtcccaccaggcgtgccaaaagcgtgttgacagaaaacacgaggcctgggagatctgcttaactccagtgcaggtccaaagctcgccttcgaatgtatgagcgtgccagttgatttgatcctgtaatcaacaagaaatagagacaaagaattcgtggttaaatctataaatgatagtcgatcggtaaggtgctgatgacatatcatttatctttgagccgatgtcatatatgaatcgatcggcggttataaatagatattaaggaactaaatctattcgatcggctgtagatattaacgatatatagttcttatattaatatatacttaaatcaagtgattgggatagatcggtcaccatgccgagacagtataaatcacttagatcgaaatatatattaataacatgattatatatgtttatagcatagccgatcagatagatctagcatgtatcggctaatactccgatactactttatataaagatattaaaacaaatataatataccaaacaaaagcttaatatacttaaatgcaataagatcctgacataaagggcggatttaacatgtcattgaagcatatagatcgaatatggttaaatcagataagatcggctgaaactccgatactaccctaatcggcaaccagaggacaggctagagattgatattctaagcacgacttaatagatcaaactcaactgatgcagtattaagtatgaaaagaagaacaatatctagacaatcaagccgctgggttttcataaagtggtagatatcttatataatctagaacaacatcgctatttaacctaatcggctgtcttctattaacagatgttagccgattgtaggttagatgatgatattgccaaagattatgtaggatatatgataacttgacgaattatatagacaagattagagtgtcataaagatagaatcactaatctcgagaacgtaagtcgtcataacaagttttacctcttgttgaagatcgaaaccgatgcagcttaacccgaaagcaagaactcgtcgaaacaaaactaaagcaaaaaggtggcgatgcgccgaaattgtattgaacgtgtgtgttctttttttaaattacatagggctcggggtctatttatacccgagaattacaagatatgtccataccggacacgaccactatctctaacaaactctagacttttgcccaaacatatctctaaggaagttacataaaacagcataattaatagatacaattgccttctcaggactctatccatgtgcggcaatcatcttgaagcacctcaattcaacccaatatcatacaccaaatcatactgtcagaatcggccgcatcagctcacctagtccgactcagacccagctgatcctaatcgtagccgatctggatttcagccgattcttactctgttctcagatcaatctccgccttcgactccaccttgatctaatctccttttccgatgctgatattaccaaatttggtcgttaacatacgcacataccctcgaatgttagtgagaataggaatataccgttggtttccctttctgtttcgtgttaggaggcatattcgtgggtgtgtaagtgtggtgttgtgtgtgtactagtgtatggtgtatgtacgtgtgcgtctgtctgccatgtaattgaaataaggaaaaaaaaacaattctttgctacataatgatggcgagaaaattgtttgtttgtttttgttttgacaggtgcaaagcacaagagggagtgtggcgagctgaatgcgccgctgccgctgtgcgaccccggcggcgacgcctgcatcgcgtggtgcatcaacgagggctacgccaacggcaagtgcttcgtgtcgaaactagatttcggcaataataaaagggggtggctatcaagctcggaaagtgtatgggtttggagacaaggaatttatacaggttcaggccttcttataaaagaaataataccctattcctgtccgggggatgaatccgccgagtgtattattgattgtatgatttgggaaaaaatcagcatatgcccctagaggcgcccggaccccccttatatatgggaaggagtccggattacaaaagataatctatattcctaacggaacatgaagatacaggtaaaatacagtcgtaaccgactaagtctcagggtgtttccttgatacacaagttaagaaacaaacccaagatacagataagatattctatctacattaagtatccggtacccaatccaaataccgttgccgtgtagatatgggatacccataatctccacagtagcccccgagtcctttgcagtcgaccatcatagtcttctcaaagatagtaatccgagtgcttcaaactcttcaagccaaaacctgccgagtggactgtaaagggcgaaaagataaagaatatggtgcatcgaatagatgcacctaattaggtgtagcccccaactatgtgattagttaacaaactaatcatatagttgaaagacaaaataataacacaattgtgcattatatgacaaaagcatacgcggcgcctaaataggcatgctagccgaccgctttttagccacaataaaagaaatccgagtggattacactctaaaaggttcacgaatgaacacacttgacaggcatccgaatataaaaactctaaagattacccatcaagtattatgaagattatggtaataaataagtcgaatagcctaggccatgactatttaccataatgaaaataggtatatcacataccaaggaagtgactatagtaaaaacaagtcattcctagttaacccaaacagcttttgtagcctaaaaaagcttgcaaaaacagcataacgcctttctgtcgggcacctttttaatttgcattgcaataattccaaagaattatatgaccgcataaaaaggatttgatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcgacgcttcgtcttccccgccggaactctcgccattttccccactccctgctacagtgtaaagctgcgccggcgaactagggttcacaactccggccaaatccacctccgaaaagtgcatcaaaatccttcccgtgatccaccgcctcaatccctcacctctcccaagccatccctcaaatcaaatcaacacatttgagtgaaaccaatggcggaagagagagaaagcttcgaaggccaatgggcgtcatccgacgtaacagaagagaatcttaaggagatggtggcgcacggcgttctccctgccaaggagatcatcgggtggcgaccagcgcacggtgaggctttcccgtctccggatactcatgagattgtggtcttctcgcatttcttctacggcggctttgctcttccgacctcaaaatttttccgcgggatcttgaatttctatggaatcagcttgcatcacctaaacccgaattccgtagtgcatatcgccaatttcgtccatgcttgtgaagcctttttggggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggctggcatgcaaactggttctatgttcagaatcccgagcctgctcttcccgggtactcttgtcttcctccagtgtaccaagatacttggaactctcttccaatcggagatgaagcagtacaagccttggagttgttggaccgtatgttaaatcttaaagaacaaggtttacagggagagcagatcactcggcacttcatcaaatgccgactggcgccaatcaaggaaagatcccgcacagcattcgagttcgacggcaaacatgatcccaaccgtgaagaaccagactccctggatttcaaaatcatgaaggagaggatgtataaaatcttctcaaatgcaattgtagtcagctactctcatcagctgccagtagtgccatataatgcgttcaatccgcctccgcaggtatgcatctgaaatcctcaatctatggccaaaacataatttcatcttcatgctgagttgactaactatggaagcatcttgtgcaggaatatgcattgatgaagtcagatccaccagtctctcagcgtcggtctcctcgccaacacaccgttcagggaggtggagggccaacgatcagaccagatccgcaacctcagacctccaaattggctggtcaaacaggtcctcgcaagagaaagctggttcttgatgatgatgaaggcgacgatgataaatctggggataagggctcgcctaataaacccccaaagcgtaccatgcccaggaaaaaactggctggccgtgcaatgccaaagatcagaacatcttccaggtattagacctctcgatatgattccgcttcagcatgttatgctcatgaaaatgatgctgaatactgaaagaacactttgcaggaaaccatctgatatagatccatctggaaaagaccccgatcctgccatgacagagcaaaatatatccaaggaccccgagccgactgctgaaaaccagccgactgctgaaagccagccgactggcgcccatgcttcgggcgatagggccaacccaagtgacctgccgccgactggaaaccagtcggcaacaaccgaagcggcaacaactcaagaacccccgactggaaaccagtcggacgcaggccctgatcaagagatccccgaagtagaagcgcagacgacgacttcgcaaggaccagaggctggtaacgactcgatagctgggtcttcaggtaaagaacaaagatcacctcacgctcagctaggtacatcttcaggttagttgtcttctcaaacaatggcgatttaaataacctcagtgtatccgtctaatgtcttggaaacacatcaggaccatcaggtgatgacggagaagaaattcctcgcataaaggcgaccgacgactctcgtcctcctatcttgatcaaatggtgggacgagaactcacaagctgccggcatagtcataaaccgtcaaaaagaagatgaagaagtgtgccagctgaagaaagcgctcggagaagccactcgtattgtaaatgtaagtcttccgagtgacggccttcagtaactttgttttctttttagcagaactgaaccatgatccatcatgcagagaatccatcttcgcaatgaggccaagactacaactttggaaaagctggttctcatttgggaactctagaagcagttagggaccagctgcatgaggccaaggagtgcgccaaaaagacagagaaagagttaagggaccgaatcgcccagctccaggatgcaaacttcgagctaagtggttcatcaaaaggtaatcatctagatctgttccattgatttatactgtcataattgcatcctcaaatatttggatttcaaacagcgcaagccaccagaatggctcagatggaaaaacagattgaagccttgaaaaaagacaaagcaggactggctgcagaaagggactcagccttgaaagaaattgaaggtactgccggctgatgatctgaactttcctctttttaatgcagtagagtctgattgttataaatgtgttctgtagaccgtaaaatcaagtctcaagctcagtttgacgtcctggttggtaagatcaagaggcttgaaggagcaagagatgaagtcgccaatgtcgctacaccactcatccaagccatgttcctcaataacagtggtccgagtgcactcgacgcaaccgaaatattcgacaagctgagtgttgctccggatgtatatttcaaaaatatcaagaaagctggaagtatgggagctagcatggccttggcgatgacaaaatccttgtacccgagaattgaagttgataccattgatggatttgcagacgggacaagtgaagaagctgctcttgatctcatcaataatgcgcagagtgcggctgacaaaattgcgagtgatgttgtagagcaattccgcaacaacgacctccagccgagcgataataactctgatgatgaaaggactgattctgactgagtgtaaatgtaatacatggaggctcaatttgtacaatactggtgtatttatgctgtgcttgatgattcttgcgaagtttttgatttcttaaaagtttttgctaagctttattgagcctaaaacccaaagaagctattaaaaactttcagtcctcgcaaactaagtagaaaaaccaaacaaggcaatgataaaccaagtaagcaaactgaattgataaaaaatcacactccattattatgatgatagcccccgactggcaacttcaaggagaaaacttgatgtttgacagtcaaaatagggaaatacaatgataaagttaagcgtagaaacgacgaagatgttcaatgttccaagagttgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactaaaaaggcacgagatcgaacattgcgattatgataacgtcgcaacccttgtaagtaccgagctgactgaatcaaagctgcttcgcgggcctcttccagtcggtgcaagtcgtccactcggtcttcttcatagcgttcttcacggaaattacggaagcgcaaagattcgaactcgacttcactcggcaacattgcttctgccccgtagacaaggaaaaaaggtgactggcctgtggcccgactgggcgtagtacgcaaagaccaaagtactgatggtaactgtgacacccatttgccggcatagggtttaagccggtcaaaaactcgagctttaatcccttgaagtatcatgccgttggccctctccacctgtccgttgctcattgggtgtgctactgaagcatagcaaatcttgattccaaagtcttcacaaaagtctttgaaaactccgccggtgaattgtgtgccattatcggtgatgatccgattgggtactccgaatctatgcacaatgttgatgaagaaatcgcgagcattatctgctgtaatcgtgacaacaggcttagcttcgatccacttggaaaatttgtcaatggccacgaagaggtgcgtgtaaccgccgactgcctttttaaacgggccaaccatgtcgagcccccaaaccgcaaacggccaagacagcgggatagtttgcaactcttgagctggtagatgaatttgtctggcaaaaaattggcaaccttcgcatgtgcgcacaattttgtcggcgtcggacactgcagtaggccagaaaaaaccctgccggtaagctttgccaacaatggtgcgcgctgcagcatggtttccgcatatcccagaatgtatgtctttcagcaattgtctcccttcctctaaagatacgcagcgttgcagaattcctgaagggcttttcttgtataactcagattcatgcataacataaagtttgctccgccttgaaatccgctcggcttcatctttatcttgagggagctcttgagaagttaaaaatcgtatgaagggctctcgccagtcggcttcaaccatggcgacatcatgggtgcccgtaacttgagtggcatctttgtgaggtaccgtcggcgtataaaggtgttcgacaaaaacatcagagggcgctgcctcgcgcttggatccaaagttcgcaagtctatcggcagcttcattgttgtgtcgaagaacatggctgagctcaagtccatcgaacttatcctccagtttgcgtacctcttgtcgatatgccatcatgttgtcgtcaatgcaggaccactctttcataacttggttgacaaccagctgtgaatcacctcgaacaattagacgctttatccctagggaaattgcaatccgtagcccatgaaggagcgcttcatactcggcgacgttgtgagacgccgaaaaatgtatccaaagcacataacttagtctttctccagtcggggaaattaaaaccactccagctccagtgcccgaaagtctttttgacccgtcaaaatgcatggtccagtgctctattttctccacgggggtatcctcttggcactcggtccactcggcgacaaaatcagctaacgcttgagacttgattgaagtgcggggcttgaatgatatgtccaaagacatcaactccaaagcccacttagcaatccgcccatttgcttcgcggttgtgcagtacatcgccgagtggaaatgatgtgaccaccgttaccgagtgaccttgaaagtaatgagacagcttcctggtagtaattaaaataccatataacagcttctgaacctgagggtacctcgttttggagtcggccaggacctcgctgatgaagtagattggtcgctgaactttctggacatggccttcttcctcacgctcgacaaccaagactgtgctcacgacctgggaggtggctgatacatacagcaacaacggctcctgcggatgtggtgaggctaagaccggtggcttggtgaggagttgtttgaaatcttcgaaggccttctgtgcttcgggtccccattggaaattatctgttttcttcagtagcttgaagaagggcatcccccgctcgccaagtcttgaaacgaatcggctgagcgccgccatgcatccagtcagcttctgaacatctttctgggtgcttggcggtttcatgttgaggatagcagtaactttctccgggttggcttggatgcccctatgagacaccataaaaccaagcagcttccctgacggtactccgaaggtgcacttttcaggattcaatttcatcctgaaagcacggatgcttgcaaaggtttcttctagatccgagatcaaatcatccttttgcttggtcttgacgactacatcatccacataggcttcaacgttgcggccgatctgcgttgagaagcatctttggatcatacgttgataagttgctcctgcgttttttaatccaaacggcatggtgacgtagcagtatgccccaaagggcgtgatgaatgaagtcttcaagcagtcggattccttcagtcggatctgatgataccccgagtagcaatccagaaaactgagaagctcgcagccggcggttgagtcaactacctggtcaatgcgaggcaacccgaaaggatcttttgggcaagatttgttaaggtcagtgtaatcgacacacatgcgccattgccctgttttcttccgaactagaaccgggtttgccagccagtcgggatgaaggacttctttgatgaagcccgctgctaacagcttggtcaattccaccttgatcgcgtccttcctgtcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtctcggcttcggtttccccactttttgaaattttggcagcgggcacttctccttcgctcaccgtggttgcagccaatcggatttcctctcgggcagacgccatctcgcgggtttgggccatgtcgcaactctccttgtcgcatgtgacagcttgcttgatgtcgctccgtagggttaggactcctcggggaccaggcatcttcatcatcatgtatgtgtagtgcgggacggccatgaacttggctaacgccgggcgtccgagtatggcatggtatgctgtctcgaaatcggcaacttcaaagctgatattctctgtgcggaagttttcccgagtgccaaaagtgaccgggagagtgatctggccgagtggagttgcggataatcctggaattactccatgaaaaggcgcattgcttggttttaactcggagcgagggatctgcatatcatccaaagtcttggcgaagaggatattgagtgcactgccgccatcaatgagggttctgcgaaacttgacgttacggaccactgggtctagtaccagggggtaccgccccgggtggaccactcggtcaggatgatccgagcggtcaaacttgattgcgatctctgaccatcgaagatactggggcgtgtcaggttgaacagcattgatctcccgttcagtcaacttctgcttccgtttagactcataagccagggggccgccaaagatatggttgagctccttgcggtggtcttgaaatccagccgggatgtcgccgtcgtccttcttccttgacgtgctttgttcctcgtcggagttcttccgagtagacttggtgtactgctccgcgaactgcttgtagatgaagcattctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccgaatttgccgaccaactcttcgtggcgaatccctttggtgaatgcggcgatgatgacgtcgtcggtgatgtcggagatcttgttacgttgttcagaaaatcgccggatgtaatctcgaagagattctccggacttctgaatgacgttgtaaagatcatattgtgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgttgtctcctcctgctgcgcggattgcgagaccgtagacggtaagccacgattctggattagtggtaccgtcgtacttctctattccagtcggtttgaagccggctggccaatccactcgacgcaggtcgtcggtgaaggctgcaactccgtcaaggtcgtcgtcgcggcgatccggcgagtgatggtagcctcgagctgctcggcgctgtgtgattgtgtcgcgaagatcgatggggcggcgacgaggtggtgagcgaggccgttccactcggcgctccccatgaagttcgggaggcgagtgaacagaccgctcgtcgtggcccctgctcctgcgattggatcctgctccagtgatgctgaggcttggatgacggtagtcatgagatcggaagtgggggacccggctgccagtcggcgtgtggacgctttcggagttaactgggaccgtcgccgcaatcatggtcttcgtctggttcaagatgttgacgacgtggtcggaacgattgagctcgttttggttgaggagggtgtcgagaagggtgatcgcggcaaccgcattctgttgaggggtgcggaaaaccagtgtcccttcgacatcttgctgaccgatgagatcacgtgctcggcgccctgcttccaaagctcgctgacgtcgatcctcagcctccttcgcagtccgctcacggtcctgctgctcgcgccgtagccgttcttgttcttgtgcttgatgctcctcctccagtcggcgtcgttcctcggtctcctgggcttggcgttgctcctccgtctcattattggccatgaaaacgccaaagtagagaggggtgtagttgtcatctaggcttccgtcgaagtcgtcgaagtcgttgaagtcgttgtatcgagaactaaatttgtcgtactccacgatgtcagtaggacgtgagtcgacggtgggagagctgttgtagtcatccagctgatctgtcgaaaccgtgccgagtggttggaggatgacgccgacttccctgaagctaggcgaactcggtgttgaagccgacttccgcctaggcctacgggatgaaggcgctgtcgtggtgaagacggccgctaaatcgtcggggagcttcatcaggaccggtgggtaagccccatcatcttgatctggtatcgttggagaagatgcgatctcggccgagtggtttgaagccgactcggttgagatggtcttgaagtagctttcagccgcgttcgggaatccaagcgggaccgaaagccggttctctcccgactggtctgattccgagtcgaggagagaaatcttgccgaagttgttggtgatgaagtcgaggctgccgaaccgaaacgcctgcccgggtgggaagacgaggtcgtcgatgccggagacggaacccattgcactgatcggcgaaaagcttgacgctacccctacctggcgcgccaactgtcgaaactagatttcggcaataataaaagggggtggctatcaagctcggaaagtgtatgggtttggagacaaggaatttatacaggttcaggccttcttataaaagaagtaataccctattcctgtccgggggatgaatccgccgagtgtattattgattgtatgatttgggaaaaaatcagcatatgcccctagaggcgcccggaccccccttatatatgggaaggagtccggattacaaaagataatctatattcctaacggaacatgaagatacaggtaaaatacagtcgtaaccgactaagtctcagggtgtttccttgatacacaagttaagaaacaaacccaagatacagataagatattctatctacattaagtatccggtacccaatccaaataccgttgccgtgtagatatgggatacccataatctccacacttcggcggcgacaccggctgcacctgcctcaggccgtgcccggctccggctgctcagcccacgccggcaacgccacgaaaatgggctgattttcactgaaaatttttctcatcaggctttcagttacgttggtggtatacatgcatatactatcattccttcttacaccaaggaaattcatctttacggtgctctttagtgataatattctattgactattgccagtattatcaccaataaaaatgattcccataattggcttatgagttatgttctgccatttgtacgtattacatccgtgcaaaaatagttctctctaagattgtcacttttgagtattacatgctaagattgtcacttttgagtattacatgtctcatcaatcatcttcattttagttttttttattctaccctcaactatccttgcacatctataaccataccctatttaataaggagcactatagtctttttctttaaaccttaatctaccctaaacaatttagaatgacaactatactacgacggagggagtacatatgattcactagattaaaaaataaataaataactggtctagattaattatactaccacaaaacaaggatatcatttcatttactccattttttttaaaaaaaataaatgcaacagcatggatttgcacataaatgcaagtgtatctctctctacacataaattcggttggaatcaagctatgcacattaattcattgcagatgcaaattaattcctatatatatatgaacgctgcccccatcccatttacatccatcccagaaaattctctacacaaaaattagattaatttgctcttaattcattcctggacttcttgacccccctcaaaaaaaaaaaaaaacctctagttgtcgaacagttcatcatccatggagtttcagagcagcaagatcgcagctgcattcttcgtcttcttcctcctcgccaccggcggcggcgccgccggcgggtgctccgtcggcgagagcagcacgttcagaggcaactgcgagatcgacggcggcggctgcgtggagtcgtgcaggggcgaggggtacaccgacgggtactgcttcaccgaggtcgccaaccctggctaccacgtctgcacctgcacccgcggctgctactcgccggcgcagtcgacgaggaagatgatggcgcgcaattaattagctgatgattgattcgatcggcggcttgtttgaattgaatcgagtttcggtttaataatcaaataagaaattaagaatcaagcagagttcattcgaatgtgacgtagaggggcttgataggaatatacaggtttatgacaggggctattatgaaaaagttccagaactaacgccaagcgacgccaggagaaaattttcttagagacacgctataaaattaaagcagacacccataacacgtgtatagttaccctatgaacgtacgtacacacagccttctcatatgagtatactttcagaacactagaccaatattttttgagattgacgaagtcactacggacgtctcgttgcttaggggtgaaaacggagcggatattatccgctccgctccgaatccgtccgatgtgaggatatggtaagaatctttagatatccggccggatgcggatgcggatgcggattttatcatgcggatgcggatgcggatatggtatcaacgatatccgacggatgcagattatccggtattttaatcggattatccgatgtactgtttagcggataatccgcacctttcaggctatacaacaactctatttagcccattttacatcggacggcccatctagcctatctagtgtaacctaatccaatcctcccctaaatctctctctctatgtgactcttctctcggtcccttctcctgctcccacacgcgccgccgcatggcaccataggtgcgccgcgccaccgttgcagcctgctagcgccaccgtcgccactcctccttctagttcgccgacagtgtgttgtgtgctgtgtgctgtaagcagtgtgctgtatggaactagtgtggtgtgtgccgtatgcagtgtgctactgcgttgtgtggttgtgtgctgtatgcctatattgttgtatgcttcattgcctcatgcctgtcgtactgatgagtgaactactaaactgaacactacatttttaaattttaagcaacgcagtgaactgctgaactgaacacttatattatgtttttgatggatatgttatattaagcaaaattatattattgatgtgttttggttggtttttcatagagagctgagatcatgttcatatgttgtttggccatcgtattgcagctaattgtattgccgccctcttgttgtatggattgaatacaaacttgacatccgacaactttttgtccgtttccgaaccgagtccgcaccgactccacaccgaatccgacgtacgaaataatctgctccgcatccgcacgtcatccgcacccgctccgcatccgcttaaaagaaatggtttaggatatgtgacggagctcgtggctcctcaccgggagaccgcgcaggcccccctttgccggttcggccgggggcttagggtgcaatctcaagctctcgctctctctctgtatgtggaaagatcgtctgccagcaagaaacacgagacaccggcgatctatacaggttcgggccgctgagaagcgtaataccctactcctgtgttttggtggatctgtgtatgaatgagttacaaagtgtgagctgacttctcccccgttctcagcactcaatccgggaaagaatcaaccccctctcaatgggcaaggtcctccttttatacttcaaggggataccacatgcacccttccctttccaaactggactgttctttttctctttaatgggcggagattggtatggctgctgtccgaacgacacttcgatgggacagcccacacctacctccactcccggcggagacgggcgcaacgtgagatcgtggctgcccgttgctgatgcgatcagtgtcagaccggtcattcttgtccaccacgcgtcagtttaataacatgcatgtttccccttcttcgtgtaacacctcgcctgtaatggttaggatgaagcctggtattcatctaaccagggctaacgtgccatctctaagaaataacacgctagctccggcttgagacgagtgcctagaggctttcgtcttgacgggatggggcaaggcgtgcgtcagaccgccagtcgccacctaacccttgatctgaccggtctgtgactggtcacagaccggataaaagagcgtgctgtactgcgatgcacgcaacgtgacacgcttgaccagactgcaatgaatgctgttaggtgagcacagctgtgctcacttatcccatatatgtggcgcagacttctttaaggggtcggggtgccccggccctcggggccggggcaagcgcaacccgaccccccctcgggggaaatcacgaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacagtctcaatccatgcaccttggtactggtaactttggtggtccataatgggcggtctattcaagactgccacaccacttgagcagcgcgcgaatctgggcgagcagatttgtctcgctcggagatacggtaacgccgcttcggtcggcgagcgtaattaacgcgcgcacgatacaatccgtttcgattgccacaaccgcatatccacttcatgcgccgtaagcgggcgaatgggattagtggaagcgtgggcacgggaaactagggagcgagatagcgagatacgagggagcgaagtagtgggcgcgagaaacgaggagccaggcccagcgatggcaagggtataaaagcatcgagaaaaggatttgctcccttcctttcgccattgttcctcttgccttcgccgcctgagctctaactctttctctgctacgccctaccttcgccacacacgctcgttcccaatcatctcttcctccaccgccatggcacggggctctgctctgctcgacggcagtgtactgccgccttcccgcatcgtgaacgagaggcacgccggactgccgcgccgcttcatgccggagtccgccaccggtcgggagatagtgatgctgggcgaggggcgcccggcaccagactacccggggcggtccatcttcttcctccctttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaattgggacgactggaagagcgactggttctacaccccccttgccgacgaagcgcgtctccgacttccaagccagcccccggcgcaggtctccagctggcgggcgccggtagatctgggggaggagtacgacgccgtcctcgaccgcctggcgggcctgcgatcccaagggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtggtccaaagggtgctgaatcttagctctgcggaggcgtctcgcattcctcaagagatcctccccctctgcagcgatcccgaccgcgcctccattctaaccattatgatgggggtcggggcctcagaggagagagcccctaagggccacgacggcgcgggcgagcgccgccgggggaaacaatctgccccaggagggggtcgtgcttctgggccccgcgtcgggggctcggggagcagccgccctgccgacgcccaggggaaaaggaagctgggaggaacacctcccccatctcctccccgagggggcggggcggcgcgtgccagcagtcggcgcccggagggggccgcgccggcgtcgcagcccgagggggagcgcaagaagaagcggctccgcaagacgggggagacggagccatgccggggaaacctgatttcccctccaaggtggtcattcacccgaccccctcgcaggttcgtctcgctctcttcgcgatcgccttttcttccatcctaaaagcaagttttttcttactcattttgttcgtcttctggttttttcttctgcttcagcaatgtcccgtcgcattcctcccgccaccccaagtccggccagtccgaggccgaagatccggcggctgcagaggagcggaggcgagaatctgaccggcgtgaagccgcagatcgccttcgggaagccgaagaggccgcccgggaggccgcccgggttcgccaagcggaggaagctgctcgggaggaggccgcccgggctcgccaagccgaagaagctgcccgggaggaggccgcccgggctcgccaggctgaggcgacagctgctgctggcgcgtcactcgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgtatcctccggggggccaagccgtgtcacattttctccaaggcggcttttctcctcctcttccgtcgccccggtgagcgccgagcccattatgcaggccttggccgccgcaaacaccgcggtgctagatggatttagcgcccaggtggaggccttgcgagcggaacgagcggagctcgaggccgcatgggcgcgcgtcgaggaggggcggcgctcggtggacgccatggtggaggtgggccgtaaggctcaccgccgccacatctcggagctcgaagcccgcaaggcggcgctggcggagatcgcccgagaggtggaggaggagcgagaggccgccctcgtcgccaccaccgcgatgatcgaggcgcaggactccctccgccttcaacacgggagctgggaggcggagctgaagaacaagctcgacgccgcccaaggggttcttgactccgctgctgcccgagagcggcgggcaacggaagccgaagcggcgtcccggcggcgcgaggaggcccttgaggcccgtgccatggcgctggaagaacacgccggcaccgtggagacgggcttcatggaccgcgaggccgccactgctctccgggagacgacgctggcggcgcacgaggccgcctgcgccgaggaggagtccgcgctccgccttcgcgaggatgcactcgctgagcgggagcgagctctcgaggaggccgaggccacgacgcaacagctggcgaacagcctctccctccgcgaggcggcgcaagaggagcaggcgcgccgcaaccttgaatgcgtccgtgccgagagagccgcgctggagcagcgggctgccaacctcgaggcacgggagaaagagctggccgcgagggcgcgcatcggcggggcggctgcgggcggaagcgacttagccgctcgcctcgcggctgccgaacacaccgtcgctgacatgcagcgcgcgctggattcttccattggggaggccgaggccctccgcttggcgggcgagatggggcccgacatgctttgggactcagtctcccgcatggatcgcgccggtcggcaagcgggcctctggaaaggccagacgaggacgcgccctagcaacctggaaggcctcgctccgcacctcaacaggatggcctgggtcctcgaacgactccccgaggagctcgagaagaccatcaagtcatcctcgagggacctcgcccggggggcggtcgaactcgtgctggcgagctaccaggcccgggaccccgacttctctccctggatggcgctggaggagttccctcccgggaccgaggacgacgcgcgcgcgcgcgtccgggatgctgccgaccatatcgtcgacggcttcgaggggtcggcccctctgctcgcgttcgcccccagctccgacgaggagggcgacgccagtgatgaggatgacggcggcgacgaggccggcgacccgggcgcattggaatgagcccccaggcccccgccaatcttttttttcttgttctttcttctaaggccttcatgcctcttttttgtacaaattaacttaatctgcaatcagaagaaaaaatttttgtgttagttttagtttgctatgcaatgagctgaggatgatctgtgccgtgatcctcttttcgtgtcttagcctgatttaagggcccgtgcccaagtcctaatcctcgaagggcgcgggtcggggctagtgcctggggagatccgcatgtcgagactggccaggccgggaacgtggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattcttcagaaggaaaaacggcacagacacaacctttaggaatttgaaactgcttttattgaaatgctgaaaggaatatatgtgcatgtgtggtagcccccggctaaccctgcacacccgaggggggtgcggggttagcccgagccaaaacctgacacccgaccccccccttcaggggtagaagcgacgaaggtgttcgatgttccacgggtttggcagctccgtgccgtcgcccgtggccagccgtaccgagcccggccgggggacaccgatcactcgatacggaccctcccacatcggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctggtggatttgcttggcgtggaactgacacgctctgcatcgccggaccagatcgaccgcgtcattgagagccgtcggccaataaaatccttgacgaaaggccttgccaaccagggtacgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcagtcctcaggtagagtcttatctgtgaggtatgtttggatctcagagatccaagcaatcaatctaagggagcttggagcgctctcttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccttctgggtacatgccgaagttctatcccatcgaaatggcgctccatacgccgcacttggcgtacgtaggcgtccatctgcgggtcagagcaccggtactccttacagacttggttaataaccagctgagagtcgcctaacaccaggaggcggcggatccccagcccagctgccaccctgagtccggcaaggagtccctcgtactctgccatattattggtcgctcgaaagtcgagacggaccaggtatctgaggacgtctccgtttggggaggtcaacgtgacccccgcaccggcgccctggagagacagagaaccgtcgaactgcatcacccagtgggcggtgtgaggcagctgagaggggttcgtgctggcctcgggtattgagacggtctctggagccggggtccactctgccacaaaatcagcgagggcctggctcttgatagcgtggcgtggttcaaagtgcagatcgaactcagaaagctcgattgcccattttaccactcgtcctgtaccctctcgattatgcaagatttgcccgagggggtaagacgtaaccacagtgacccgatgcgcctggaaataatggcgcagtttcctcgaggccatcagaatagcataaagcatcttctgggcctgtgggtatcgggtcttggcgtcccggagggcctcactaacaaagtaaacaggccgctgcacctttcggcggggccgatcctcttcgctaggggccgtatccccggggtgctcttcgtccaagtggcccctcggggcacactcgtcttctgtgctgatgacctcggggtcggaggacgacaggagcggccttcccacagtggcctcggggccgtcctgggggtcgggggctcctggcgtcgtcagacaagcgagcaaagggccagctccggtcgtcaggggcctcaggcctcctttcggctcgggggcctcttctccctgctctctcccgggtcgagtcagcacagggttagcctcggggtcaaagggcggtaagtgcggccttcccttagtggcctcggggcctctgagggtcgggggcacccagcaccgtttgacaagcgggcagagggccgactccggtcgtcgggggccttaggctaccgttcgactcgggggcctctcctccctgcctgctcccgggccgagtcggcacggagtaggggtgcgcaggatgaggattgtcctcatcgcgctccacaactaacgccgcactaaccacttggggggtcgccgctaagtaaagtagcagggactcatttggctccggggcgactagaaccggaggagagctgagatacgccttcaactgggcgagggcattttcagcttcctccgtccaagtgaacggccccgagcgcttgaggagcttaacaagggtagcgccttctctcccagccttgatatgaaacgactagggcggccatgcaaccagtgacgcattgcacatcccta

SEQ ID NO: 44214 - DNA, 2248 bp, Oryza sativa
ccgggctcgggaaaaaaatggggaaacggacgaggggagcacggggatgctttttatgggctcgggaaggcgggatcgaggccggacgtggcggaatcggccggcgaagtggagcgccgtcgtggggtggtggaggggttaaccggcgccgtttctagcggggtgagtgggggaaaaggtggaggacgtggagggggtcgtgtccatgtggttggatgcgagctcgggtgcgggaggtcgccggattttgcggcgacgtggggcggctcaggcggccatggcggttgcagccggccagccagaggaaggaggaggagctgacgggtgggaccgccggtcccacctgtcggcgaagggagagaaggagggacgcaaaacagacttttgcaagcgggccaaggaagaagggagccggcccgagagagggaggaggcgcgcgggccgcgggagaggaaggagggggaggaatttgggccgagcccgaaagggaggaaggggaagtttaatttgttttctttttattttaattgatacaatgatctttgtgttattaaaactatttctcgagctccgaaaattcacggaaaattccggagagtattttagggcacaaagaatattgcaaaatattcccggccaatgatttttaagggaaaattttaattctcccattatttcacttgattaaattgattaactttttattcaatttctaggaaatgcatcattaaatgatttttaatcccgaacgaaaatcggggcgttacaaatctaccccccttacaggaatctcgtcccgagattctgggatggctagaaagaaagccggtgctgatgggcggtctgactgatctgctgacacatgctgcctctttctgattcgaactgactgactgactggtttcatcggattagatccctggagttctggtacccaacacgaccgattagctgatgaaacctatacgagcgatctggctggattcaacactgttgtcccgttgcttcccaaacctgaattgattggttctgctcaaactgacgcagactaggactgcctgtactcataaaacttacttatcttgggctgaactgtcaatactagcaatttgataacccgacaattcaccaagctggtagaagagggtgaaacttgcatctggcatttgtaactcattgatcctacgtccgcttgaacgggtcctgactcgaatgacacgtaattccaggaaacctgcttgacaagtctttcgtctgaactacaaccgtccctgatgctgcttctcaaagctgagctattgacctagcctcaccggtgtacctcagaattcaaacggatgccctaagatcggcttagctcttctgataccttgcaacaggcttcttcaagtgctacccggattgttgcagtgggttgaaccttcaactaaaacagcgatgaggtgagccaaaactcatctccgagacctaccccccttacagtgggtagtcttactttcgcctgactgagaacctttgaactgttgtccttgaaaaaatgaccaacatttctcggatttacagatgccctgactttgaagactaaaacttcatcggtccatcaaattgaagcaatggcgatgcactttcatcccgacaagatttggaacttaagccttagttgatgataggaaattccacataaaagtgactctcatttagctcatggacacactgactcttgactgcaacacactactgctggagttctttccgctacacttgaccttgcatcgagctttgcatctcccgcatcaatacatccatcatctaatcttggacaccaaatgttgatcacgagcagggttcttctggcactgggataccttgtagctttcaactgaaccattgattggtgactttaattgatcttatctctgacactgaccatccgctgccaggacggaagagaggtggaagagaggggttgctaaagataaggtactaaaccacttgcctactgatatgttgtgagtagacttttattcttcaagttgcttaagcaaacaacctagtatggtcgcatccccaccaatgatgcaaaccatacccctacacacaagcaaacaacacacgatctagaaagctaacggaactactcttctgggaaagattgggtttaggtcatctccgagaaaactccacttgatcttcgcagaacgacgactctgaactgatcttctcgctccttgcacgaagcttgaggctc

SEQ ID NO: 44215 - DNA, 2740 bp, Oryza sativa
cccagccacgatttgttgcttgccatcgtgccacccatccccgagtcggcgagccccctactagtgcgccatgctactcgctgccgacacgttgtcgattggaccactgttcgaggcatgccaggctaccggtgaccaacaccgttgccatgttgtagtgatatttcacaaaaagaacacctagctctttgtttgtgttatgctaacaaacttggaagcgtatgtgagcggttcctttaagtagtccacatagctagtaccacctctacttccctttagaaagggattcaaactttacttacggatggtaaggatgtgatggggctaccaacacgaaaagaaaattaatgggctgaaaacattgagttcatgatgtcaaaagaatttggagcgcggagtaggaacacttagtaaaaaattcctaaacccgccactactttctagaaaacacattgaccattatcttcatatatcctcttaaaatagagagaaaaagactttgaaaagacaattgtaatcctaggccattttgcaagaatccattcatctataaagctaatgcccactaaacacctaaagctcaacatgcaagcatagtatttattagcactcctaaaatctaacatgcaagcatgccacatcaatccactaagcatacaaagctcaacatgcaagcacatagtaattatatatacaatttatttcattctaaaactaaatatacacatgctaaatcattattctcaaatcattttcacaatatttcaatccaaatcatttcaccatttctacaatatctaacatatatatcaagcaacaaagcgcggggcatcatctagttataacaaatattactcaacaaaacgtattttgcaaaattaaacttgtcccaaattgtaaaaatcaacaacaatttactgaaggttgtttaaaataaattcatttaaattctattttcacggttctttaaatttacgaaattcattaatcttattatttttatttttaaaatttgttattaaaaataaattcggttaatattttttcacaatttaaattttgtttttttaaaacgtttaaagttcaaccaatatttttcagttttaatttttttgcaattcacatatttacaaatatgggataagttttgcttattttttttcaaaaatatgtttgcatgtacctattatttgttcaagaattatcttgcaaggtggaccaaatttaaatttctcttataccatattttctcaccattttaagaagatatattaaaataatggtcggagtgtttttggacaaaacaccacaaaacaaagatatcctaaagcataagcttttgaagaagataaattaaaataatgatcggattgttttttgggcaaatcaccacaaaactaaaatgtcctaaagcataagccacaaatatttagtgtcctaaagtaaattttgcttaacagttaaggataggaaaacacagagtttaacaaaaagcaatagagatttcacaagtaaactaacttgacaaaagaaatatatattttataaaaactaaactaattactacataatgagataaacaaaaaataatcataaagaaatatgatagcatgttccaaggaattggagaaattacctgctcattctattctactactgatgatggcgatttcactaatcctaaaggttgtccattgtgttctatctcctacaaaacaaaaaaagtatggattaaaatattgttgatcaatcctacaatgaaacatatttctataataaggaactttcaaaaagttattcactaaatgcatgaaccaaaatgcatgagtagtcaaagggcgtttcctactgacaagctgctaaagttgcattagctaatagtagtagctaaaaatttcaaatggcatgtcggtgcgtagtcatagtcctctttctaatgaatccgttgaaacaagagttatgtcctctttctgctcctccacaggcaattcttcatcactaccagtaacctctctgtggagggcctccgcgagcttcttaacaagatcatccttcaagcctatgatagcttcctcctatggagttgttccttcaattcagtaaccttctactgttcaaaatcggccggttgttcagcacaggatacattgcactgtgacttctaaaattcacagctacaaaatcaaatggctaaacaattagattcgaacatcatggttgtcaagatggtaaggcgatctggggcaacccacccacgcattaccgctataggggtaaagcgctaaggtgcggggacgccataaccttcatgattagcagcgattagaaaagggagaggaagaaaattagcctagtaggccatcccacaaaagcccaataaccttcatactagcccaaggtcaaagaaacaagcgtaacacccgcatcaggtgcgtctctcctatcacagcgtcgcctctgatgtcgcttcttcccaggggcggagctagaatgagatggaggggggtgccacttgtttaatttactctgctaagtttaagctaatgtgggtgtctgaatttgaattgaggggggtgcacacatggtgaaaataggttaggtaaaatggcatggagtgttaccatataatctctgaatcagtactagtagtagttcttccttagctagtaagcattgtattggtcaatagattttttccttctccaataagctaagacctgctagtaagtcaagtctgttt

SEQ ID NO: 44216 - DNA, 15532 bp, Oryza sativa
aagttatatcattaaaattctgaggacatgatctgagcaaatagattggtgaaatacgtttcaactaagtttgcatcacaatggaccaactacaacacaatttctctttcaggcaatctaccgatatgtgaaaccagcattgatcaaaacactcgtagttcctttaacatcattgaccagaatattgagatacgcttgggggtgtgggtttagttaactattctttcctactaaaatcttcaacctgagactaaaacaaaattgtgttccataaaacaagtaaagtaagactaaaacataattgtgttaaagaaaacaagtagtgctcataagtaatgaatcaataaggagattagcaatgctatctgtcagtaaaggtgcagtcggtagcttaccttaactgctgtaagtctagttatttcattacccattctatcaacaagaacgggaaggcatgccggcagttccctttggagaccatcaccaaacgtggatagcgcaaggctcatgcaagatatggcacactctttaacttcctgaaacaaatatttccataagagacctgagagagaaagagacagatgaggatagggaggtgttaattttgctcaacctgatcctgatcctgatcctgatttgccaagcgggccaagatagccttatagattggaccaatatatggcctgtaatctggagagtgtggctgtatcacaaacaaacaaaggcttcaagaaacagaacttagattttgttcagcaacatatgaaatacaagattgacctcagaatttggacgaagtacacgaactagctcttcgcagactcttaaagcctcagcggtgaccttgtcatatctgtctccaatagcagacaatattgggccagaaagagcctggaatttcactacgatcaatacaatgatgacaaatgccataagtatattttactgaagatatatgttacagttacctgtatgtatggatgaaacacagctggggaatgtgaagccataacaagtcttgtaaatacaagggcttcaatcttcaggttggaggtagatgacttatcctatgaaaaagaaaacaagttagcaacaagtagaagtcctgcacataatcttttttagcaaaatgggaatcaccaacattcaaagcgttctcaatcccaggaacaagtgacccaatatgatcagcaagacagtctggcagtacaacaacaagctccttcaatacagagaatgctccaacctgaaattttatctaaaatcagaaccaggtcgatagacatgatttgcagtcaaagagctcacctttgtcttgattgatttttcacgcaactgcctattgatggatttgacaaccttaggtacttcttgtttcagcaaccatctagggctgaaaagcaaaaggattgccaacataggctcagtgctctaaacatggtagaatcaacttcaagcatgtaaaagtatttcaccaataaactgcataagatgctataacttggaaaagttgaaaataatgatgcaaataagagcacaatagacttgcctagactcatcaatgtcaccttatccttttgtcatgttaccagtttggcgtaacaactcaataaatgtgttaaagatgtcgatctagaatcatatagaagcttcatcagattgacaaacagaaagacaactcagagacaactcagagactgacaaattattgatacaaagcaattacctttacattttcctctctttccctaaaccattcaattaactttggacaagcctgcatatattttaaaaaataaaaacatcaaagttaaatggggcactcaaagttaaatgggtaaaaatcattacagaaacactgtctgaaacatgggagaaatttaaacatgccatcaaacagaacatttttcagataatcatatgttggtttaacatgattatgtcaatatacctccagatacatcttagacaacatttcaggacgagatactataattgcatataagcactttgctgaagccctccggactttccagcttgcatcctcatcatctgtgtattcatttgcgctctcactggagaaaatatcgaaaacatattttgatcaagtaaacagataacatttatctattactgtaagagcatcaattaagtactcatcatcttcctcatcctgagcctcatcatcagtgtcctcctccatactatcggtgaaattaggatcatagcttatatattccaatgcaagatttaaaatactctcacaatatggagatatatctcttggacacctcagcataaaactctcgagggcctacattatgggaaaaaccacaggagtcatacaagagaacactcgttagtcatgtaacattggaaagaagaaaattgctagcctgcaagctgtattcacagagctcttcatcattttctgatgcacttgtacaatagtttatgagcaaaggaacaacttcagcaaggtgtggcccaaaacggtatccaaccgagcgactgtaaatgaaacaaatattgaatcaaaacttggattgcagcacaccagataagaaccactaaatcgccaaaaagtagtaaatatctggatttcaacttgctagataaatttgaagtgtgaacatgatctcatctaagctattgcgaacaaatgagtgtgccctgttcctcaaaagaactactcaaggcatacatgtacagttgaaagccaaagtaccttagagcaccaatcatctggatatttgttcgggcaatttcagattttgcacttctatttttaagcaactggacaacctcaaaagttgccttggctaataaatcatcagacagacatgcagcaagtgatgctgaagaaaaatagcatgttaacagtcagtgtaaacacctttacaaactcaagccacgcaaaaaacaacatataatagcacagcacatcagttcgacttaccaatgcaagaaatagactttttcctaacacttgcttggttagagctcaactgggataacaaggcagtcagcatgcaatcatgatcttttgtgatcaagttgccaaatctatgaagtacatcccccaatatatcaaggcactcgcatttcacttccgcactttttccctgtcaacagaagaagagttatcaaacctacccaagacatcccatggtataacaaaaccagttatatgctactaagccccaatccgtatattggtgctactaagccccaaaatccgtatattggtttatctattataggcaggtgttaaacatgatgtgctggcaaaggcaagtaattcaataaaccgctcttgttttttttaaggtaaagacgtaaaggtgaaaggtgttcttatagttatgtggatagctagacattgccagatttgcagctaaaatctgtcttgtgttaggaaggatatcacagtttcctaattaatttatccaaataaaagattgctcgtggtttaccatttgcattgtatttgctgcagtagctaaaattgcggtttgaaatttatggtggctagaaaaatctagcaatattgactggtctggaaaactatccaactttctgcaatagcggaaggtactgtactatgccacttactatcatggctctcaaactagaaacaaatgttaaaacacactttctttttggctctctgtgctgataacataactctggagttatgatactagccagcatataatgacttaggctgaattcatttcagcctgttccgaacccctctccctcgttttccgcgcgcacgcttttcaaactgctaaacggtgcgttttttgcaaaaagtttctatacaaaagttgcttaaaaatcaaattaatctatttttgaaaaaaaaatagctaatacttaattaatcacgcgctaatggactgctccgttttccatgcggaggagaagggttcccaacccccaataacaaacacagccttaaattgaatatggcaagcaaacatggttgcacacctaaccagactggatgaatagggaggtaaaaataaatacatagttacaaggtttgtaaatgtgttctttggtattacacctcacaaaagtagaatgcaccatcagaaacgcggtaaacttaattagcaggctgaaactttcaattgtaacggcaaatacaaactacatggtacgaatggcgcacaccgcaagattaatatggaagcatgttttaccacaattaggagacgaattaagaacttacagcagtggcgcccttgattagctgtggggcaagagacaccaaaatcttttcagcaagtgttgttgtcgtaacttccgcaatgattgtcttcagagcaatactagcagtgtctcgatgttggtcctttccattgagtaacttatcacaaagaatgttggtcatctccaccacactatcctcaccaaccttcttgacaagtggagccaagctaaccaagagaagtaataatacagattaacatagcaaaccatgaagtgcagaacacaggaatgtggaaaacataacagaacaattgggtatcaaattgctatactaaatgtgcttcaatggatgcaataattgagacatgaagatgcagtgaaaaaaacagcagttagagagatacagaaaaaaataacatctactgtaataatcaatgtcctatattaatccagaaaattgaatgaggcagtgcaaatccttaacaatagcaactgcacctaacataaattacaaaagtagcgagatccaaattacagcgaattcttgcaggaaggagcggatgatcaccattaacaaaacaaaatgctaataagacgataccgctctcaataaagggagaaagcacttaatgcataccatttaacagctaaaccagagacttctcctgaagtatcttccagttgttgaagaacggtagtagtcaactttggctcaatgtcttggtcagctttgaagccctctttgttcaatcgctaagcaaatttgaagttgccatatatctgtagtccttatctttccctgtcatctgaaagcaaattttacacgacgatgttaaaatcaaatcatagataaataaagagcaaaattcaggtatacagttcacatgcagatcagtgaaacccataccttctccaagatggtggttatgttcatgtttgccattttagctaaaccgtatccaaaagtccttttccacggaactaatcactgttgccctggtggaaataataaaaatcgagtataatgagattaagttccattactgacaaggtaaacaacacacattgtacacattgttgagtatttgcttgctgacacagatgcaaaactccagctcacgatcacagtgacaatccccagtacctccctcctttaaaaaggaggaggtgggcgtgatggtgtggtgtgctctattctgccccacttcgggaaacaaaagatcctgctctctgctagatctacggtaacacacagaattggaaatatacaggtataatgaaacgaaaacagattaaactatcaaactgcaatattctgctgaagctgcataaatgacgcaaatagtaaagtcatgtcatgtatatcacaaaatttgttcttcaaacgtcccaaatcctggattttggtgcaaaaaaaatttatactgacatgctccatatcaaaacaaactttacatttgacatgagctatatgctacatgggagcgtatcctatgcacacagaccctcgcgtgtacacaccatgtacaccaactaaaaattatcacaaaaaattttagaaaaaatcatacatgtactttcaatagtattacatctacgtgcaaagtcgcatcttcaaattcattctacatagagaataacaaaaaagataaaattctgacaaaattgcaaccttaaaactgtcagattttttgttttttttttgttacggctaaaatataatgaatttgacgttaagattttaacctcttaaccctaggtgtaatacaattgaaagtatgtgtatgattttttctagattttttggtgacattttttagttggtgtgcacgtgtgtacacgtgagggcctgtgtgcataggatatgttgccatgctacatatgaggggaaaaatgcaagatggaaatccgttctctatgtaatctggaaaatcctgtacaattcatttcttaatgaaattcaggtgggggaaactgagacttaagtcccaaatattttacctatcaggtgcccttagtcaggatgtgcgcaagcgcaaccagcgtgaactgagtagtcggagataggtggcggagaggcgccgccggcggatgtgctcgggtcgcggggtcggcagcggatgccgaaggggcccggcactgcaaagagggcgctgacgaggatggaagggtggcggtggtcgggggtcgggggacggagaaaggaggaggagagaagacgacgagctccccgcctccccggcggcgtcgagaactcctggggcgccggcgccggcgccgccaatgacacggccgacgacgaggaggatgtttggtttaatccacatgttagcagtcttaaattgagcccattaccggaccattcggcggcccatccatgtctagaacatgtttggatgggccggattcagcccgtgtcggatcccgaaaactgttttgtattatgtgggccgtacttggaacctgcaatggtataatcacctgacgtccctcaactttacgtcgactttgttcaagttccttagaccttagggcctgtttggttggtgccctgagtgatgagcctaagaaaaaagcatgcctaggtggaagaaaatctataaaatgttttccctggtcaggcatataagagggtttgttgtttggttggtaccctggacaagaaacaagcatgagagcatgaaaccatgtgaaagcaaacaagaaaatataaaatattgcaatctcaaccggttagtacaagtaaacattgtgaaatgacgccatgcaactagaatattccaacctcacctaatctaccttctttaattcggttgcctgagtcaggccacccaattcaagcgcctgagcctgagcaaccacgcctgtgtccagcaccttctcaggacttgaaccaaacagaccaatgaaaatgtcaggcatgcttcagctcaggcgaatttgctttagggcagcaaccaaacagacccttaatctctagtactagaaataatctctatagtactagaaatccttactcctagactaaacaaaatcatgcaatttcgatccttcgacagtatggatatatggtttcgctgatgtggcatcttagttagtaaaataaaaattaaaaatgttatgagactcgtattcgaatgatttataaagagtaaaataattgaattttgatccaaggccagcagcaacctggaggctaaaagatgaggcaacaccgaggcggtcggctggagcgtcaattgaggagtaatcttaatgtctgaatatttagttgtcaaaactcccccaataaactcagattttcatttagattttaagaatatatagtcctgcaattcataaaataaattagaagttattagtagttggaaaatcagatatatatttttttcagattatcaccaaaatcttaagattttaagctcccttgccttagttttcaatcttttcgtgagattttctacatggggtagcgcttttctttttctccttcctaatgcagtgatgcacaaaaatataaagtgcttttttttttggaacaaccgactagtaattactttactaatataacaattgtattatttatgtaatataaaagcataactattaagtattttgaaggtgaatttaacaacatcagttttatcataaattatatcctaatggagtactccctctgtttcatgttatagggtgctttaactttttttttaattaaattcttgacaatttgatcaagtttatagaaaatataaaatttataataccaaattaattttattaaacctaacattgaacattgaatatattttgataatttctttgttttaggttgaaaatattgccatatttttctataaactataaacttagtcaaaggtgaataagtttagaaaaaatcaaaacgacttaaatataaaacagaagtaccttatttttgttttttgtttttttttatcggaggaccaagttctgaattgccaagtttatgcattccaaaagttttccctaatctattttgtcgtctatgttctatgacaaaactgtgccgcacaaaattacacaaacattttctttgttttgcacctccagaacataaccaataactgagtcagaactgcaagctatttcttgaaaaactggacaaaaatggagtcagaactgcaagcttatttcttgaaaaactggacaatgggttaatggaaacagtcagttttcctctaaaaaaaaaaactggacaaaaactcgacagcaactgtaactatcattgattgattatgcacaccggttttggcagaattggcatcattatagcttaattaggggtgctatacttgcatgttcacttgcgacaacagtttcatcctaaacaacataaacagggaagggattccaacatgttcctgagtctgtttgagcatcacgttacgtgttagcgaatgccaacatgatacagaccaacagattggtaagtgatatggcacatcacaagcattgacaaggatcaagactcactgcaatttgttcaatacttgtctttttctcccttgcaaaattttgagtaatcctcgtcattcatgagcgaattgagctcgcctgaatcactgatcttgaccacgataatccaccctgtctcgtatggccttgcatttacctatgcaggtaacgacaaaaaaaacagttagcaggttattaaagcgttttttaccatactcaacttctacagcttaccaatccaggtaaatcgcttagttgatcattcacttcaacaacctctccagatactggtgagttaatacccctggtggttcccttcacacttacaacaacaccaaatttatttccctgggatacactttggccaacttctgggagctccacagacgcaacataacccaaatggtcctgagagcaaaataaaataaaataaaataaacttaagaaccacaagcccttattctatacgctgaatatggtaacatatgttggacctaataacgtttaagaaatagaacgcatgctctgtgtacatgcatagagtgaagcaaatggatcattcaacacactgaggccctaaaataaaaaaaaaaatgctcagagtgatagaacatctaaatatgtacctgggcatgatctgaaatcccaattgttgcataatcgccttcaacactaacccattcatgagtttcagagtacttcagatccttcagcactgaaaaagggaaaacacgaaagataagtaactgcagctgtgttttgacaggcagcaatgaagctcaaccatgcaaatgaaaaatctagaaccattcaaattagtggcaccctgaaacaaatttatgggtgcttctgcgtatcaccatttgtccaattacttttgcatatctagataataagctcttcccttggctcagttattgtgcgcaattactttcgatttatagatgtgactgtagcacgccaaatgtaactggaattgaggtctgcaaagagtccaatatgtaatttttttgccttttgtatatatgaaaacagaaaaataaatcattatttccaatcatatattggataatagccaatttctcaagaacaagaatttgccattactcaagaagagcctagtggcatgcagttgttatccaatcacaagatggaaaatttatgcttgtgaaaacaagcatcaacaaagatggcatagcaagaacctttgtaggtgcaatttttttacttttcatgcagtgaaaaagaggtggtggctgagactattgcacccaatccaatggcacagaatatcctagaattccctcaaaaaggaatatcgtatactttcaaaagggaatagattttactttttcattgtggatgaaatttagttgagaattttaccttcaggaaatggggcaaaccaagctctcatcttgttatcaagaaaatgcatgtaaagataaccaagagatccatactgtggacagaagaaacaaaagaattagacaccattatgcgacaaaaatagacaatagatttggcataaaacgaagttacctccttatcaacctgctgacacacccagtccttgaacattccacactctcgttgtgcatctgtgggcatctggatgaatgaaaggagacgaaattttatactcctaagaaaaaaaataaaaaaaggaaatatttagatacaataatacatacataagcacgagtcctgcccacaaggcgatgaacctacaaacaaatgtcaaacaaatatgaatattataggcacaagagcattagattgtctatttgaaaatagcacaaaccaaatcatccatgtggtgatcagcatggggagtgctgaactctttaagccgtgtagtgtaactctacatgcccatcgcgtataagcttgagcacatcttcatatgacttgttgttgaagaggatctcagatgcaatgaaatgatagaagtcgtatctatcattcatcctctccatttccttaagaagctccaagcaatcttgcacagcagcttcaatttggaagtacagcatcttctgataagattgtgttgcaatggtgatggctttggctagaactgtatcttctgtgttaccacactccacggtatccatcagcttgtgaaagaataggatatattgtaggtccccttcaaacgtagaaggacgcagccaatcagacgttatacgctacaatagtagggaacacatgttattgttaagaggatgaaaacagttggaaaaacatttttttcctcaaaaacgaaatcaaaagagtagagacagaaacaaaaacgatgtcagtgttaccggaacatcagaatatagcagaacagaactatcggaattatgtttttttgtaattattttcatgggttatcagtacaatatgttttttttcagaaattctagatgaaaatggtatactgataaaaagggtaattcagtagcattttcacccctattaattgttgacatgtagcaatatatatgctaattagttggacaaggtagtgggagtaaatgatactccctccttcccaaaatataagaatctaggattggatggaacatttcctaagctgtctagattcgtattactaggaaatgtctcatccagtcctaggttcttgatatatgggagtgttgtattttattttagctaagtacatattatattgtttgcatatgtgtatgtgcaactactagctgtagatgatacagcaatatatattggaattttctcttttctaaactcagaacctatgatttaattatttgagatatgttgcaatgccgcgagcacgaaatcaagccagaagatttaaatagagatataaacaatgcttgcaagtgtcaataacatgctagtcaaatatttatgcacaatgtcaggcagcaagagtaaaaattgttgggagggaagttattgaattaccggtgaacggttgaagtcggggaagaagtgagcgtaggagggcgcagacttctggcatcgcgaggcaaagcagaggtaaggctcttccagcttgaaagggaggaagagctcctccacatcggcgtggctcgtgaagagggtgtgacgcgggatgtggttgcagttgcagtgatgtatcctgcgccgtgtgttctccacggctagctccagctcactcaaattctcctcctcctcctcattgtctggggttaatgcatgtgttcttcttctccctcttcttgttgccttcatattaggccaatcccctctcttcccacggctttctgaacagattactgacagctgttgtgacatcctcaggaagtcgtcgtcgtcgtcctcccacggccatgcctcctcctcctcctcctcctcctcccaccgccgcatatccttctcaagctgccgccgtctctccgcctcccgccgccgctgctcctcaatgcgcttcctcatgaggcccttgtcgacggggtcacggagctcgtacaggggcactctgatgaacgcgacctcatactccgggatgtcacggctgtcggcgaaagcctcgggcggcaacactcgggtgatgaaatcttctggagggacgtaatcatggcgctccttcagctccatgaagagatccatcggatcggacaaacaaacgagcaaattccgcccccggtgaccggtggagcgagagtgcctggggttgggggtgacggtgggtgtgggtggccgccgccggcgatcggtggaggcggcagcgagattggggtgggcgcggctgatcgatgccctacttttactgaggatggttacgatgaggaggagttggagggcgacgtctgcttttcatggcccagcccgagcccgacccagccaagccagtacgaaaccgactcttgaaaaccaaaatttaaattttcaagcttgatttttaaggttgattttataatacttttaacataatctctttttacattggcttttaagttgttacaaacaaatacataaaaattttatctcctaataaatcgttttggcttaggaggaaatattagcatcccatgaagctctcaaggagttgttgaactgggcttgtatgtttgcttcctgaacgagactatatgattgccatatgtttttttcgtcccgtacaaaaaatagagagtaaaatgcatggagtatcaattaacttgtttatgcaacttgggattttgccacctaccaaaataccaagtatattattctattcctacacatatttctgcaaattttctccaaaacggtatattctactgaataaagtcttgagcggaataaacagacaagtatgatgaaaggtgtctcacagtgagcgactactaaatgaaagaatcttttaaataaaaacaagggtaatgaatgaagtctggtttttaatttatttttttttctttttatttaaaaaaccgattttattcatgacccttgtttttatttaaaagattctctaaatgacaatgccattattatcgtcctccaataaccggattatatccaaaccggacgtacacgtacacggtcattggaggatgataattatgacatggcattttgattggaaagatgtattttagttaaaacagaaaataacaaggttcgtagcataaatgaagtgacaaaacatcttacaggttgggccagtgataaacaaacatcttacatgttgtttgctctaacagggaagaagatgtgaaagaaaatagtggtgagagagacaatcgagtgactctgtctcgagtctggctcgaaccagcatacataaagcgatgccgtcctatggcgatgtcacgctgatgctcaacaaaatttctgagaaatctcaccaagctgaccaggctgtcatcataatcgtcccaattaatctggtttgagcagaggaaaacagaaaatttggtgcttttctttaccatcgactgccacacccagtctcgaaagttttgcttgagagaagtgtttagatcgacacgtttgctctcagcaaggtcatacaatctctcattcatgggctcaatagcagcgactctttctttatccgaggccaagatatatggatgtttcatgattacctcgacgtcatcactgccaacaaagcgaagacatggatggttttgaaacgatcgaaaaggtgcaagatatatgaaaaacttagttgttttcttgagaaagtagtcaagttggatttactaaagtgaagtgcatgcatgctacgtgaactgcttagctagttttgagctattagatgatttgtaacaggagatgtaaaaacgtgttattgtagcaggtcagtggctagcccgataaaagaacatataggctgtgtttagttcccttcaaacttctacaaattccatcacatcaaatgtttggatataaacatggagcattaaatatggacgagagaaaaaccaattgcacagtttgcatgtaaattgcgagacgaatctttttagtctaattacgccatgatttgacaatgtggtgctgcagtaaacatttgctaaaaagaattaattaggcttaataaattcatctcgcggtttataggtcgaatctgtaatttattttgttattagtctacgtttaatacttcaaatgtacgcctgtatacgtcaaaaaaaatttggaggaggaactaaacacagccatactcctataaaaaaaggtctttgattttgtaatatatgataataaatactctagtgcatacaccttctactcttttatcctgagtagtgattagagctaataattttaattgttaaacttgttaggaatgtatataagtggtttctttagcccttgcattaattttttttaacaaaaatgaaatttggagtaattagttactaacccgtattgtacggtcaccttaaatgcttgatagccaagtgtattttctgccccgatttttcgaaggaatgtgcaaaatttcactcgctgagactttttggttctagtatcatcacatggcaagggacatccaccgactatcttcagtagcttgtcctgatcattaccctgaccataagcaaaagtgatggttgaattcatatagttatttccatatcccgccacatgaagtgcttccaaggcttcaaatatttcactacaaaatagattgtatgttaaatttttttacctgagctagatctatcatatgtaatctatgggtaagacattacctgatatttttcctccagcgttgttttggctgttgttttttttcactgctagattgttggtgatctattctatcctctttaaaggagaagcggttcagccgctcataacagacaaaatacttgcataagcttctgttatagcctatgaaatatgctttggcaactcttttgtggttaacttttagtgagcaactttgataactttctgcagtagccagactgtctacgagcagaaaagagcaaagaatgtcatgtggtttatcttctaccaggaaggacatcttgccattaatgaggtttgcagatccaccctcttcagatttgtcatcttctttatctattgtgtatgctattagaactcctccaacgacaagatcattggtggaacgtaagtgttgtggcacgttccactcaatgaattccttctccagcatttggacatgccatggcttctctggatcaactgcagggcaaacccaatgttttagatatatgggttaacttgtctaataaaatcataaaatagttcacagacaagtgtcacgaagcaagatttattagcgttactcattggaaaattacaagagatacttagagaacatgtagggcatctggtcctt

SEQ ID NO: 44217 - DNA, 11884 bp, Oryza sativa
tattaacaaaaactataagtttttacaaatgagaacttttacggtgtttgcatttcaaaaagggtaaagatccaacgctcctcaatcacaggtaccatgttaaaggtatttaagtattaatataggtatttaggtactaatggtaaaaatataattttgctagtagagtgaaaagggtagaattgtcctccaaattataataggtaccgcataggtacgctctacacggtatcagcgtatcttttacgtggtttcttgaagatttacgttgtattcgagttaagtcaccgtagtgttctttgatgttctcttttgcgtagatttctctagatttacattgtattgttataatacgtttgtagcctaattatgtgaattttttctacatttacattttgttccaacgaacacatgacaactcataccttaattctgttaaaaattatagtttgtttctagcaagatatttatattgtgtttcagaaacatgaccagttaaaatatcacccaaggttagcatcaatttaaattatacatttcatcaatttatgatacttgcctccaattgaacatgctatgtcaagttaaccaacaacatatcaacacaagtagtctgactcatggtgagcatgctcacaaacaccaatatcatacccgctagataaatatgtcagacaaacttcatcaacaacagcctttttacaacaaaaggtcataggttcttttccgtttgacctcttttgcggcatttcttctttcagcatatgattttcttatgctaaagcctttatcccaagcgtacttgttgtagaagtgaattccttcatcctcactattgaatgtcttgctgacaatttgttggtactccaacaattcctcaaccgatatccctgtatcctccatcagagcttaaaacctacaagaaacaacatttaatttttagaacaccctttaccatcttgagttaatttataattttaactcaaattgtacatagcaaattgctttgtataaacaaatctacaaaagctaatttagtgtacaactaatttgcatgcggtacatacgaaagaatagtgcactgcattaacaagaactaaactatgtaaataagaaaattcaatatgtgtcaattcaggccctacccaagtaaacttagggatccatgaactcggtaaaaactataacaattgcgtaaataagcataggagatcttacctatgcacttgttacgtacgtgtcaatcagattatgtctcatattcaaacacaagacagtgccaatgcttctccctcaattatgtcaccaagcaagttcacctattcaaaccctaatatgaagaacatattaggatatctctttttgatcccttgtacgaagaaatttgtgagctacataaataactaatcaactacgtaaataagcataggatatcttacttatacacacacctgtacatgtcaattagatcttgcctcctgttcaaacgctcaaccataccagagcttcttcctcaaccgtgtctcctcgtgggtacacccgttaaaacactagaagaacaccattggagaagatctcgtttaatataccacaaattgacaaaaattctaaatcccttatataaggaacttatgaactatacataaataattaatcaactctgtaaataagcataggataatttaccgatgcgttaggttgacgttgaccaggcgatctagtctcctcttcaaccctcaaccatgccaaaacttttctctctgtctccttttggcgaacctgtctccttccagtgaaacatccaaaccctagaacaagaacgaacccaagggaaagaagaatggagatgcgatctgttacggatcaatcggattgatatccgtgatttactcttttctctgatggcttaccgatctggatactgacttaccgatctgaatactgacagatggatgttagtattcaattaacgtataatgcccatgttttacaagttaattactccactgccatcatgttacaatatttttgttccgtaccttgcccctctcttatcaatggttcacgttgttccacctccaagtacctcgcaaacactgtaaaagatctctttacaaatagcaacaacacaggggaaaaaatgaaaaaagctcaatgagcaaactgttatcaggctaatggcgctatctcatccctcttctagacaacgtgtcggagcacggagctcctctagtgggaatgcaagataccttcccttcagagttcggccaaggtgcaggttctaagcttgtggccaggatgcaagagaaagaaggtgggacaggtggtttatataggttcgggctgagaagcgtaataccctactcttatgttcttactctatgtgatgatgaacaagatttacaacaggtgtagggggaatgtgctaagtgggagtgtatgaacttagtctactccagggagtcgaacttttttttttctcagagacatggatcctccccatgcatgcatgcggaagtgggacccagtacataggggttgttatgcttagtcttgtcactgtccctccaagtaggctggtcagatgggacgggcttaccaaacggctgacatgtggagcagggctgcaaaagtcttcatcttagttgtccatcagcctacctattagccaccaaagctaacaaagggggagggggtagtggggtgatagttgagggcgtgccacgtcgcacacctttttctccaggaagacgtgggcgtgtgagaggtagcatgcatggccacgtttctcacattgtatgtggtctgctatcaatattcatatcaccccgcaattaatgtgaaatggtggggtaaagtaatgcgcatgacctagtcaaatccccttaatggggcagattcctttgagacagatttctatattcattgaaccgccgaatatagtccctcaaacattcacctgggttgagttaaattgtgaaggtcttcctcgatcgcgtggcacttgtatgtaccctgaaagttggcgacgaactgagatcgagcagggtaggagatgaactagccatgatcgagcagatcctttcaacacagacgacaagtagtttgcgagcgcattgtcatctgctccagcagcgtaaagaaccgtggaataaacatggaggaattcctcagggacggtgcttccatcgctcctggttagaatttttcgatccaccgtatttctcgcaatgttggagtgaacgctcggttgtcgtcattattgcgtcgaggtgaacggcgctgatgtcggtgagcgttgtcttgttctcgtcgttcccgtcggcgcccgttcaagtggtcacgtaaatcgcgattatcttgaggggtggggtcccctgacgaggtcctcgaggtgaggtattgggaggttacgaccaggatctcagctcgaatgttcgttggggtcttcttcgacactgccgtcgacgtgcacctcttctcctcgagctgggagttgaggaggatcttgagccggaggtccagtcgccgccgcaaaagcactattgagattcaccattgtggatcgtagtcgttcgacccgccatcagggaacatgaccggatcaaaagggctctatcttaatattgagttgattgtgttcaaatgcttggcgggagtacagatgggatctgtggtcgcccgagcagttggattttgattactcggactactccctcgattacgttcacctttcgtagagtattaggtgccgaggactctagatcctccaagctatgtaaaaccgaggcctcgtgggggtccataccaatgaatcccgaaacggtcaggagctccctgggctctgttcctatgcaacgcttcgagtttgaactcgtcgttcttggatctgagggcgtggaggtttggtggcgtcaaggaagactttgcagcctaagagctcatgtcctcttgagtcttgacttatggatcagacaccaggtggtcttggttggtgaagcacgctgaataccccgttccttgcaggcttcgagttcagctctcacgtgttgcaccaccttgcagtccgtaaaagagtgattggtcgtcttgtggatgacgcaccaagtggtagatcttcgaggagttgtccttgccggcgcctgattcccagcaaatagatgatttctggccgctcgaggctacttctcggatgtcgtcatagtcgatgctctcctttctcggatgttcgtcatagtcgacctagttgcatccatgaggaaagcgagtgtggcggcggactattgctgcttgtacttgtcgccaacgaagatctcctacgaacgcaccatctcctttctccctaagattttcgccgcgaggtcctcgaactacctcatggttgaaaggtgcttgaagttaacgcgcatggcgtccaagcccgaatcgacgacgacgcatgccgacgggcatgccttgggcatccttgtgctcacgaggaagatgagtgtgtccatcaagctagcatagaggatttggggacgattcaatgaaaatccatgggttgaacccattttggacccaaaggtatatgaccgaaaaccagatcgatccaatccactttcagcaaagtccaaactgccccaacccaacagcttcgttagaccatttctacccaaaatgaaaaccaatccattataccaattcccacccaacctattagcaggcctatccacaatgcccatgcatgcatatgaaagagggacccaatacacaagggttggtttgcttggtcttgtcgctgtccctccaagtaggccggtcggatggaatgggctcacctactagctaacatctggagcaaggccgcaaagtcttcatcttatttgtccctaggcccacctatcaaccaccgaagctgacagggagggcttggggtgatagttgagggcgtggcacatcgcaaacctttttctccaaggtgacgtgggcgcgtgagaggcagcatgcacaaccacatctcctatgtcgcctatgataagctcacaagatttgtatcaccccgtaattaatgcaaaatgataggataaaataacgcacaagacctagtcaaatcctcttaatgggccagattccttcggggagacctcgagtcctgctgctatcctcgggggctcggggccctaatccacccaggttagacgtttcagccccggggtctgaaggacttgtccacgggctgttgtcttcctcaggtcatcttcgtgagcttggggcaaaggttgatgccgtgcgccatcttccccttgagacaaagtggggctcatagtgacccaagcatatgataaagtgaaaacccttgttcccacttctccgacaaacaacatcaatagcaacaaccgtggtggagcttgacataaacttaagaggggaaacattatataagcatgtaaagagtgttcaaaatatcaaaagttaaaacaaagtttctcttactataggacaggtatttaaaaatgtaaacgttttagtaaaaagtgtaaaatatagtataatgtcgacaagaaaatattagtagcgtgaaaataaaataaataatctatgtacgtcctaaaaggaaaaaaaaagaataagtagaatcaaacccctaattctcagggatgagacatccgccagctaacctacctatcaaatctaggatgttgcagtgttgcacatattactatctacatcaacttgaaaacactggaggggccactgcgcagtttgacctccattatgctctgccactggcaacaacacaggaaaaaaaaagaaaataagctagatgagcaaactgttatcaggctaatggcggtcatcccatctcacttctagacaactaatgtgtttgaggagtaggagattggggagatacgcaaaacgaggtgagccattagcgcatgattaattaagtattaactattttaaatttcaaaaatggatcaatatgattttttaaagcaactttcctatagaaaatttttgtaaaaaacgcaccgtttagtagtttgggaagcgtgcgcacggaaaacgaggtgctttctcaccctatctaatacaaacgaacgcagcctaacaacatcatcaaagttctggctaccaaagaaaaatgataacagcagtgaacagtattttttttggtttcccctagtaggccaagatcaactgcattatacaacaacatatattgtgacaaaattatcagattttaatttgttgcataggaaactgcataagtaaaatgtagatctagattattaaccaaccaacaacagaaaaagggtgcatttgttgttgataaccaaatggcaataagaaaattgaattactattacacacagagtacaacagccaacttttgtttatagttgttcaaggcagcaccagtcatttaacacacacaatcataacaattaagaacaatccaatcttggcatttgaagcaggtgtacagttctgtagcatttctctaatatatataacatcaatatacttttgcaactaagtcctttcaattcaaaatttcaaactttcaactccaacttagaacattcaactcattttcaaaattccaaattaataatttatttatcgttttactataaaagttaaattaaaacgctaagcactaggctgcgcgggggctgagcggcttacggttgcggcgcatactccctcgttccataaaaaaccaatctagtgtcggatatgacaaattatagtattactatgaatttggacatccaatattatgttggtttttcaaggacggaaaaagtaatgtgttactaggttggttttttatgggagagagtttgcgcgggtcagaccgatggatccgcatgtgaacattgatgcacgacagagtatgaggaatgcatatgaacctggaggcatgtcggcggtaggagattcagtaggattggcaatcccttctcctctgtgactgtgccgccaatccatttcctcgtcccgtcgccgcgagaacccatccctgcatatacaaacaaagaggtggccaacgttaagacgaagaaacaaagctgcatccttgacgtcccggacgagtgagtacgtgcatgcttcaagattcaagagcaagattgcactcaaagatggaagaggctgtaccatgtccttgttgttgtctgtccttccggtttgcttctccaatctcctcctcctgatactcctggccttcggaagtaggtgctcccccctctttccggtggatgcaatcctggttctggttgtggttggtgcccgtagtcgccgccgccgcgtgctcctggcggccggtatttgcctcctcctcctcccgatgagtgccagtcgccgccgagtgctcctggcggccggcgttcacctcttcctcctcccgagaagatgtgcccttgggcggcgcgcgctcctggcggccggtatttctcttctcctcctcccgagctgtgagattgagcggcgcgtgctcctggcggccggtatttttctcctcctcccggtcccggagctcgattcgtgtccatagtacgtcctggatgcatcatttcttggttagtacaagactacacagaaagaaacgtggagaaagagacgtacgcgcgcgccgccgcggcgtggtctccacggcgacgaaagatggagcctcctcgccgggcgacgcacgtgccggccggcgaggcgagaccaacacgcagtacgcacgcacgcacgcgcaaccgcaaccgcaaccgcaacggctcaggatcgatcatcgaacgcgcgcgacgggcgccggcggtcgaggagacgacgacgcgcgagagctaggtgggggtgggaaggaggatcgatcggggccgcacaccctttcctttcgatattgcttctcctcctcctccttgccttgattcttagcttccatcgctactccctcccccatccctatcattttcttgctcctcctgtcctgccaccctaggtagacgacgactactccaactggtttgcaaatctgggatggggagaggccgagagaggaggaggaagaggaggaggaggagagaacccaaaaccccaaacaccgaccacaccaccctccaccaccccaaggcttgcaggagacttctctctctctctcttcttcttggtaacgagacacatggcgcggatgaagcgaacagcctttttcttgcttgtttttttgctaacaagggaaagtgggaaacccaagtacagaccagcataccgcgcttggcccccgttgccactctgctcccctcgcagtcacaaggactcgattttgaaattgtatccattttgtcatgttgtttttttaatagttttaaaaatgatggtgaagatgttgtacggattttgtccagtttggtttaaaatatacttaaaattttcaaattttaaatttatggtcaaataattatgcccccctttgttttttcctcacataaatcattttttcacgttgagggatatagtcacttttttaaaaaaaatctaacaatcgacttgtggtcaattaacagaatgagtatagaaaaaaatcaaaatgaaaactcgatggcatgtagagaataaagcaaaaaaaaattaaggcatagaaagaaataaatgaaaattctttttttcttattaatatatatttctgtgccacttttttctttttttctcttttggcttaggccgtccttgtatataccctttttcttattaatatataccatggaggcctccctcactgtgttttgataaaaaaaataaacaaaaatgcaagtacataaggaatttgctcaacaataaggttggattcgaatgtgtagatttagtggcgcggaaaatacaacatatgtttcgctcatggtaaattgagtatgaaatattataaattaaaaaaatgaatttgtttgattttataaataaacttctattagaaaatatatgaaaaaaatattgtttagcagttcagaaatgagagagtagttaaccggataagctctttagaacgcaccctcacatatgtttgatctctaaacaattccatttagtcttaccaagttttggagaaaattgaaaaaaaaaaaagctccacgagtaacattttttgaactgaaaatttcaagtccaaacatgtgtccagttaaaaccggtcttaccaggtacagtacttgtgttttaaaaccttgattagcactgataccatttctttattaaacataaaaaaaattcatgcatttgtcctataaaaaactggtaattcgttggtgtacacacggtacattgcgtctgcatgcaagttatttcaaacgaagcttagattcatagcctgtgtttagttacacgctaaaattgaaagtttgaaaaaattgaaacgatgtaatagaaaaaatttatatgtatagaaaaattcgatgtgatggaaaaatttaaagttcgaagaaaaaaaaagttagaataaacagggccatagacaaaatagtaacctgagccacacgcccacacctacacacatccacaccggcgatgaggatccgcatcctatgcctttgctcccaagtcccaacggcaaaatttgccttaccttcaatctgaaccatccattaatggatcaatgatgtttccattgcccatgggacccacctccactaacactaaacaagagaagatacattgaaggaaaagctactttcctgcttaattaaaagaaaagacttcagaaaattaaaaggaggtggagattggaaaaaaaatcactgtaaaaaaaagggtttatgaacatatatacatttttctacgccatttgtttgacgtctcctctacaagcatccttgcaagtaatgaactgtttttttttcactgtattacttcgtaggagtatttcactatttacttcttgtggacaattttcctacttcctctgtttcacaatataagtcattctagcattttccatattcatattgatgttaatgaatccagatagatatatatgtcatagattcattaacatcaatattaacattaatatgaatgtagaaaatgctagaatgacttacattgtgaaacggagggagtagtcactatctttcattgtttactttttgtggacaattttcctagtcactatctgctttagtttcttttatttttcaagttaatattaatatatagagttcaatatcgtgtcttgttttaattaattgagcaggaaacaacaagttctttccgcgtactccccctcagaatggtagtcgaggcaaatagtagtcaattaaaacatgcatcatcctttgatctattggtctctcacccctcttcccgggggcagttgggatggcagagttgcagctttttcctagctagcgcagtcgcgtcgtgtggagagttcgatcgtgtgaaaagtttgatcggtgcggtgcagcgcggaagggcgcgtgcatgccaatgtgccatgccatgcgcggctcggatttagggtgtttagtcctataaaaaaccaacccaacacattttacgaatttggagattcgtagtcctaaaatatatcacatatagttttagattcgttttttaggatggagggagtagatccgtggatgaatgcgcatgttttctaagccccataaacagtgttattttcataaaaaaacattactctctctatataaaaataaatttattaggaaactttgttaaatttatttcaaactttataatatttaaataattcagttgtaccctcgaatagctatttattcacaacaaatcatacagtagttttctatagttggatgggcattcctcgaggttccacaaaatgaagaacacttctcaaggcaaaatatccagtgaagttttagcagagattaagttaagaggttaaggttacggtgagactacctttatacatttgagatttgacagctcattagttttcttgaccataattaaaatgaagcaacaaatacatgaaataatacaggtacaacctagtatatcaacttgtagcatttcaaatgttgtcttaaatatatacacttctctacatacctgtcataacaaatatctcattttatttcttcacctacttactgatcatcttaactactacttatacaatacagtagcaaatatttttttaccttacctttaatactaacaatgggtaaaagtagctataaaacggggcagatgtaggagttggattggaaaattggtactatagaaaacttatatttaatttatgaacagactagtcgtttatatttcggagaatgggactagtataagcatttctaacttttgactcagcagtaccatccatttctactcccacaatgaccgagagaaagctgcaaagcttttgcattaactgcaggggttgaagttcatggatccctgcaataaaaagaggaggagagattcacggacgggagtagtatggtcagggatccagggatgttccatcagtagttccatcagaccctgtttgatcagaagaaaaacaaagtgactttaaatcaaaggatttatatagtattcaaatcatatagaaaaaatttctatttggccatttgattcaaaggattgagggtccctttaaatcgcaggaatggaaaaacggaggaataggaaaaacgtaggattctgacaggaatatatgtgtaaaacagaggattggaaaacacagttaaaacatagaaatgaccgtttgattggaccacaggaaaaacacaggaatcgaatgagagagatagacttaaaggaatttttccaagaggttggacctcttgctaactttcctccaaaatctctataggattagccattctataggaattttaaaggatagtataggattcaatccttt

SEQ ID NO: 44218 - DNA, 10777 bp, Oryza sativa
  unsure (1)..(10777): unsure at all n locations
tcattttcatttgggctcatgttatacaaatcataccggccctcttctctattttagggcttctttggactgaactattttcaagtaaaatctaaatgattctaatctttagaaatgcttccctattagctcctttggaaaaaaaagaatatatttgagaaaaaacctatggacttgctctctactacccaattagaccatccccaagccagaaactatacagtagtttccatacttgtcatgtaatatagatactatgtatagaaactatctatccaatggatggtgtcttcaaattaaattctcatccaatcatctctattctctctcttttcatccacctatccatttcttgcatgagaaatggtttcttcatttttttacatctctcatcattaactctcttgccacatcatagttttgtttacgtggcaatgtattaaatgctatggacaatagatgatatggagggttggggatggccttacagagaaaaataaacgtggggtctcatgttatattttcctttgagaaatctcatccccccatttctacagaatgacattaaggggtgtcatgaatttaatcctttattagcaaatgtttactgtagcaccacattattaaattatggagcaattaggcttataagattcgtctcataaattagtcgcaatatgtgcaattagttattttttagcctatatttaatacttcatgcagatgttcaaatgtttgataatttataacagacattatcttctcagctaatcacaactcttcactattcagtttttccacatatctccacttcttatctaatcacagctctctttatttaattatacctattttttaatattttctctatctcataatataagcgatttttggtggacagacggtctgttcagattcattgtattaggatgtgtcatatctacagaaatctcttatgttatgggacggagggagtaacagtatacaagtttaaaagtgattatattctgggtgggaggaagtatggtttcatgtgacttactggggtgcttaaataaatataccagtgcgtaccgattagattacgaaatcatcgttgctcgaatatttccccgtccgctgtgcgtcgactccgactgctcgtgtgttcgcccgccgccgccgattcctatccatctcgcgagcgagcaggggcgccgtcgttcgtcctgctgcttccgccgcatccatcctggtgagcacccatccgttatacacgctctttccgatctctctctctacccacgcacttctactcgaatttgcgttaaaccctagcctctgttctgtaaatttgccctaaccttaatactaataacaatttgcctttactgtttttcttccttcatcttagctctggggggatcgatttcgtgtttgcctctctttagatagaatttttcccccaatgttcgagtgcatatattggtctggtcgggcaatcccttttatcttccttcattcatttacctgaaaacaacggcgtatcgtaccttttgcttttccctgtgctgttgtgaatacaagtgtggaggtcactgcaatgctgtgctgttcgtgaaaattgatgatgccactctagttttcaactgtcgatgtgtcttgatgcttcagtctctgatcattgctattcttaccgcttacagtgctaaagtttgtaccttgccttggaacattagtcatggagagtcagagaatgacctggctctacgatcgtcaccactccttgaaacataataaagctgaaagacaagccattctatcaacttatagattagcaaaacgtccaaatctctcttcagaaggtatgattggcgaaagttgcattgtgaggacaaattgtttcagtgttcatctggagtctttggatgatcagactatctatgaatatgatgtaagtttctgattcacataacttgtctataacatgaaatttatttgcgccattagtattcgtatctgatgttatttttatcaggtatgtgtcactcctgaggttggaatcaatcgtgctgttattagagagttggtaaaacagcagaaagattctggtttgggtggccgtcttcctgcctatgatggaaggaagaggctatacacatctggtccattgccatttgattcacatagatttcttgttctgctggatagtattgaagacagtcctgaagagtcaaggcacttgagagtgagagattttgtggtcactttaaaatttgctgcaaaaatttccttatggactttacgcaagttccgtggtgggaagccaaaccgagaaagtcgagcggccctgcgagcacttgacgttgttctaaaggaattacccactgcaaggttagctttcgttctcactgtgttccgttttccgtctttctgtattattattattcccattcaataattttgcatattcaggtatacccaatttgctggttcattttactcacctaacttaggagaatgccgacaattgtgtaaggtcttggaaagctggcgtggttttcaccaaagaatacaagctactcagatgggacttcaactgaatatcggtcagatcccaactattcatcgtggttttgtatttcagacctgagaatgagaatttctatgtcgccccttctgaaattgatcttgctttgattgagttgaacttcttataagtaataaggtacaagtggtaatgaagaaaaccgtaagattgttcatattgaaaccgtttcatatgttgtgtattaggaacacatgtcctcaataattaccgttcagtataaaatatggttacatgtttgtaccatttccgtaaatgcttgaagctgcaatatgaagtatgatacattgcagaaatcttaaggtttcctaatttatttctacttttttttgggaataatattttatttctactttaataagctcactagcattttatgcatgctaagggccaagaatgcatgttcactgtattcctatatacatcatatagtgggataagtacgtcttgaacttgcctctggtctttttccatgtcttgaggaagtttagtactctattgcagacgtgtcatcatcagtgttcatcaagcctgtacctgtggttgactatgttgcacagcttcttaacgaggacatcttattagacagaccattatgtagcactgagttcttgaaggtcaggtcgttttgtcatcctatttaatcacaaactgatcattgctattctgttacttagtacttgatttaaattcctgtgttcactccattacaagattcactttttttcccctctttgttagattaaggaggctctagaaggtctgaaggttcagattaatggcattttgttcaacacatatcatgtacaagaccttgtccatcaagcagcaaggtatttactgtatgcacttgctttcacacataaaaatattctcttgtgtctatagttctgctctaaataggccatctatgatgataataggttaatgctattttggtttttcctgcaacagttttccagttaactttagtattcagtacccatctttgccttgcttgaaagtggctcattttggggagacaatatttctgccattggaggttagtatcctgagcgaacatttattctacaatatccaacaatattaagaatggacacacactatcgtcttataaaaactgcttcttatcaccttctgtattctaggtctgtaaaattgctgagggacaatgtcaccagaaacagctcaatgcaaaacatatggctgctcttcttcaggtagctcgacagccccctaatgagcgtgactacaacattctgcaggtaacctgatacaaaaatttctacattcagtttatgtttgtttaggatttcttttaaatattttagccatgtcaataacattaagtggatcagttcaatctgcaaacttccacaagttagttataaatatcatatcatgtcatatcatggatttttttcgatgataatcaaaagacctacatgaggatgtgcttaaggtgatcatgctgtcatccttatgcacaagatttatgttatgctattaacatgtcatgagcagtgagcactagaagatcatacatatttaggagtataaactggcataatctgatctaaatgtggcacctaagccctttcgcaaacaacctaactcctagagccaccatagcagatgcttgaatacgtgcatgtatacgtgttgggaagaggagagtggtccttcactgattttttttaaaaatatttttggaggcaaccctaccactccgcctcagagtgagtatgggtcttatgggtggagaccttttatattagatggaacataaaaattatactaacatgaatgaaggcaaaaggtattggtttgactcaaaagtatttggggctaaaccggttgcctcaaatttgcataccccccggcttggcttaaagaatgatattgaggtaaacgaacatttacctcaaagtactgttcagaggctaacacattacctcagaatttaatttgaactttgaagggaaccaacttgtatgagccttaggatgcacctctgttgtgttctttgttgtagtgacatttttcattattgttagatttttgagattgtgcacacagatatttcttgtccatatgaaaataagctgtttgtcgcaccacttgtaatttgttttgtgatcttgaagttttattatctactatcatcaggcttcagttttctttatcatggccattgactattttcatgcatttgacatggcatatcaacaacccaaatttgcttaacaggtgcgattctaatatgaaaacagattatttaaagtaggccaccatatgcggattaaagtttccagttttacatgtaattagttatcatgttcttttggaaaagaacatattatgctctagattttcttatcatgttatgtctttggttaccagactgtgcatcagaacaaataccaggaggacccacatgctaaagagtttggcattaaaattgaggaaaaacttgtatcaattaaatctcgcatcctacctgctccttgggtatgtcttaacagtcatttacatatgctgattgcgatgtctgttgcatgtgttatgctgtaggtctgacttttctttttctatcagcttaaattccatgacagtggcgagacgacagaattcttgccacaacttggcatatggaatatgatgcataaggtactgaggtgacatatattgtgcatttctccttccaaattatttgtttttcagaactgttgtgattatattttacagaagtttctatctttggcaatattgcatacagctgcaaattaattttatggtaatgctttgttgtagaaaatgatcaatggtgggagagtgaaaagctgggcatgtgttaacttttgctggagtgtacgggagtatgctgctaggaatttctgttatgaccttggctttatgtgccgagaatctgggatggtaggttctctatgacccaaaaggtgattccattttttttacctcacagttattcacaattttgacctttcatattccctatgtctcaatgtaggtcttttcagttaaacctgtgcttcctctagtgattgctaaacctggatgtgtagaatctgcactcaggacacttcatgacgatgtcatggacatacttagaccacagggcagaaaacttgacctgctgattgtaatattgcctaacaacaatggatctctttatggtataccttttactttgtaacacatgtgggcagtttctttatgtaatacatgtgagcattgactgatcaattaatggtttttatttaatgtacttgtcatccacaggtgatgtcaaaagaatatgtgagacagatattggactgatctctcaatgttgtcttgcaaaacatgttcttaagatgaacaagtggtatcttgcagcgttgcccttaaaatcaatgctaaggtttgttgtgctgtactatttgcttgactggtcattcatcaggtccttatttattcctttggttgtgtacgtagatgggcggaagaaatactgtactggttgatgctttagaaatgagactcccccatgttagggatacaccaactattgtatttggtgctcatgtcacccatccacatccaggaaaagctaatagttcttccattgctgctgtaagtgcacatctcactatttaagacgccgttgcctggaggcaggagtcctgcttatctataacttttaagtgtatatgtgtgctatatgtagcaattgcatgttttatgcaggttgttgcttctcaagactggcccgaggttaccaagtatgctggtttaatcagtgtgcaagcgtgccaccaggagtcaatacaaggtctttttaaagtccaggatgatccggaaagaggaaccacaactagcggaatgatcaagtacgaatgattgtgttaccttttagcatgtgaatactatacttgaaaggtctttgtagtctatgtacataagttttgtcttatatgcagagagcatctcatgtctttctatcgagccactaaacggaagcccggaaggattatattttacaggtattaatctatgtctggcgaattgcctcatcttttcattcttttcattttttagataagggagctttattgatcacaaacgattacaccgaggtgatagaatcatacagagaacactcctggccggactcatctcttctatgtctacatatttgacattattccacgactgctctcttcagggatggtgtgagcaaaggacagctccctcaggctttgatgcacgaacttggtgccatcaaaatggtgaagtttttatcccacattttctttctgaacatttttgtgatgagcactgcattctatttctttgaaatgataaatttgtgccataaaaacaggcgtgtgcatctatgggacccgattataatccattagttacatacgtggtgctccagaagtgtcgccatacacgtctgtttgctgactactataatgcgaatactcatgattcaactgcaaacatacgggctggttagttgccaatttttgtttgctgtactgcctatcttgtcaaacctaaaaccttcttcctaacccctgtgaatttgtccaacttcaggtactgtggttgattcaaatatttgccaaccaaatcagtttgatttctacttgtgtagccaccgcagcacgcaggttgagcttagttcttctttacccaaataattctttttctttttttttcatttgtaacacgctcctagctgattcaaaattttcccattagggaactaagcggcccaggtattatcatgttctgtgggacgagaacgacttcttggctggttctttccaagagctcacaaactacctctgctacacgtaagaatgccacttgttatgtgtttttacatttttgaaatcccttgaccggtttaacggacgagttgtcacctattattgcagctccgcaacttgcacccaatccatatcagttggtaagcacgagcccccacattctcctactatcatttactgtaggaaatgtgcttttcctctagcaaaagcatatatggttacgatatatattcacacctttttcttcttttgcactctgcagtggcccctgtgcactacgctcgtcttctgtcatcacgagctcgatgttacattaaaccacgctcgattggcgattcaacgagccacacctccttgccttctgaagaagatagcagcgcagcctcagagactggcagtcttcttcctataaaggataatttgaaaggggccatgtttttctgctagaactgctgccagcaagatctgctgtcattttgtacgtggtctgtacagtcccacagttcttggtagatttgactgagcagtcaaaactcattatcgttcagcgagattcaggtgtagcagctgtaggattactgataaacattgttcctgtaccgatactttagaagaaatgaattaattatatcttagaacagcatgagtatgttacagattagtggtttcacatttaacattttgtgagtctattgatttgttatcttttttatgtagatgcgtcctgttgattagttttccttttcatggactcaaacaagcaaaaataaaaaatgggtttgccaaagaaacacaaaagttttcctttttaatataatgatgatgtgcagtacgcaggatgcccgttcgagaaaaaaaaaagtttccctttttatttgagggagaatgctgattagttttcctctttcccttcttaatattaatatataatgatgtgcagttctcatacgagaaaaaaaaagttatcccttttatttgagagaatgctccttctccttgtactaacattggggaataagttcactttgtgaccctcaaaagcgatcgaaatctaatccgtgaccctaaactacaaaaccggttatctcgacccaaactcttaaaactggtgcaatttgactctctcggtggttttggagagtggtttcgttgacgtgacgcctacgtggtgatgttgactcagtcttgggtacacgtggagttgacgtggcgcttatgtatactaaattgaaaaaatatatgcgggacccatttgtcattcacaccaaaataataatgtataactattgacatgtggggcccatatgtagtcctctttctttcttcctcttcctcctcccttcctatcccttctctctctctttctctctcctatttctcttcttcttcgtctgcaggcggcggcgggcgctcgagggtccgagtggccgcggcggcgagcgggaggggaggggaggcggcggtaggaggagacgccgatcaccgggtgatgcgccatcccggagtacgacgcccttgatctcctagtcctcggtcaccacgacgcgctccacctgcgctcgtcgggcggattcataccgccgccgcacgccaggtcgccgccgcttatcctcaaaagaatcctaccgtcattaatggcattcccagccttcttctttttgctttgacccagcaagcaagaaactcctccagcgtctagtcacctctaagttgcatgcaccagtcagtcagtcagttgcacctaaaagcctgcctaagctgatagggaaaggtggacaattcactttatacacttcaacactccccctcacgcgagaccccctcaagtctcaagtgtggaatattggagtgggctgcaattattttatttnnnnnnnnnnnnnnnnnnnnnnnnnnnnnnnnnnnnnnnnnntgataccatattaagttgcatgcaccagccagttgcacctaaaagcctaagctgatagggaaaggtgggcaattcactttatacactccaacaacctcaaccacgaacttgaatccgctgctctgctgctgctgcaactgttgcgcttttaagtgtgactacagtgtctgctactactactctgctttgccactacttggttcgcaggagggtggtgagagggagagtgtgaggagctgagagagggagagggattgggatggagttcttggtggctcaagcgctcctccttctcgtcgccgtctccaactccctcctactcccttccttgggtcttgttggtaaaggtggcacgtccgattcataccgccgccacacgctgcctcctaccgccgcacgccgctgctgccgccgagccgccgccgggtcgcctcctcccctcccgctagccgccgcggccgctcgggcccaccaccgcctgcatacgaagacgaagagaaatgagagagagagaaaaagagagagaagggtggaggaagaggaagaaggcaagagggcccatggccccacatgtcagtgggtcccacattttgtgtgaatgacaaatggtcccacacatatttttttaattctagtacacataggcaccacgttaactccatgtggaccgaagactgagtcaacatcgccacgtaggtgccacgtcagcaccaaaaccgctaagggagtcaaattgcaccggttttaagagttgaggggtcgagatatccggttttgtagtttagggtcacagattagatttcgatcacatttgagggtcacaaagtgaacttattcctaacattggagctcctagctagtcccttcttttttaatgtcaagaaatcttggcccatcttgtacagagcgacccagccaagtccagtggcacagcatcagatcaggaaatcttggcccatcttgtacattgcagctcagctcaagtagaggaacaaaagttaagaggaaggaataagttcaccggagatccctcaacttaacaacaagattttttaaggtcccttaaccacaaaactagaaatatgtacccctaaacttgtaccccttaacagtatatatgggtggtttcgctgacgtgacatcctagtcaacaaaaaataaataaataagtatgtggggcccacatgtcagctgcgcatatttcttttcttttcttttcttctcctcttctcttctcttttctctgttctctcttctcttctttagtgaggaggccggcaggtaattgtctgagtcagccaagtcgtgcagcaacttgtggacgagctactcgaaaggagggatgtagtctcgagctgctcaaaaggaatgatgtagtgtcatggtagcgggtcgagaggtcagttagtgttccaagaggttgaggccctagtg

SEQ ID NO: 44219 - DNA, 1723 bp, Oryza sativa
aatagagtacaattattactctaattaataggcgaataaaatgtcattacagaggtagatagttcctctcaatcaataaagatctaagcaacggaaaataagataaacggcgcagacggctccactccacaggcagcttgaccaaggctacacctaatcctccacaccatcagcatcattgtagaactcttcctctgatgaatgattgcaaggtgagtatatgacatactcagcaagccacgcagcaaatatgcaagtgcacaaggataccaaaggatggcataatagggttccatttgcataaacagcatttagcaaacatttcagaatttaataaaacagttaagtaaaaattaaacaatattaatccaacgctatacaacataccctgttgtataggcccaaccattctggacaaccacacccgggtgtacaaatctaatctccaaccaggaatataccattccaaaccaggagctaaacaaattattaccagttatagcatcttttattatgatgagaggtttgagactaatcacgaaagacattgttagacccgcccataaccgcgggcacggctattcgaatagttttactctgatcagaggtgtaccactgtacccacaagacacaaccccacatcatgtcaccatgtgccttaataccaccacggtacctcggaaaggagttgtgacaataccccttgcataacacaatccactacagcgcacctttcctggatcataatcacccccttataaacaaggtatggactccccagcgacccccgtgggcttatctccgccacttctcagtctggtgccccgcaatgaaccatgctatataaaagataaagccgttgcccatgctggcttgtggttggcacggttaatgtttcacaaccgaaactcgtgaaccggtccttaattgccatgagcacgactctcaaaaccatgtgctcacaacccaccattatcaggttttagttagcacattaattaattaaccaatcatgattgtccgtcgtgaactatcattaagccatctttaaataatagtgaatcataagttatcccaatagtgtgctaatgtttctaagcatggctaagcaatcacatctaatatctagctgaaccaatatataaagcccaactagtcaagttataataacccaaggtatcaaggaataaaggaaccaataacaaaaaggggtataacaaacaataggttaattccacccaatgacattcgaaaataaatgcaatagttgaatagaaacagtagctttaaacgggatcaatacgctcaaagggttgtttgggatctgggtgacttgccttgctggccttgaaactcttcaaattcttctcctgcgaaaacggactctctggaaacgtcggaatctaaacagaaaaaagcaaaaacaccaaaacagcacataaacaagcacgaacagtaatgtggatatttttaacatgtagatctcaattttagaaaaatttagagacttgaaccaactaaatccgagctaagatgaattagttatgaatttttgaagatttaatcggattaaaacacttatatggattttaattgaattatgacgcaataatgaattatttttgaaaaggaaaacggggtttattgtgtcagcggctagggtttacggtggaccgggtgcacggcggcggttcacgggaacggacggccgagatcgatccat

SEQ ID NO: 44220 - DNA, 1422 bp, Oryza sativa
ccgtgtccgacccgatgcccaattataaattgtgggttaggatatgggaaggatgagatctgtccgaacctgacctgttttcacccctacgtctatattattgcaatgtgcaacttttatagaaataactcatatccggggcccctctgggtcacccgcgggttaattccgattcccgtccccatcgccggaattatgcggggccctgtccccactcacccacgggtgagaactcccccggccccgcccccgtaggggcgggtccccggcccaacggggaaattgccacaccctaatccggtttcatccaaatttatctcgagtcaatgggaatcatcgttgtagctgaatctgaacttggccttaggccttgtattagactagggccatctcggaagtgtctcccttcagctccacgaattaacctctataaatgtttatgtagaccctctaaaacaattggattttgattagttgaattttgcaaagcgccattcatcatgtctctagctctccgctcaattagtcggcgactatgcattgagagccgccaatagttggtgtgttgatttgcctaatcgattagatttaccacttttattacaactatttctttgtgcttaatcacctattcacaatatttagattacatcctatcttgttcttaaaatgttctctcgttagcattgcagggatcatcaaccacgcgtcacggttggtacgatatcgtttgtggggtagcgattacacgacgtcttgaacttgttctggtcgtagccacatcgcaaacgttgcgcttgatcaaagagaaagctatcccctcaccagaagattgggccacgagagagagcgtcatcaggatcgctccttttccgccactactttctttttagtgtgaggattaagtgtctgtgctgcaagtatttacgctttatttatatttcgatatgtataaagatttatgatattattacctggcttgattcctggacaagaaattatacacaaaatcgtctgaaaaatttggcttattttttggggcgtgacacccacaagagatctagcgaacgtcgtatgctcacatcccttgatagcgaatgagtcgttgacacgtgggtaccacgttacgttccagcataaaaccacttacgaaatcttcaccgattttcgaagatgaagaaagttctcagtccggtttgttttgcggttgagggagaagttcttattagcagaaacaaataaggaaggcagaatagacttgttccccttgattgctgcgagccgcggttccatacttccatccgtgagcctcagacatcgccgccgtgagccctagcctcgccgccgcggcgcgtcgatggacgtcggcgagggcaaggggttcggagccgtggttgatggcgtcttgccaccggagatgct

SEQ ID NO: 44221 - DNA, 777 bp, Oryza sativa
gattattaatttatttcgtattatatcatcaacaattataaaactagtatcacatgaaagtattttaaaatacgaatctaataacaataatataacatacataatacttggtgtagatatcattaatgtaattattaataaaaactatcgagtttgatttttttcttaaaaataagaacatcctataatttgagacagggagtactaatcatttttcttggtaaatgtgtcaaattaggcctctaaaatcacaacccttttaattgaattctatgctccgattactgacaactcggacaacatacagctgacctttgaaaaagggtatattgtgatcgagttaggcccgtgccatgatgggtggttatccaatcatccaggttttgattcaggtcgtggcctgcaagacaatactatagttaagagagaattaggccctggtttgacatttctgatagccggcacacattttcttccatcggtttttcttttgccacgcgtacgtgcatgctgccggttaaaggcccgtttgcttctaagtttagggttccttttatttaataattttggttttttaatatataacatcattaactttttaagatatgtctcatcattcttttttattttataacttaatttatctttaaaacttctttaaaatgtttgcataaaagaattatataagacgcatagtcaaatgtaaatctaaaaatcaacgatgtcatatattaaacaatgcattggctccatctttttcattaatcattttgcaat

SEQ ID NO: 44222 - DNA, 779 bp, Oryza sativa
agatcttcttggcgctgtcagcctgtcacaaactcgcaatccaattgcacttccagcggttgagcaggttcaattcaacatgactttcatcaggagatggtaagttaggaacagattactgtcacaactcacaacagttattactactatcgcaacaaatgctagctgtccttatcctcatcgactggatacttcagaaacaagcataacagtagcattggagcaaaggacacagcatggctagaagtagatgctgctacctagagatatcatctcgaattcatggcatgaacaaacgtcgttcatgcagccatgcaggaataataagctcagaacaggattcaggacaaattcaggctatctacaagcttgccagcatcatcatattataataatcgctttaatagtcagcaaacttgtacagaatatccagatccaaatttccacaaactatatatcatcatcaggaattttaaaaagagaactcggaatcgatttcgcatgatattcgaggacacccaagccaaactgacgataacgatgactaacgctaatacctactacaacaccaggtgctggcccttatttgataacttgcgcctgcgagaattcttaggcagaagcagatgcagcagtggcaccgacgtgcttcacgatggtgttctggaggtcatcctccctggcgccaacgaccttgtcagcctcagcaccatccttgatgaataggaaggtcggcattgcctcgacattgtacttttcagcaacttcctgttggataa

SEQ ID NO: 44223 - DNA, 849 bp, Oryza sativa
cgattttgattcttcaaaatatagttttgcaaatttttacatgaatttaagtagaatttatgtgagtaatttggagttctggctatgatggcacttgcttaaattactacaagtatttacttgttgatataacgtgaacaaaaaataagtatggtgcactgattattctagaacaatgtagtacaattggagtttgaaatgattaagagacatcaccaaatgtactgataataccttcaagttgacactacagctcttggttaaaacttacaaataaatgcatatcattgcgatatttgttgttttagaaagcttcgacagccccccctcctttttttttgtgatggctctacatgcacacacctgtttcgttaacattttagcatatgtggaattcttctgcttgtctttagtcatagttgcttgcatgtcattgataattcatatgattgggtagttatcctttttttattttaagatagtgcaatataaaatactacattagctcactgtttgtctctttaataagtaataactctgttgtttttgctgatctattgtgaggggcttcaaggctccagctatgcagtcatgcatgtatttataccttttatttatttttgcagtccaagcggcaaaggggttgtagaaatgtccacggatgatgaatcagattgtgtggttatatgtcccccaaatgggaaagctggtcatacagaagttatgagtggcaggcatgatgaagattcttcaagagggcaagaaaccccttctactatagactcacatatgaatgggaatgtccaggatggagtgcctgcagatcaagatgtgctgaagctggttgat

SEQ ID NO: 44224 - DNA, 1876 bp, Oryza sativa
tcatctattatttctatattgcagtgtgcaaggcaatgttgtttgtgtatgcacgtaacaagagtgaaactaaggttgaatacaaagtgtggaacttctttcgttctaagctggcatccgctgaaggaaattgtggcctccttttttctgattctttttttattttgtgttctttttttcatgtaggggagcagctctggtgcgaccgtgaagttggcagcacagacgcatttcattgagcacatctttagcgttctagatttcttgagtgttctatattgtggccagaccaacaaggtatccatctggcatacagttttctcatttgggttaagtgattggactggtttattgtatcttgcgattttttgtgttaaaaaatattattcagttttcttgctaaaagcaatctatctcttctgtcatccagatgggaggcctcctgtaattacttatggcatcttatgttagtaggcataattatggaagaactggattagcatggataattaatggactacattaattggcgatggttttggtttagttgacattttccattttaagtataagtggaatgcatcattagggcttctatggacacttgagtacctttgcataaactagctaaaaaagcctgtgctttgcaagttgctgctatggtccatccttagtgtttattcactcaaatcttacagatgcacaagagtccaacttttcagttatttatgtttctgttctgtctcgatggataaaacttacaattttaacaaatatgttcttggttatctgtacttgacagaaataataactactactcttttcactttgatagctcttttctgcttctaaaaggtgggttttccatgaggagatcactattagaagctaattcagaggatttcagagcagattttggatgccggaggatggcgagagtgacacatttcagtaatcccctaaggttgctgaattttgttggtagctttatcttttcctgtgtaatctcccaccaacgctgagagctctactctatgtagttcctccttccaatgtataacgtgagttgaatgggttggatttaagtataagtggaataaattgttagggcttatatgagacacttgaatgctaatctgaatattagaacatgacagtgccttggcttaactatttgtatggttaaatatgaaaccactaagtaattttgctttgttgagttcatttagaaggttcggagggcggcctgtatcactattcactcgagcacatccttttcaaatgatatcttaggatttgcgggagtattactatttgatgtttctggctcaaactatatgcaaactttatttaattgattctaaagttagatttctgtttttgtggcatttcataagctagccaacatatattttttcagctattttgtcctttggcatatcaaggaattctatctatattatatggttcgtcgattgcctattctttttaaaggaaactaatgtgttatgtgtttattttgagttatccacatctaaaggagactgatgtgttatgtgtcagaattgtttgatgtacgtaaagctcagatcatataatttatttttattttttggctaacttgacgttttggaaattattaaagacaaataaaattggacggcagcatttagctcgggcatattactagtgagctgtaatttcatatgtctatcgcatagagtgatattgcatcagagcgtaacatcgtcctgttcttatcgcaatctcccgcggctgaattcatcgccgtagaaataatcaggtaatgttaattaatttaatccacagtacattttatgacttgacatacattatgtccatttataactatgtc

SEQ ID NO: 44225 - DNA, 746 bp, Oryza sativa
tcaataattattaacagtgaaatttggtaatcggcaaagacatcatcggcttaaaatcattatcgggtgtagcatctgggaaacagccgatgggagttatcaagtcgccaatagtcggattcctgctatattcggttaaggaaatcaatctactaaaggaagcttatctctaagtgaccgagtttaaagagaatacggcatggcaatttatctattaattaggaataatttgttagtttctttttatctttaggaaagtgtgtttagtgtccaataaggactttatattttccttttatctttaggttagtttctttcttgtccgacaaggacttgtatcaacccatgggtataaatatgtacacccggggtctatgtaatctatctctatgatcaatacaattcgacgcatcgccaccctttttacttctatttttgttttttacgttctggcggaacttggcacccgacgcggggctgcatcatcttcaatctccggcgaagggataagtccaatgttccgtcggcccaagcaattgtctcatctacatcggcgttatttaaggctgcatcagtacattcgacctcttggattgctctagtttggatgatatatttgcctacatatttatcatatgtctctattaatctagtcttagcatatcaatttagctctatcggctgcttctcattttagggtttctgccgatatcggctaaatcgcgttgctagattagattagctca

SEQ ID NO: 44226 - DNA, 701 bp, Oryza sativa
ccgtgggagaagttctggatcagcgtcgcggtggtgctcggcgtcggtgggctagtgttcggcctcatcttcctcatcaagagaagcatccccccgccgaggaccatcagtgtggtcaagcttcaggttaatttctctgaatctgatcttagagtgtccatgagcaattcagagtttcagactgggtttcttgatatgatcagtgatcgatcactgattcaaaattgtatatatactgattggatgatctatcttcgtctctgttactcgcaatttagattgcattgggtggtgtggctgcggcgaagtcgttccagaaggatctgaaccggattgctgagagggtgcaaggctctagccgacgttggtacaagttcatactgagcggtaatgcctattctgaatttcttgcacatcaaatctatttattctcctcgcaaaaaaaaaagaatctatttattctgaattcttgcacatcgaattctgctttggtggttccatgctaattacttaattgcagatggattatatttgacactagctagtagctttaaatataaatcgcacttaaaatgtctttaataataagacaagtagcaacaaaattaataatatttacataaatttattgaaccaagacaaatggtcaaactttgtagccaaagtcattcacgccaaatatttattatcggagggagtag

SEQ ID NO: 44227 - DNA, 1267 bp, Oryza sativa
ttcaagtcaaatttcaaaaactttcaacttaattgttgaaactttcgacttaattttgaaaactttcaacttcaatttcaaaaactttcaactcaacttgaaaatttctatgtcaaaattttaaaaagttgaaatcaaaatttaaaactttcaactcaaatttcaaaatcttttgactacaaatttaaaactttcaattacttttctaaaatgattggtaactgaattatttatgtttgttacggttttaaaaataatactaataacagtaattaccactaattatcataattagcggcggcagcgcgcggactagtcgtcagggggacggcgcgcctgcgcaagttaagcagcggacgcgcacgcgcttcctaggaacccccaattctttggtaggatagagttcatataatatgtgtttggtttgctaccaatatgctttttatagtgaagaaagttctagagtactaccaaattaggtatgggtattgccaatgcattggctctaatccaaaccaatcaaactactatttaaattaccaaacaattggtatggcacattttgaaatcaatccaaaatggccctaacatgtgcagccggaaacaaacacgagattcaatcgtaaattctactttattttggcactcgttagttgtgcgtttagataaaagataaagttaggccatgaactacaggaaaactattggcacatgactaatgaaattttaattattattataaacttgaaaactcgatttatattaaaatgacttatatatagaaagattacatatgaatgcaccgtttattagtttgaaaaacatgctaacgaaaccggagataaaatttataccttattcagaaaaataatgaaacttcaaaacacaatttaaaatgcatcgtgagcgatttgagtcagtttcttttttataccgtcagaccactggtccgtccacctcccatttcttttcttttatcccatggatttgtttcggtcccacaaactatttcttttcttttattccatgatttcttttattccatgagatttgtttcggtccaacaaaaagtacctcaagttaccggtatctcatggtaccaaatcgtttccgatcgttgtttctaacaatgcccatcctaccgagttaaatccaaatatatatgcttcatatatgtgtccaaattatataaatgttatttaatttagatgatgaatagatatcaaaacgtcctttatatatagtatgaaacagaggaatatgcttt

SEQ ID NO: 44228 - DNA, 11634 bp, Oryza sativa
  unsure (1)..(11634): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaacggctattgggttcaccttttttcttaggacaagatgaccaggcaacagctccgtcggtcgaacttttttgttgtaagttgccgaagtgcctgtggcatacttttgcatgtgctcgagtgcttcgactcttaccccctccaagagttcgagcgacaactcgcgcccctcttcgcccccagagaacgtcacccttggtgagttagcccctagctctattggggtcattgcctcatcgccatagaaaagcatgaacgggctgaacttggttggtcttgtaggggtcgtccgaagggcccagagaacagatagtatttcctctggccatttgcccttagttgccccctccagccttttctttagtgcttctaggattttaccatttgtacgttcggctgctccgtttgactgcgggtgcgcgaccgatgcgaacctgatttccaggttaagcccttcacacatctctctgaacttgtcagagtcgaactgcttgccgttgtcagtgatgaactcttttggcactccgaaacggcaaacaatgtttttccatacaaacttctgtactgctgccgaagtgatcgctccgaggggttcggcctcaatccatcgagagaaatattcaacagccacaattgcgaacttgtacccatttcatgccaccgggaacggcccaatgatgtccagaccccatctggcgaagggccagattggcgcaatgggctgcaactcatactggggcgtggtttggcttcggccatgacgctggcaactttcgcacttcttaatttgctcgacacagactttcaacacaatgggctagtaaactccttgtctaaacactttggaggcaactgttcttgcggcttggtgcgcgccacatagcccctgatgtatctccttcgccatttcctcgccttcggcgaaagagatacatcgaagcaagggttgaagtaccccagagcgatagagctggcccgagaccatcttgtactttgtggctctgagttgcaagcgttttgcttctgcttcgtcttccggaagccagccagtttcaaggtgtttcacaaacggggttcgccagtcgtatgggtcttcgcccagttccaattggtcgattgtcatgacttccaagctgtccatgggcacacttggtgcatataggacttcaaaaaagatgccaggcgaatgtgggccaccaaaagcagcagatttcgccaaggcgtctgcttcctcgttctggcctctaggtaaatgttcgaccgttatgccagtgaagcatttttccatggactgaacggcctccaaatacttcttcattccttcttcctttgcctcgaaggatttgtcaatatggcctgccaccagcttggagtcggttcggattagcaagcaccgaacccccaatgctttcgcctttcgtaggcccagaagaatggcttcgtattctgctgcgttgttggttgtgtcgaactgcagccttgctgcataccgaattggcgcgccgtttggcgaagtgagtactgccgcaatgcctgctcccctatgtgaccacgaaccgtcaaagtacatcacccagggctgttcgacaggctcggggtcgggggcgaatgctgatgtccattcggctacgaagttagccagcacttgagacttgacggcagtgcgggcaacaaaatgaaagttgaaaggggatagctctgccgcccacttgctaagccgtccagtaacttctttaccccagagtatttcgcccaaagggtactgtgatggcactatgactttgtgggcctgaaagtaatgcttaaccttgcgtgaagccatcaccagggcgtaagcgagcttttccattttgatgtatcttgtcttcgctccttgcaatgcttcggagacgaaatagatcggtttttggcctgaatccgtttcttggaagagagcagcactgactgccactggcaaagctgccaggtatagtagcagttcgcttcctgatgctgcgctgatcagagctggccggctttgcaggtattgctttagctcgttgaacgctgcttggcattcgggagtccagttgaattttcctgcgccccggagggttttgaagaagggcaaacctctttcggctgcctttgagaggaatcgaataagtgccgcaattcggtccgcgagcttttgtacttcacgtatgctcgacggaggcttcatttgctaaatggcatcgattttctcgggattcacctcgatgtctcttttagaaacaaggaaacccaacaacttgcctgcgcgaacgccaaaaacacacttctcaggattcagtttcatacccgctgcgcgcaagttgtcgaaggtctcctgtaggtcggacgcgtggtcgaaagccttgcggctttttacgacgatgtcgtcgacataagcttccatgtttcgccctaactgctttaaaggaccttgtacactagcctggcgaaggttgctccggcattcctcagaccgaaaggcatcctaagatgacaaatggtgccgaacggtgtgatgaaggctgtcttagggatgtcggccgggttcatgtgaatctgatgatatctagaatatgcatctaggaagctcatgagttcgcagccggctgtcgaatccacgagctggtcgatccgtggcaagggaaaatcatccttcggatatgctttgtttaagtctgtgaaatcgacacacatgcgccatttgccatttgacttccgcaccagcaccggattcgccagccactcaggatgatcgatctcttgaatgacccctgccttgagcaacctttggacttcggcttttgctgcctcctggcgatcagcggacatcttgcgtagcttttgtttccttggcttggcatccggcttgactaccaggtgatgcatgatgagatctgccgaaacacctcccacttcaacagggccccaggcgaagatatcaatgttctttttgagtacctctaggatgttcttagcttcttcttcgcccatgtcgccccccagtgatacgagctttgtggggtcggcatcgtcaatctgcatcttgactatcttgccgtgaggggcgggctttggcgcgtgtttcgcccggtcatgcggttcagcctcaacattgtgcactgttctgttgattatggccaaatcgccttttgaagcagccgagggctgaagccccttgaccacgatcactcctgccgggccgggcatcttgagcttgagataattgtgatgggaaatggcttcgaacttgttcaaggttgcacggccgaagatggtgttgtagttctatgggatgtcgacaacgtcaaacaatacttgctcttcgcgtctgttttcccccgtgccgaaggctactatcaagtgtgcttggccaagaacttgaactgcttctccgccgaatcctcgtagcgatgtcagtgctggggtaagggcttgggtagtcaaccccatcttggcatatgcttcggcaaagataacatcggccgaacttcctccgttgactaggattcgtcggacctcgaaaccagctatctcggctgagatcaccagaggatcttgatgcgggaacattactccttcggcatcttctggcccaaaaaagatttgctggttcagatactgcggagccccttcgcctgccgaagtgatattgtggaccgttcgcagctgcatcttcttctgtcgcttcgacagttggatcggcgggtcggcccttgtaattacttggatcactctgtgttgcgcatcttggcgctattcggccgggggtgcttgttcttgagctacttcatgagttgcttcggccgctgctccctgctgcgtccttggatcttacgcgttgccacgttgccgaatgtttcggcattgcttcgtggtgtgcgaagagcgtccgtggaaggcgcagtagaggtctttcggaccttcttgcggacaggctgctgatggttgcttgcttgctgagcgtcgaactccttgcggagggcttgcacttcttcgacagccatcacaactttgcccgcacggtcggttctgaacttcctccaggtcatgggggcttgaccttgccttggtggttgtgcttggaccgccggctggggctggcgaacaacaagaggaggtggttcggcaacttgaacttgttgttgggcttgagcaacggcgatggaagccttatcatactcagcttgtattgcttgccgtcgcttggaatcctcttcgccccttgcgaacccgtcaatgatgcgaagtaggtgttcaagcgtctgcggctccttgttggcgatttttcttgtgagttcgccctcatgtaaaccggccgaagcggcgtttatgactgatgcctcagttatgtcttgaacttggcaccgggcttgcgagaagcgacgcatgtacttccttatcgactcccccggcctgtggcgaatgccgagtagatgttgctgcgtcttcggctcctcataggtgcctcgaaagttaaggacaaaaacatcacggaattgctcccatgagtaaatgctattggctggcaaattgaaataccaagagccttggtattttcgtcgccatgagccgtttcgatcgcggactcataaatggagaggaattccttttggtcagtttcgcctgagtagcgtgggacgggtgggaacttgaattggggtgggattggacgggtcttgattcccccactcagcggtagccccttttcgccccttgccctgttcacggcaccttgctgcgggtacggcgtggcgaagggcgaaatcacggcttgcgcgtgaggttgggccatggcattcggctgcccggccccgattggtgatgcttgctgagccgccatgaatgggtcaaaagttggctgtgaccatgttatggcgacctggtttggggcttggtttgctccgaagcctggcgttggtgcttgcggccgaacggttggcgcctgagcagcattgatagagtcgaactgcggtccttgactgcacggcgaagcccccagacctggctgattcgaaggcaaccaactaggcgcaccttgacttgtattcccctccgggcgggccgaaggggctgtacttgaaatgttgtggggttggctgagctgctgaaggaaagcttggagctgcgcctgcagagccgaagccccttctaccaatgtttgcggcacttggccaggcggttgaggatgtacttgggcagcgaccggttgagcttgtagttgcacgtgaggggccggatgcgctgctgtggttgatggctgcccggcgaagtacattggcgcttgcgcgacttgtggcggaaggggctgggtcggcacttgtggatagacttggggtgggacatagccagcctactactggaggattggtgccgaagtgaccttggaccgccttgccgcctcgtacgtgtcacatcttgatttttgtttcaggatttataaattatttaataaattattattagaatttatattaaatgttcattaatttacaagtgaagttaaacgtgggaaataaaatttcctaaatataaagcatggatggatttaatttttattaaattctccatggttaattatactctctggaatattctcggatttttcggagctcaattcctaatttttaatcatacaaagagcatttcagtaattacccacatattaaattaatcattaaatggtctaattataatttttttaagtactttgagtgtccaagtattttcaggatttttcttgaaattatttgagcattggaagtatttttaacaattcaaagatcatttaagtgattattttaattggaaaagtaataaaattctcctcccttgtcttaggctgaatcggcccattcctttccttcctctctcttccgccggcccaacccgagcctgcatcctctcttcttctctcagccaaagtccggttttgctccctcttctaatcaggctgagaaaagaaaagcccggcaagaagtctactttctctccctgcgctactgttcatcttccaactcaggcagagcccgagccagccgtgccgtgcacagtgccgccgcctcctccttccaaatctcgcctccccgttgctccttttttccaatttagttgaggggaaatattcctcttatcctcctctatctttaccccaaaaatcggagctaatcgttgagtatcttatccgaatcgaactcgttttcgagtttatctccaaaaccgagtgtttgatttcccggatcgatttcttgcgggaggagtccgatctcttcaatccaaggctataaataggaccccctagtcctcctctttcgtttgcccctctcccgtggtctcccgtgccccgtagcctctccgccgccgccgccaagttcgccgtcaccgccgtaaggtgcgccgaggtgtgggcaagctcggccgctccctccccgctgtcgccggtcaccggagccccgtcgccggccgtcgtcgttcgtcgtttggttcgagggtgagtaccgttaggttcgtctcgtcgtcctctacgtgtacatgtcctccaaagtcgcagccgaccatccaatctccggcgaggtcgccatcttggtccggccattgatgaggtcatcatgacgtcatcatcgtttttctttttcctgttgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtatattatagatctgacgatctagttgtctcatatatgccccctagagggcctcctgccccaccttatataggatggggggcaggattacaagatagaaaccttaaccaatacggtatctgtttcctaaatcaggactttaggccgttccgtaatatacaaggaaacgtaacacccaagtcatgatctgttacatattacatagatataagttatcccctataactagtcggataaccatgccgtgtgggtatggggtacccataatctccacagtagcccctgagaccttcacagtcggaaagataaccttctctcgaactagattactccaaagccgagtgcttcaatcatcttcgccatggtctcccgagtacttttaccaaatctgaagactgtggagggctgaaaaatatagtcaggtgcatcgactagatgcacctaataggtgtaacccccgactatgtggttaatcgaacaaaccaaacatatagtcaaggaataaataatccaaccaaccgagtggttttgataattatagtcaaccaagcgacttaatattaatatgtagcatatgcggtgtgaatccctgaataatatgatccaagtgatataccgactgttttgtaaaatatgatgaatgtaacctaaagttggctacattattgaaaattcacatagcaaaacagctataaagaagcttgtatgttgtgaataaataaattcccaaagtattgggcatacgccatgcgcacactgctttaacagacgtgctttagtccctaaaagacacatggtttcaccacacctggaaatatatggcatatgtggtgtaaaatccgagtaaataaactcataaaggatttaccaaccgtctagaaaatgaccacaatatataatcagcctaagccataatattggtcaataaaaaggcacacttacgtggcgaaaagcaatgatattgtatccaatcaattgcttaaaaacccaaacagcaccttgacttatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctataaaggatgacgcatgtaacatgctcccgagtaataaatcttctgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagctagcagtgaagatgtaggcgcccaacaacaacgaaagaacagtcggtgatgacaaaagcaaaccgacgatgaagacgtagacgcgcatcaacagtgatggcgaaatccaccaatcatgaagatgaagaaaataatcggcggcgacaaacgcatccaacggtaatgatgattaacggcaacagagatagccgactatgatgacgaagtttcccatcaacggcagcagagttggctatgttgatgaggcttgacaagatgttgatgaagatgacgatgtcggtgatccagtcaatagcgatgtagcagctgatgataacgatgagatcctctatcggcagttgcgtagtaggccaaccgtgaagacaaataattggaggagagttgatgttgttgcccaactcgtctaaaccgaaatatttgaagttgttgaagcagaatgtctgttccgaagcaaagatgaagataatgactcctggagttgactcattggctgattaattgatttcttcagcttgacataaaatttgtcaaattttgagccttatatttgtgtagcccccgactctttggttagttgagaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccggtgccgaagataataaagatgaagtcgctccaccataatgacaaagttgtattgccgtaatgaagtgaacacaagtcggcggcaacagaagcaaaccggtagtgaagacgcgtagttgtgaagataaaagcaccaatcggcggcagcaaaatcagtcggcgacggaagatgatgatgtccatcagtagtggtagaacagcggcataataggccaatcaacactggcagaatcatgcagccatggaagtgaagaaaacagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacagcggcataaaggccagccgtgcaggcggaagcaccagtcggcggcggacgaggcggccggtcggtgaagacgtagacgcccaacaacggcggcataataggccagccgtgcaggcggaagcaccagtcggcggcggcgaaggcaagccggtcggtgaagacgtagacgcggcggcgaaggcaagccgatcggtgaagacgtagacgcccaacaacggcggcataataggccagccgtgcaggcggaagcaccagtcggcggcggacgaggcggccggtcggtgaagacgtagacgcccaacaacggcggcataataggccagccgtgcaggcggaagcaccagtcggcggcggacatggcggccggtcggtgaagacgtagacgcccaacaacggcggcataataggccagccgtgcaggcggaagcaccagtcgacggcggacgaggcggccgaggcggaaacaccagtcggcggcggtcgaggcgagccggtggtgatgttctgactgatccattcctggagcgtaagagataagcttaaagccatgaatcccttttatgcatatctggatctggatcctttgtcgtattccctcgatgacagcagaagtagccgatgtgggaataaagcagtccatcaatggtgacaaaaacaccagtcggcgccagtggaaccaagccagtggtgtagatgatgaagcccattaacagcggcggagtccgccaaccgtataggcgagaacaccattcggcggagacagaggtaggccggcggtgaagtcgtagacacccaacagcggcggcataataggctagccgtgcaggcggaaacatcagtcggcggcggcgaaggccagccggtcggtgaagatgtagacgcccaacaacggcggcataatatgccagccgtgtaggtggagacaccagtcggcggcggcgaaggcaagccggtcggtgaagacgtggacgcccatgaacggtggtgtgaccaaccaaccgtataggcgaggacaccagttggcggcgacagaggcaggccagcggtgaagtcgtagacgcccaacaacggcggcataataggctagccgtgcaggcgaaaacaccagtcggcggcggcgaaggccagccggtcggtgaagacgtagacgcccaacaacggcggcataataggccagccgtgtaggcggaaacaccagtcggcggcggacgaggcggccggtcggtgaagacgtggacgcccatgaacggtggtgtgaccaaccaaccgtataggcgaggacaccagtcggcggcgacagaggcaggccggcggtgaagtcgtagacgcccaacagcggcggcataataggccagccgtgtaggcggaggcaccactcggcggcgacggaggcgggccggcggt

SEQ ID NO: 44229 - DNA, 5673 bp, Oryza sativa
acgcccatgaacggtggtgtgaccaaccaaccgtataggcgaggacaccagtcggcggcgacagaggcaggccggcggtgaagtcgtagacgcccaacagcggcggcataataggccagccgtgtaggcggaggcaccactcggcggcgacggaggcgggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcgaaggcaccagtcggcggcgacggaggcaggccggcggtgaagtcgtagacgcccaacagcggcggcataataggccagccgtgtaggcggaggcaccactcggcggcgtcggaggcaggccggcggtgaagtcgtagacgcccaacagcggcggcataataggccagccgtgtaggcggaggcaccactcggcggcgacggaggcaggccggcggtgaagtcgtagtcgcccaacagcggcggcagcggcgcacactaaccgtggaggcgtgtaatccaatcggccgcgacgagggcggccggcggtacgtgcataaaaataacagatcaaataataattagtgatctgtcaattagaagactagaaaacccaagattaatctaatttatgtaagaaaattagaacgataaacctggtaatggcaaatactagctggtgaagtggactcgtggccgattgactggatagcgagacgcctcgagtccatgaccagcatcaatcgcctcagtaatgccgcttgacttgttctcagtatcctcctccaaaagtatgctagcactggccatgtgcttgtcgcggacggcttgtgtatatttgtaactagttttagccttgatcaatcgcggccagacgctagcaaatattgcggccagaccatctgctcagacttgttgcttgcatgccgtactaaccgtatccgtttaggattttggcaaacaaaatacagcagccgctgattggaaaatcctgatctcttgattcaaggcctctggtagtcgaacttttgatgacggatataccaactcagaataactcgtccaggagcatacatgactagataattccttctgttgacatgttcggaatcgatctctgcaagttgcagcgatcttaggcagcgtgctgatgccggagattgatttcgccgaactcgtcaaggtttgatctaggtttttcctgttgcatgctgacgctttcggcgtgatattacaaatcaacgtgtatgtgtagtgatcttcctgatttgatgtgggccagattcccatgcatgatctcatgcgtgtgcatatcagattggctatggaaccttctggtctcgctgatcaagagaagaactcggcggcggcggagattaaatccatcaaaattgccgagattaatcctcccagggcccggttgactggcttgatctagtcggaagtttttggcaacgttcgttccagccttttgttgagaataacatggcctgggatgaaggtgacactcgcggcagccacagtagattgagtctgacgactcatgaagttaattccatcacacttgacgatgatattctcgacgcacccctacctggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtatattatagatctgacgatctagttgtctcatatatgccccctagagggcctcctgcccaccttatataggatggggggcaggattacaagatagaaaccttaaccaatacggtatctgtttcctaaatcaggactttaggccgttccgtaatatacaaggaaacgtaacacccaagtcatgatctgttacatattacatagatataagttatcccctataactagtcggataaccatgccgtgtgggtatggggtacccataatctccacacctgtttttctaatagattaaatcttcggaaattcataactaaaacatcgtaactcggttttgagtggttcaagttgctaaattcatctaaaatcatgatctacatgtttgtttactttatatgtactgtttatgcttgtttttgtactgtttatttggtttttattagtctttttcttcgttttgcgtgttagcttgtcgtttccgtcgttgcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttggattctattccttgataccttgggatattataatttgactagttgagctttatatatattggttcaactagatgttagatataattgcttagccatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatggcaattaaggaccggttcgtgaactactgttgtgaaacattaaccgtgccaaccacaagccagcgtgggcaacggctttaccttttgtatagcatggttcattgcggagcaccagactgagaagtggcggagataagcccacgggggtcactggggagtccatgccttgttttataaaggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaataaccatgcccgcggttatgggcgggttgagcaatgtttttcgtgattagtctcacacctctcacaataattatggatgttatacctagtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttatttcgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacagtacgcttgatgctgttcttgcatttggcaaagcatgtcttggagtcgtgtcatgttctgtcgcatggcttccatgtcggctttggtttgtgtctgggggtcagagttgacttgggcttgcacagcggcgagcgcagttggggccgctgccagctgtgacggagcggcttggggcaccagcagttggcttgtcggaaggatctccgccctggtctggagtgccctcgccgccgcagccgccttcgccatgtcaaccgtgttcggcacctgcacagaggtagcaggggccgaaggcggtagtgatggcgcaggtgcggaagcagatgtgtcacaccctgaaaatcctaaatttataaattgttgtttaaatggaattattagaaatgattttaaaagcctagaagaaaagatctaattttaaataataaattccaatataaaagtgggccagataaaattttattaaatacttcactttctttgaattgtgttatgcgaagggtattgtcacaatctcttttcgggtacttgttaagtatcgcgacgcatggttgacttgatgctgaggttgtgtcttgtgggtacagtggtacacctctttcacttgtctttcgtgattagtctcatatttcacaccataataaatgatgatgaaaataatttgtttagctcctggtttggaatggtatattcctagtttggagatagaactgtgcagccgggattggttgttcagaatggttgggcctatgcaatgggtgtgttgtatagcgttggattaatattgtttaattaaatactttactgttttattaaattctgaagtatttattaaatgccatttatgcaaatgagactatattatgccatcctttgttatcccttgcatttgcatatttgctgcgtggcttgttgagtatgtcatatactcaccttgcaatcattcatcagaggaggagttctacagtcatgccgaaggtgtggaggattaggcgtagccctggtcaaactgcttgtgggatggagtcgcctgcgctgtttattttatattccgctacttagaactttattgtttgagaggaactatctacctctgtaatgactttatattcgcttattaattagaatattaattgcactctattatcgatttgttggataaatgtcttaactccctcctttcacttgtctttagatgccgtgcttcaagcctgagtacttgttcggttctgagggatttgtccaggagttgtgtacgatgtccttcgccataggattcgggactgcccctttgtatgcccagattcctcatgatcgtgatgaagagaagtgccgtgtcaagatcaccttgaacagtaatcgtgaagatatcccatcggtgatgttcgaggctggagggggaaactatcttcatgcctgtcaggaggtggcaaggatcaccataggagagctctgcgaccgctacagtgatcagttggccgacactgagtatcgctaccatcctctccaaccccagggaagtgactgtggcagctatcttgaacctgcagggattgagaatgatgctaccacaaggcatttggttgagatgctgtgggccatggatgagtcccacgctgaagtcgtgatagctgctcaagatcgcgaagatcggaatcgtggtaagaactgcaagctggaggacaaggttgatcggttggagaaggaattagccgcattgaagggagaagcaccaccacaaaaggccagggttcgtcttaccgcaaggaagagagctctatttgtccctcgctaccagttggcgcctaaggttcgtgtggtggaagaaaaaaaagctgccccagtttcagcggatcctcctgtcgttaacgtaagtgatgatgatggaaaagattcgaagcgcacccattcaaaggtcgagtggggg

SEQ ID NO: 44230 - DNA, 21348 bp, Oryza sativa
aaattagtagaaattaattccccgtcctaaatagttttctcccttgtttctcttcttgtgctcctgtctatgccagatggtgcttactcgcagcaatgggaacggccccaacaacaacaacaacaatggagagaatcccacgcttgcccaagtcctggctcaacaggcacagctcatgaacatgatgatgcagcaactccagaaccagcaaaaccaggggaacaatcatgcacctccccagaacaagttagcagaatttcttcgtgtgaggccgcccactttttccagcactaccaatcccgttgaggctggtgattggctgcatgccatagaaaagaagttggacctgcttcagtgcaatgatcaagaaaaagtctcctttgcttcacatcagcttcatggccctgcctctgagtggtgggatcacttccgtctcaacaggaccactacggaaccaatcacttggcttgagttcactgctactttccggaagactcacataccctcgggagtggtgtctctcaagaagaaggagttcagggcactcactcagggatctcgctgtgtcactgaatatctgcatgaatttaatcgtctggcctgttatgctccagaggatgtacgtacagatgaagagcgtcaagagaagttcttggaaggactgaatgatgagctttcttacccactaatgactggggattattctgatttccagaagttggtggataaggccattcgccaggaggataagtacaaccgaatggaacagaagaaacgcaggattgctcacttcaaagctcagtaggggaatagtcagaggccgcgtcttgctatgggacctcaggcagtgtcacatggagggtcttcgtcagttgttcgtccgcagagtcagttctacaacaacaatgctggcaacaacaaccgcaaccaagctccacgtcctgttgcaactccagcccagcaccagcctgccaagagggagtaaggaaacaagccaggagtgtgctttaactgtggggaaccaggtcattattctgacaagtgtccgaagccccaacgcgtgaaggttgtccctgcacagaacaactccaccgcaccagcgtcaaaggctcgtgtcaatcatgttgctgctgcagaagcccaaggtgctcgagatgtgattttgggtacgttccctattaactcagttcctgcaacagtgctttttgattctggtgctacacattcatttttgtctatgatttttgcgtgaaatcatgggatggagatagaagatcttagatgtcctttgatggttagtaccccgagtaaccaagcactctcatcacaacgtagcccctctgtcagaatagagattcaaggagtaccatttctggctaaccttattctattagaatccaaagaccttgatgtcatcctagggatggactggttagcccgatataaaggtgtgatagactatgccaatagaaaagtaactctcaccagcaatgatggtcaagttgtaactgttcatgcattgccttctgagcctttaaggtcaagtctgaaccaagtaactttggaagagattcccatagtacgggactacccagatgtgttcccggatgatttacctggcatgtcgcctaaaagagatatagaattcagaatagatctggtaccaggaacaactccaatccataagagaccttatagaatggcagccaatgaattagcagaggtcaagaggcaagtagatgatttgcttcaaaaaggatacattagaccaagttcgtctccatggggagctccagtcatttttgtggagaagaaagaccatacccagaggatgtgtgtggattactgtgcactaaatgatgtgactatcaagaataagtacccactgcctagaattgatgatttgttcgatcaactcaaaggtgccaccgttttctccaagatcgatcttcgatcagggtatcatcagttaaggatcaaagaggaagatatacctaagacggcttttaccactcgatatgggttgtttgaatgtactgttatatcttttggacttaccaatgcccccgctttcttcatgaacttgatgaataaggtgtttatggaatacctggacaagttcgtggtggtctttattgatgacattcttatctactcttgaactaaagaagagcatgaagagcatcttcgccttgcactagagaagttacgagaacatcaattgtatgccaagtttagcaagtgtgaattttggttgtctaaagtaaagttccttggacacgtcatctcagccggaggagttgccgttgatccgagtaatgtggaatcagtaaccaactggaatcaaccgaagacagtctcagagattcgcagtttcctgtgtcttgcaagctattaccgaaggttcatagagaatttttccaagattgctaagcccatgacatgactgcttcagaaagatgtgaagtacaagtggtcagaagaatgcgagcagagttttcaagagttgaaaagtcgcttaatatcagcacccattttcattttgcctgatccaaagaagggtttccaagtgtattgcgatgcatctaagcttgggttaggttgtgttctgatgcaagatgggaaggtggttgcctatgcatctcgtcagttacgtccgcatgagaagaactaccctactcatgatcttgagttagccgcagtggttcatgcgttgaagatttggcgtcactacctctttggtactcgtacggaggtgtacacggattacaagagtttgaagtatatcttcacccagccagatctgaacatgaggcagcgaagatggttggaactgattaaggattatgacatgggaattcattatcacccaggaaaggctaatgttgtagcagatgctctcagcagaaaaggctattgcaatgctacggaaggacgacagttgccgtgggaattatgcaaggaatttgaaagattgaatttgggaattgtcagtagaggtttcgttgcaggattagaagcgaagcccactctcatcgaccaggttagagaagctcaaatcaatgatcctaatattcaagagattaagaagaacatgagaagaggaaaggctattgggtatttggaagatgagcaaggaaccgtatggttgggcgagagaatttgtgtcccagagaacaaggagttgaaagatgcaatcttgaaggaagctcatgacactttatactccattcaccctggtagtaccaagatgtaccaagatctcaaggagaaattttggtgggcaagtatgaagcgtgagatagcggagtatgtagctgtgtgtgatgtttgttagcgagtcaaggcagaacatcagaaacccgcaggtttgctgcaacctttgaaaataccagaatggaagtgggaggaaattgggatggatttcatcactggtctacccagaacgtcatcgggccatgactctatttgggtgatagtcgacagacttaccaaagtggctcatttcatcccggtgaggacaacatattccggaagccgtttggtggaattgtatatggcaaggattgtgtgtttgcatggtgttcctaagaaaatagtatccaatcgaggtagccaatttacttcaaagttttagaagaagcttcaggaagaggtgggttccaagctgaactttagtaccgcttatcatccacaaacagacggacaaactgaaagggtaaatcagattttggaagacatattgagagcttgtgctttagacttcggtggaagttgggataagaatctgccttacgcggaattctcatacaacaacagttatcaagctagtctccaaatggctccttatgaagcactgtatggtcggaagtgccgcactccgctgttgtgggatcaaacgggagaacgtcaggttttcgggaccgatatcctgagggaagcagaagagaaggtaaagatcattcaagaaagattgcgtatagctcagtctcgtcataagagttatgctgataatcgtcgtagggatttaagtttcgaggaaggagatcatgtgtaccttcatgtcacgcctcttcggggtgttcatcgttttcacaccaaaggaaaattggcaccgcgttttgtgggatcttataagattgtcagtagaagaggtgaggtctgtcagggttacgggttaggcataccctttacccttcgatatacgtcacatatcggtatggtatacccacgcgcatacggatacttcctgcatattctaaggaaatccttcacgaaatctatagattggaagaatcctactcggacaagactgggtcgttgacgtatcgtataaggtctgataccttcgagttctacttggaaacctccagacctgcgatataaaagggaccccccggggagcctgcaagggatcgaatctcagagccaacacaacccacacagcctacgaagccggagcctgcaaggagccaagccatcaagatctagtcgaaccaactcgactacgatctcgccggatccgacaagttccactgttccctttgtaacctgtgttttccactatataatcccacatcgactggattagggctattacctatcaaggggcctgaaccagtataattctcgtcttttgtttgcttaatgtcgtattacatagatccttgtaccaacgtaccccaataccctctatatccggtctacgggtaccactcgtcgacagtggcgcgccaggtagggggacttggtgctcaaggttctactattatgtcatccagcttcgtcgacaacagcgtcaacaccaacctcagccaagtactccctgcttcaacgatgctggtgtggactcaagtcagtgaaatcgtcttcctggtttacaccacaatgccgatctcaaccggtcccccaatgaccggacacgagaacacagtggctacaagccaaggcgactccatgtcgaaaaattgtcccgccgagacggagaatggagcatcgacaacatccgagctcgagaaggattctgatacggccaaacattgtccttccgacatgaaccgcgagctgacgaagatgacttccgaagccacaaggtcctggtgtcctatccacaaaaccaggaaacacactctgcaagcctgctgggttttcctcaacgtccgcgctgaaattcgcgcctgcaaagaacgtggaattcagcgtacttctccaactcgtgatgtctattgtcctattcacaagacaaagaatcacgacctctcaagctgcaaggtctttctcggcaccatgaaagctccgtctcctaaattatacgtccccatcagggataacggcatggaacaaggagcgactccaacttcagatcgattcgttggggtaatcgatatcgatcctcacgaaccattagtcttacaccttctcgaagactatgggtcatcgacaacgagcgcgccgcgggaggtattggccatcgatgacgttggcatgtcagcgcacgccaacgcagaagcggggaatcaatcgactactccagcccagcacattagggccgttcaagctatactgagggaaactccctacgatcccgttctgaacgatgacctcgagcgttggacagaacgactacgggaatcagtgaccaacctcagcaatgcattcgaagaagccgctaccgcagcgcacccggagcagccaccaattggcgatgccaatggtgaagacccggaacgaagggaatcacctcaacgagctacccctccacctcgcggcactggcgatctctgagatcaaatcaacagccaccgagaagcacgacgcacacgagacaatgtgaatcgttctcggcgtcatgtctcttcatggcgccatgataatggaaatcgaggagaccgctcaaacgaggaccgagaccaggacaaccaccacgatcacaacgatcgcgaacgacgggtgccagacaatattggtcgaggccgtcgccataacgacgatgatgacggagatcggcgccgagacaacagcgggagacgacgacaggattcccgagatccaggccgacatcctcgtaatcgtacgccggaaccaagcgacccattgtcatcgtcatcatccgcgtcctcctcatcgtcaggcagacatccacgaaggacacacgaccgccgacaacccaccgcccctaacgctgggtgtagggctttctgtcgtttcctgcgagatgtcctatggcctgagagattccgacctggagcaatagaaaagtactctacgctgttgaatgatgggagcaccgacccagaggagttccttcaagtctactccacagtactctacgctgccggagcagacgacaacgcgtttgcgaattatttaccaacagtgttgaaaggttctgcacgttcatggctgatgcatcttcctccctactcaatctcttcatgggcagacctgtggcagcagttcgtcgccaatttccaaggaacatacaagcaccacgcgatcaaagatgacctacacgcgttgacacagaactcgggtgaatcattgagggaatacgttcggcgcttcaacgagtgcagaaatacaatccccaaaatcactgatgcttctgtaattcgcgccttcaaatccggtgtcagagatcgctacactacctaggagttggcgacaagacgcatcacaactactcggagattgttcgagattgttgagcgatgcgcccatgcagatgatgcgctaagacgcaagaacgataagccgaagaccgggggagagaagaaaccagccacggacgcatctgagtcaagcaagaagaagaatcgcaaaaatgggaaaaggaaagctcaagcggaagtcctcgcagcagaatacgcgaaccctcccaagcgcccagacccacaaagtagcgacataaagaaagcatggtgccccatacacaagacgaacatacattctctggaagattgccctgttttcaaaaaatcgctcgagaaacacatcacatttgaaaaaggcaagcaagtacgcgtgatcgagaagaacgaggaggcggttcctcacgaatcggattcagcgtatccagactccgacctccacgtttcacacatcttcagcggttccacaacatactcctcaaagcggaaatacaagaaagtggaacgtgaagtctgttcgacatggcagggggctgcacccaagatgaagtggtctgaacagaggatagagttctcggaagaagatcaccccaagaccgccgtcatcccaggacgatatccgatcgtggtcgaacccactattcggaacatcaaggtagcgcgagtccttatcgacggtggcagctcaatcaatcttcttttcgccagcactttggacgcgatgggaattccgtaaagcgagttgacaccaaccgatcaacccttccacggaattactccccaatcatcgtccagaccattaggcaagattacgttgcccgtgactttcggccaagccaacaactttcgaacagagcagatcacctttgatgtagctgaattcgatacaacttacaacgccatcatcgggagaactgcacttgcgaagttcatggccgcatctcactacgcgtatcaagtgctcaagatgccgggaccgaagggaacaatcactattcaagggaacgcaaagctggaggtacagtgcgacaagcggagcctcgacatggtcgagcaaacgcccagcccacccgccacgactgagccacccaagaaagtgagcaagacaaacaagacgccgaaaccggacggcgccatcaagattgttccactctccagtgccaaccccaacaagaccgtcaaaatcggggcgacactaattgagaaataggaactcgcgctcatcaccttcctccgcgataatgccgacgtgttcgcttggcagccgtccgacatgccgggggtccccagggaggtgattgagcacaaactcatgatgcgacccgatgccaagccagtaaagcaaagactgcggagatttgcaccagaccgaaaacaagccatacgagaagagctcgacaaacttctcaaagccggcttcatcagagaagtacttcatccagagtggctagccaatccagtcatggtgcggaaggccaacggaaaatggagaatgtgcgtcgacttcaccgacctcaataaggcgtgccccaaggatcacttccctctccctcgaatagatcaactggtggattcaacagccggctgcgagctgttgagcttcctcgacgcttactctggctaccaccaaatcagcatggcaaaagaggatgaagagaagacaacattcatcacgccgttcggggtattttgctatgttaagatgtcgttcggactgataaccgcagggaataccttccagcgcatggtccagggcgcacttagggaccagctcggcaacaatgtcgaggcatacgtcgacgacatcgttgtcaaaaccaagacaggcgactcattgattgacgatctgcggcaaacgttcgacaacctccgacgatatcgcctcatgctcaatccagagaagtgcacgttcggagtaccgtcgggcaagctgctcggattccttgtttctggcagaggaatagaagcaaacctcgagaagatcaaggcaatcgagaacatgaagtcgcccacaagactcaaggaggtacaaaagctaaccagatgcatggcggcactgagcaggtttgtcgttaggatgggagaatgagcacaacctttcttcgctcttttgaagaaacaagacaaatttgtatagacacaggaagccgaagaggcattcgttgcactcaagcgctacctatcaaaccgccctgtacttgttgctccccaacctaatgaagaattattcctctatatcgctgccacgccatattccgttagcaccgtcattgttgtcgagagagagaaagtacaacgaccagtctattacgtcagcgaagctctccacgacgcaaagacaagatacccacagatccaaaagctgctttacgcggtcatcatgacatcaaggaagctacgccactactttcaagcccacagagtcacagtcgtctcctccttccctctcggcgaagttgtgagaaacaaagacgttgtcggctgcattgcgaaatgggtagtcgagctgagccagtttgatgtccactttgtgccacgaacagccatcaagtcccaggtactcgccgatttcattgccgattggactatgccagataacaaatcagacaaccaagtcgacaacgaaacatggacaatggcgttcgatggcgcactcaacagccaaggagcaggggcaggatttatcttgacatctccctctggagatcaattcaagcacgcaattcacctcaacttcagggcgaccaataacatagtagaatacgaaggactactcgccgggataagagctgcagctgcacttggggtcaagcgactaatcgtcaaaggggacttcgagctagtcgcgaaccaggtgcacaaagattataaatgctctaaccccgagttatccaagtatctcgcagaagtcagtaagctagagaaaatgtttgatgggatcgaggtccgacacatctaccgcaaggacaacatcgagcaagacgacctagcacgacgtgcgtccagacgagaaccgctcaagcccggcacttttctcgacatccggacgaagccatcagtgaaagaggttagcggcgaagttagcccggacacccccgacattagctcggaggtcaccaaggcagaacgcgccgttgccgatatcgagaccacagacaactggcacatcccactaatcaaattcatcaacagcgaggagttgccagaggacgatatagaggctgagaaaataacccgtaaagcaaagatctactgtatggtcggcaatgatctatacaagaaagcgtcaaacggggtacttctcaaatgtgtctcgtccgacgacggcaaacacctcctcctcgatatacatgaaggcatttgtgtgtcacacgccgccggctggacattggtcgggaaagcttttcgacaaggttttttctggccaaccgcccttaaagatgcatgcgacatggtccagcaatgtgaagcctgtcaattccacaataaacacacaaagctacccgcgcaagcgctccagactatccctctgacttggccgttctcgtgctgggggctcgatatacttgggccattcccacgaggatagggcggctacagattcctattcgtggcgatcgacaagttcaccaaatggatcgaagcagtacccacgggggaaatcaaggccgacaacgccatcaaattcatcaaagggatattttgcagatacgggctaccgcaccgcatcataactgacaacggctcccagttcatcagcgccgatttccaggattactgcatcgggctgggggtcaaaatatgcttcgcctcggactctcaccctcaaagcaacagacaagtcgagagggcaaacagcatagtactacaagggataaaaacccgcgtctacgacagactcatgtcacacgacaaaaaatgggttgaagaactcccatcagtactatgggccgtacgcaccacaccgacaacgtctaacaaggaaacacccttctttctcgtgtatggctctgaggctatgctccccgacgagctacgacatcagagtacacgagtacagaagcactccgacgaggaccaggaggaacagtgggacatcgatgtaaatcttctcgaggagcatcgtgaacgagttgccatttgagcagccagctatcaacaggcactccgccgttaccacgagaagcgcatccgagcacgcatactttcgatcagtgactatgtcctccgacgggttcaaagccaagtagggcggaacaagctctcacccaaatggtaaggaccctacacgatcacacaagtcttacgtccaggcgcattcaaaattgcagacggcgaaggtcgcgagttagcaaattcttggaatattgaccaactacgtaaattctatgtatgactcaatgccatccgtacctgtaagacaccttacagtatcaataaagcctagtcttaggcccatgtcacaatcaaagtgtttttgcccaatgatcccttaccctaatgacacctagcgttgaaacatgtcctcatgtccctttacgccgtcttgacaaggcctccgaggaacctaagggatcttcggctggggacacccagagccgataaggccttgtcagatcctgtagagatgaaagaccatgtaagatctggtcgtgtaagagttctcgccgtgcgtattaaccaagccgtgaaatcagaaatcaactttccaacttcatggctggggactaggatcagagcttattcaaccaaggcgggtcaaaggtccaagagccttatcctccgagaaaattcctccgacgacaaggctaggggctagggagagtgtacgactcaaacggctgactaaagtcgtgaactgagaacgcactcttacacacgacatccagagtaagaaacatctgttaaagatagatttcttttctatttcacaaaatacttcttacagttttttacacaaatctttcgctacattatacctttttcctaagatatctgtcacagggtacgaatactaccaagaaggccaacgccagtccatagactggaagatcttctcggccaatggcaacatcgacctcgccagatggtctatctccgccggagtcctccgagaacgagcaaaaccctcatggagaaagtcgaggtccaagcgcggacgatgatctcgtaggcaagccagcacgtgtcctccggcgtatcggctcgatcgacgacactcctgcttcaaggcctcgtcgatacgcttgccgatgccatcgagttgggcacaggccccgttcagccatgagatgtatccggccaccgactcctcgggatctccgcgaaccattcgaagttctctacagaccctggccatggatgtgcagcaactcttcaagtacgagttaaaccacacctcacgacctcggagcgtttccacagcctgctctttcttcactgccagcatggttctctcgagttccgctacttcaaacttcgtcttccagtattggatacgacgatcttgaccaacaagggcaccctcgagatctgcttaatgtgataacgactaagtcaagctgtacacctctttcgagtacacagttgatctagccgggagggcatcaaggggtgaatggactactaacctgaggaaatcgtcgtcatccctgtctccataacaagggtctggtccacattgtcgggcgacacgtgtggttcaaactcgagaatcggaattatcaccagtgactcgggctgcccgcgctgctagacatcctcgttatcagcatctctacaaaggacaaaagctcccgaggtcaacacacaaaagtaaactagaatgataattgcacgcgcgaaggcggtcagaactcaagttttacacagcatgtcttggaagtacaagaagtcctactcttcaaataggggagaacagactcccctagatcgccgactccttccatcacctccttacgcgtgtcgctggccgccccctgatctaagatctcgcgcagatcgagttcaggatgcgacagctttacacacgcgaggacatgacacgcctcggtgtagatcccgttcgacgtctcctccgcaatcctggcggcatgcttggaagggatttcccccatcgccgtcaccagttccgcaagggaggaggtcagcgagaactcgtcaggattcaccgggatggtagacttgagctgcactccccggcgaactggtgcaggccagtgtaggtgacccgcaacgaaccccggatttccgacaggttgttcccgagttccgacatgcggtcctcgagccccttccattgtcgctcattgccggccaccaattccctcatcttcatgaggtcttcatgggcttcagccaactcgcgcaccagtcagtcagcacgcgcgttcgccagcgctgcttccgacctcgcctctgcaatctcgcggctgatgccgcgagcaccagcttcgaggaggcgccccatcttgacttggagctcctcctaggtgaggacggcaactggtggatcatgacctgccgcgggatcgctgactgggccgctaggcgtcgcctcccggctcccagctgcaggcacgacatccgtcgaggccgcggcaagcgacacgctggaagtccctccggacctggcttgcacagcctttgctcgcgtctccctacgggacgaccacgggtcagacaacgcttgaatggaatcacggaaacctaaaaattcatctacttacttttcgccaaccgtcacaagacgttgtcgtcgtggaggcgggggagacgcgtccaaggcctgaaagacaaccaatgtgaagtaaggcaaaatccttctggctgcgcgatcttgcgacaggataacttaccgagggggtcgacgccttgcgacgatgtccgcttacagaggagaacttcctcccctttgtcggaacattgccaccactagtagtggcagcagcagcatcagacgcctcctttgcgaccttctctttcagggacgccgccacctgatggtccgcgagcggcccgatgatgtcagtcagaggaagagcctacgcttaatcaagtcataaggtgatctcgaaggaaaaatgcgcgatgcttatcggatgcacttacgttgatagcatcatcacgttcggccgcccccttttcacaaaggggcgtggggatgttgctcgccattgtcagaccgctgatcatcacctggccaacacggcgctccacggcttcgctattcagacctgtgaatcgagaaccaaatttcaatgagtcaataagaacgcgaacataagcatgtcaggataaatgcgagaaagatacctcgaggagaaacccgggtcgcgtcctccggtccagaatagttataagcgggatgggcctgagcctggagcggctggattcgcctaccaacgaagtctgcaacgacttcataccctgacaagcctcgtactcggagatcatcgatgatgttgataaacgactgaaggggggctttgcggtccaagacgaaatcttgtccggttgttctttgggaacaacgaagacagggttcgaatctttgatctcaaggtagaaccacctattccgccatttgctgcgagaagatgggcactggaaggagatataacgcgacttcaggccatcccgaagtcggaacccgacgcaaccagctaccctgttggactccatccaacgcagttcatagtaagagcgaaagagatcaagaaaaggctctaccccaatgtaggcctcacaaagatgcgcaaagatgctaagaaaggcgatagaagttcaaaaccaggagaagaaactcggaaggcggaggaagaaaaccgtagagaacataatcttcgatcgtaaccatgtgacccaagatgggctagggattagtacctcctacttccctctccatggttccacggccaggaagggcaccgtcttcctgacgcttcttcagcgacgcactggtggaagatgatttgccgaggtccattgctgatcgaagatcgccggagaaagggcttaggttgatgaactggggtttcttgtgccggcgaagaaggcgaagatcgctcacaggtggaatgttttcaacacggttggcggacttcaaaatggatccccaaaatttctttaaataggcgcactaccgacggtgcgaattccaaggaacagagagagatgcccgccagaaatttctgggtccgttacgctcggcggttttttggacttcagtttaacaattcgctcgtgaccgttgggcttcaaatggcgtgctcgagtacggcctgtctctgcggtcctcgcaccgggaacgacaacagtttcgacacccgaagtcgtgaatggttacacgagctcattttaagcggaagtcgggggctactgtcagggttacgggttaggcataccctttacccttcgatatacgtcacatatcggtatggtatacccacgcgcatacggatacttcctgcatattctaaggaaatccttcacgaaatctacagatgggaagaatcctactcggacaagactgggtcgttggcgtatcgtatagggtctgatacctccgagttctacttggaaacctccagacctgcgatataaaagggaccccccggggagcctgcaagggatcgaatctcagagccaacacaacccacacagcctacgaagccatcaagatctagtcgaaccaactcgactacaatctcgccggatccgacaagttccactgttccctttgtaaccaatgttttccactatataatcccacatcgactggattagggctattacctatcaaggggcctgaaccagtataattctcgtcttttgtttgcttgatgtcgtactacgtagatccttgtaccaacgtaccccaataccctctatatccggtctacgggtaccactcgtcaacaaggtcgcctatcagttggagttacctcaatccttggcaggtgtccataatgtgtttcatgtgtcacagttaaagaaatgtttaagggtacccactgaagaagctaatcttgaacagatagaaatccaagtggatctgacatatgttgagaaaccaatccgtatcttggagacagatgagagaaggaccaggaatcgagttatctgtttctgtaaggtccaatggagtaatcactcggaagaagaagctacttgggagcgagaagatgaattaaagtcagctcatccgcatcttttcgccagctcttccgaatctcggggatgagattctgtttaaggggggtaggtttgtcacaccctgaaaatactaaatttataaattgttgtttaaatggaattattagaaatgattttaaaagccgagaagaaaagatctaattttaaataataaattccaatataaaagtgggccagataaaattttattaaatacttcacttgattctatagttcttagatttttctgggatttatttgagccaaggaagtatttttaataaatagaattgcatttcatgaataagttaaaaagaaaaaggttttaaaaatcctcttttggctttgggccgaaagtcggcccaaaacctctctctctccccggcccaagcgcgccccggcctagtcagcccgccgagccgagccgccgctctccccctctctctcccgctgacaggtggggcccacctgtcagggtcgtcgtccacctcgcgccaccgcagccgcgccctagccgcgcaagccaccgccgcccccttccaaaatttgcccgcccctttcccgatccgatcaaatcaatagaggggaaatgatccccaggatcccctcttccttttctcttttggaatcgtcggctaatttcgtttggaaataggtggatttgagttcgattcggatcgatctctctcctctaaccctaaactttccattcccgtcgccggtcgccgtgggcctccatcgccgccccctagcccctataaaagtaccccgggacctcctccgtccgccgccaccctcgctttagctcgccgctgcttgtagcgccgcctccgcgacaatccgtgcgccgccgtcgccgctgcgagtccagccgtgcgccgccgccgccgcttcggtcgtcgtcgtcgctcgggaaggccgccgtcgggatcgccaagtcatcaccgtccccgtcccgtccttcgtttccgtcgaagaccgccggagcaccgccgtcgtcgtcgacccgaatgcctccgccgcttcgacctcgtcgccgtcgtcgtccgttgccgtctgccttcgtccgagccctcgatgagtttgccgcgtcgccctctacacgtaggtgctctccgtttgcgccgccgcgccgccgttcgccggcgagcgtgagttgctgagccgccgctggtgatgacgtcatcgctgacatcagcgccgcgtcacccgtagacccgcggtagatcgattcgatctcggccgttcgttttggataagattagatctcgaccgtccgttccgtagaccgtccccgtgcacccgatccaccgtaaacccgagcccgctgacgcaataaatcatttttctttttcaaaaaaaattctttattgcgtcataattcaattaaaatctatataaatgatttaatccgatttaatctttaaaaattcataactaattcatcttagctcgaatttagttggttcaagtctctaaatttttctaaaattgagatctacatgttaaaaatatccacatgtactgttcatgattgtttatatgctgttttggtgattttgctcttttatgcctagattccgacgttcctggagagtccgaatttgcaggagaagattttgaagagttccaaggccagcaaggcaagttacacagatcccaaacaaccctttgagcatgttgattccatttaaagctattgtttctattcaactattgcatttatttttgaatgtcattgggtgggaataacctattgcctttgttatagccctttgttattgattacctattctttgtcacctggttaataatttgattagctagaacattatatggttttagctaaagtaattaggatgcttagccatacttagagacactagctcatatgaatgggatgattaataattcactattacttaatgatggcttaatgatagctcatgatggttaatcatgataggttgattaattaagatgccaactaaaacttgataatggtgggttgtgagcacatggttttgatggtcgtgctcatgacagttaaggaccggttcacgattttcggttatgaaacattaaccgtgccaaccacaagccagcgtgggcaacgactttactttttgtatagtatggttcattgtagagcaccagactgtgaagtggcggagataagcccacgggggtcgctggggagtccatgccttgtttgtaagggggtgattatgatccagaaacggtgcactgctttgaattgtgttatgcgaagggtattgtcacaatctctattcgggtacttgttaagtatcgcgacgcatggttgacatgatgttgaggttgtgtcttgtaggtacagtggtacacctctagccagagtaaaactattcgaatagtcgtgcccgcggttatgggcaggtctaacaatgtctttcgtgattagtctcatatttcacaccataataaatgatgatgaaaataatttgtttagctcctggtttggaatggtatattcctggtttggagttagaactgtgcaaccgggattggttgttcataatggttgggcctatgcaacgggtgtgttgtatagcgttggattaatattgtttaattaaatactttacagttttattaaattctaaagtattcattaaatgccatttatgcaaatgagactatattattccatcctttgttatcccttgcatttgtatattttctgcgtggcttgttgagtatgtcatatactcaccttgcaatcattcatcagaggaggatttctacagtcatgccgaaggtgtggaggattaggcgtagccctggtcaagctgcttgtgggatggagtcgcctgcgctgtttattttattttccgctgcttagaactttattgtttgagatgaactatctacctctgtaatgactttatattcgcttattaattagaatattaattgcactctattatcgatttgttattgtgtgcctcggctgattcctagacgagggtctacacacatgtaagcgtttggaattttggatagaaattccgggcgtgataagatggcgctcctccatcttcaacgacagtcgccgaaggctctgctccctcttcggcggccatatccgccccggtgtcgctttcctttcgccttataaccttctcctttacgactttcttcggtggcattcgctcttagtggtttcgttcgaagatccccacgatcggcgccagctgttgtcgaaacgacaactgcatatgtcgaaagacgtggttacttaacagtgattggaaaaaggtaaagtgtattgattagagaatttctcttgggatccccccattacatggccctatgagactatttatagcccctattacaggttcttactactagggttttggttatacaggggaatttacatggttacccttatgaaagggacatttacaagggtacatagtgtaatagaggttcatggaatcctgatgggccgttaggcgattgtcggcccaatggcccctaggcttgatgggccggaaaaggcttcttcggccctcgcgggggcgagcttgctttggcgaagtcgtctcccttcggcatatactcttcgccctgtatccttcgctcaagaggcctccggcttggcagagtacccgcacgatccttcgcctctcgcccgtgtccttgttccatagtcttcgccttgggggggaggggggcttcgccccaactaactttgacgtctcgggcttggatccccattcctcgcatagctttcggcagattttggtcgaagtgcctcgtaccataccgccaacaatacatatatatactcttctaatcaagtgatcaaatgagcctaatccaactatctaaaatctgtgtgatttggacccaaaaatctgtcgtgtgatgaatagctagtcccagtttgtagaaaaaaatagtaacattttcaattcaagacatattaattataaaatatatattcaattattgatatgatgaagctaatttagtattataaatattattatatttgtttataaacttagttaaatttgaaacagtttgactttgaccaaagtcaaaacgttttataacgtaaaacggagggagtaatattaattattattattacaaacttaattcttatttgatttgtttaataaaattctatatacaaaatattattttaaccaaagcaccatttagtgttttggaaagcctgctcatgaagaatgagaaagttgttgttctaacaagctaaaactaacggagcctaagtccactccgacggtaataaacctccgttatttcataggtggcgctgctaactttcggtataatgtttaatcattcatcttattaaaaaaatcagtgtagatatgaaatactccctccgttcctaaatatttgacgccgttgatttttttaaacatatttgatcgttcatcttattcaaaaaatttaagtaattattaattattttcctatcatttgattcattgttaaatatatttttatgtatacatatagttttacatatttcacaaaagtttttgaatatgacttacagtaaaatatgtgctaaaaagttaacggtgtcaaatatttagaaacagagggagtataattcatatttaaagttttttaatggtaaaacatgtcataacaaaataaatagtatttatataaattttttgaacatgataaatggtcaaacatcatcttaaaagtcaacaatatttaaaaaccaaagaaatggtgaaatgtcatctattaaaaatcaaagagtacgatatttgacttgcactccgaaccaccgtctaaaataactcaattactaaattgtttttcaatttaaggtttgttggtttcggagccaactttcgcctgccaatataaaatttgtgctattataggaaaaaattggtagcataccaaatacttacgtgatactattaagttatcaatatttttgtagggcacaagttatcttcaatccaaataagcccttaacttaaactgagaaacctattaatcgaatgtgtgaggaaactacaaatgacaccgaatatactaaaagagatgaggtcgtcgatatcatatatgtggtgatagtcacatgttttacgtgcgtgcgatgtacgaaaacctatcattgcgcgctacacattcatttattatgtaattaccaataccagtactatataattattgattgaaatttttaattattaataccagtttcattatgtcctaaattattggcctaatttgtttttcctttttcattcttctctcctcttctctgtctctctactattataaaaatttaaatttaagatgtttttgccactaatttgagccgtcgcctctttcatcagcttcatccgattccccattttcgaacgcgatgcttccatcgcttcgcagtcggataagatttatgagtaaaactaacaagctattaacaaatttaactggcacggtttgt

SEQ ID NO: 44231 - DNA, 9817 bp, Oryza sativa
cacaagtttcctcttcttcctattcagcttgttttgcagttggggatgcatctacagaagcctgtgaggcttgctcacaccggttgctgttgaccggtggagtagcacactgcttgctattggtccgaagtagccattggttcaaatcactagcaatcaaatcggaaataacagatcaatgtcagtaggtactagatcgaaaaaataaataactagatctagagtacgggagaaggggataccttgctcagcgcaggggaggacgttgccggccggaggggagctcggcggctcggcacagaggaggcagtggcgaccggaggtgggaggcgcgactggagggaggcgcggttggagacgttgatgaccggccggaggggagctcgcgcagacgggtaggaggcgaggcgacaacggctagagggtggagccgccggcgacgacctcccgtggcgcccctcccagcggcgacctgacctcccgcgcggacctcccgtggtgcctatggcacccctcccggcggtgacctcccatggcacggtggcgcccctcccatgtccgcctagagcccctcccggcggcgacctcccgcgtcagcttggcggctgtggaggagaaaagtcgaagagaaggagatgcggcggctatgaagggaagagaagaaaattctagggtttttagatgttggtttttatactaagttgattgagggccacatgtcagttgatgttcgcgggtaaatgggcgaagcgggcccgtgtgcccgtttgttacaagttttaacccaataagaaacctatgagtactaaatagagaacaaacccaactctattagggtttttatccacaggtaaacgggcaaacaggtcaaattgctatccctagacacagcccacgaagtcatttgcacggcccaccatttgctacgtgtgcaggttatacagagacaataacacatggtgtgcagttatacgtggaattcaaagtatttcttttaccaaattttcactttttccctactaatctttacctttatttaaaaatttagaaaaatatcattatctattaaaaaatcgaaatgtttatgtctgcttgtctgtttcatctatcgctaccggtgcggtgcgagataggattggatcactcccgcgccgccacgcgtgtgtccatctcatatcacacatacgataatgagtctatcgtgcgcctgtctccatgccagcaagagaaaatagaaccccgagctacgcatatgcataacgcccctgatagttcgaccaccaccatccaggcatccactgtgagtagtgtgtgtacatcgcacatatgataatcacatattcacgtcgggcaactgaaagagaataagtacatacataaatctcacatcaacagccatgattttttttctcttttaatgaaaggcattagtcttgctgttatggaaatcaagggtcaattcactctatggaccaaacttatggtagatgtcatacaaactagaccgcatgacttcacccgttgtaatgcacggacatttctctctagtttgataaaaaaaatgtcagatttagccatcaacgcttgcatctaagctatagtaactagatcatgtgctcgaactctccagctatcgtaatatatattagtagtactagaaaataagcatggcgaagccgattggggcactctctagttaacctgtgcatactataattttactctccatttcaaatatagtaacttctagcgtgaaatttttgttctagaatatagcaacttcttaacacactctctagcctctctctttaaaaccaacaggagcactagtatttcattgagagaggagaaaaaaacaccattcttcttgggtttaggtgaaacaaagcgggttcacagatatttacatcagggacctcgtcttaagcattggggaggctatccaggaagaaattttaagtttttgaaacaccgtatatatgtaacttttacttatatgtgatcccctaacttccgctgagcaacgccctcctagcttgattaggtagaaaacatcatcggcgctgaaatcttcattgattacaccaaacgttggagatccctttctaccaaacgttgattacactgataattacatgtcatgttaaggtggaggttatttgtccatgttgcaattgttgcatacatctttgtagctgaagtgtagtttttttagaggagtagttgaaagatgaggcatgtggtcgtttcctcatgatgatcgtgaaacaggtaggtaacgttgtgtggccatacgttaattgaatggcgtgctaggttgtcagcggttaacctactggctaatttgaaccaatcataacatctttcatttaatttatacacgtattttctcatctcaaccgatcataacaattgtatgtaatttcatccctctctttagttcccatgaaaagttgagtataattttgaggaataaatcaaagatgttagtataataagattttctttaatttcgcataatattgtttaactttaacatacgaatagatagattttgctctcgataaggtttgctcggctctgttggtgtcccatggtgtgatacgtctttgtttctttttccttatttacatctaggtgtgccatttaccgtttcatcaggttgctcatagcttgttctttcttttttttctccatctgatctaggctctaccatcatgtgtagatgccggtttgtttgttagttggaacttaccgctccctgtgcttctctttgattggctgacgcagtggttagcttagtaaatgaggatgagttactgccttcgtgtgatgtagcaaatagtagtaccaatggagtatcaatcttctctatctttccactggtcgctgtttcaggctgccgtcggaaagcaaaattctttggcatatcagccaaacttcgcattttcatttcagccaaagaatttccattgattggcgtatttcttgatgttggatcttctgtggcttaatggttgcagctctcaattgatagtagcattcatatatgatgggtttagggattagcaaaaaaaaaatctcaattgatgtaagttgtggaagtaaattactatcataattaatttgtagcaatatatatttagtaagccatataatctctcagttgctacatgtagtcgtcatcctcctcagggttgggttcctcatcatcatcctatggtgagtgaacatacatctcgtcaaactccttgtcgttgatgtccggattgtcgtacaccgtatccaacacaaaattatgtagggcaaagcatgctgtaattttttttgtttgccacttcgtgttatatgagggtatgcctcttaaaatcttccacttggttttctaagcatgtagataattaaaattctcttgcaagagttccggattgcagccacgaaaatccggcacatggtaccattcacccctatatggagccatatatcgtggagccaaggcatatccagtatcaaccaagtagtacttatctgcacaacaagacatatatttcagaaactcggccaattgtaactgtattaaaaaacacttgcacatactgtgaggtgggtgaggaaacaaatcagatttgtctcctctcacgacgcggttgaagacagccatgtcatggcatcttcccttcatcccagcggcaacaaaagtgaagcgcatgtcaaagtcacatacgaccattacgttttgactagtgtatccatgcctacacatgtaggtcatgcactcctcttgtggaatgatgactgggatatgggttccatcaataactccaatgcaattgatgaactgtggggaaaacctagattgcaacaaccttccatgcacaccacgaaaagcaggatcacgtggttggatgatatcattggaaaattggagcatcactttcaaaatatccctaaatttccgatgcacggtgtctggtgacctttgaaaacgcttgcaaatctggctttgcgataagtcgaaatttctttttaggtttgtgaagttgctttgccatcaatctttcatttgtgatatgtgcaaatctctttttatattttcccacccttgtcgattcatatattgaccctccatgttcatctgagccttttcatgaaggcatcgatcaaggaatgccttggtcattcgtcgagtccaattggcgcggtcgtggctcatctgcataggctgaagtaagtggaaaggtagcatgtgcagtgggttgtctactctcaattatacatagtacatatcgaattattgggttaatgtattagttaagtgaccacatcatttctttcgaatgaaagtagtgaatacataaataatatgtgttcacacatacctaccttgccgtgttgcaaatgagcaactgtggagtgcaaagcgtatcgtcgttggtttatcctagagcacgatgaggaagatgatgttagagatgtgcgcgggcgttatttttattttgtagtacctatttggcatgtaattcatcatgttgagcgtgggaactgagaagtactaaaaagaaaataatcattcggcaaatcatgcatgtcattttctttcttttccatcctgaccaagaagtaatataatcagattaagatgtctcaagagacatgcaataacttaacttatgcatccatctcttggaactatctcaatttgttgtatgtggccttccagtagtttctcatcatcatatccaaagatcgtgtagattttgccatttgcacaaaactatgcatgttgaattgtagttgtggccactaattgtactccttccatcccaaaatataaaactacgtatgttgcattgtagccgtggccactaattgtactccctcaattccaaaatataaggtacaaccgaccaagaaataattgttggttgtgccttatatttttggtatggagggagtagtacttaattcatttaggaatcatcctttccatcatatttatatgctgccattacttatgtcatctactcttaaagcaaaaggtgtttgcttccccccacatacgtccataattagtaggcatatacacactgacactctgatgattcaaaagaataatgtttcaattcgcctaatttgtggagccctattagatcagatgcatattatgatcatcatcaattactcatacattcatgctaatgattatcatcaattactaatacattcatgctaatactttgaagtattctgcgtgttgtattaaattacttatcatttttattttttaggagctgataaggagtatgtcgtggcacaggggttgagtcgccagggggagcttatcaatgggttaaatgccaaagttgtagccgtgctcacgaagattgcaaagatccgcagagagattttggtccgaacactgagccacgggtggtaaaaccgcaaagcttagaaaatagcttcggtcttactatgtggtttcatatggtgtcgtgaagcctaaatataaaacaactttggtcttggaccgtcaataatgattttttcttagaatttggatacttaatcgacctgcttacttctattatgttaatactaattactattgtaggaatcctggttcttatttatattgatgattatatgtctcacgatgagggatatttaagattttttttatttatataagttttttcaatacttccatgttgctattggttatacaaatttatttttttagagcttgtggaatgtgttcctatttattgatatgcttttggtttacacgaccaattgcaacgagtgcttgtcaaaacaaaactttggtaactaatcgtcctatcgatgagctttccaactactagcagatgcgaatgataagagggacattatagtgccaaatccttatgtattatttactacggaattatatgccattatctgatcattagaattaaagtaatataaacttccaaatactgtcatatactttgatatctttacttgatgaaactacagatgaagctgtttttgtaaggtcaagtatatgatgctaatgaaccatgttagaaactgccaatgaagttcattcgatggtgatgaacgttgttggtatttcttacgttcataaataaaatccacaagtgcacggatataccgctgtaacacttcacccagaagtattccaatatataaaattttcactgggaatgtgtgtgtttagctcttctttaggtttatcaaggatacaagatataaatgtaggccaaagggtagagatgatattctaatgtggtacagtgttgtttggaaggcttaactttaattttatcgctatgcttcaggcactgctcactactaccagaatgcgctctactctgtacccgacatggaggactacaatgatttcgagggctgtcaccacctctacactaacctctaacgtacggtgggatacgtagccaacaatagtaattaactatctagacaccatgtctatgcaattaattactactctagcgttagctaaacactaaagtaatcactttttcttaatgaacgatagtgaacaatgatccgcgttagctaaacactaaaataatcactatttcttaatgaacaatagtgaacaatgatccagcaagctaaataggacctaacttaggccctatttgtttcagcttaagattattgagccatattactataagctggattataatagccgacatagtataagttgttagctgtttgtttatctggatgataagttatttgttagctgttagccctcaataatataaaaaaagcacctttagagtggattattagattatagtaatatggcttatagattgtaataatctatcatgataagctatctgtttatttcagcttactcctaataatacagattataataatcctaacctgaatcaaacagggccttaagaataccacacaagataaatctcaatgacttgattaaaatattctcaactagagcaaagcaattgctaaggtacaaaagaacaattctggaactcctccaactctttctttctcactctctcccttagtctaagtataaataaaagaatacaaagagccttataattcagctcacatattggtgtgttgtgaatgagggaagagaggggtattttataggccaagagacgccttgggagtatgtagatcctaagcatctaaagagcatcttcactcttgagctgccaagtgtccctccatgagctgccaagttcccctccatggcggtttattccgatagaaatgatcacaatcgccttggatagtcggtaactaccgacatgtgaaaatcgagggctagatgggctgttcctgagttggccgacccctggttggcccttctggcccttggttttcttttgggccctagtaggtactttagtatttctgtggagttggcccatttaattatgatcttgttgggcttgttggctcaaaactctatgagcttggatatggaagtaatatttccgtccctcatgtatagttcatctcaactttggtagtttatcacctgcatacaaatatacaccgacactagtggaatttgttagaaataaaccttaccactatgttggatgttttatattttcagatttatgcaggtattgacggcgtaaatttcgtatttaacagccatcaacaaacgcgttcaatcctttgaagtacttatatatggttgattatggggggcacgatagccggttgcctcatagtaggccttttgggccgcaccgtacagggtgggcaaagcgccccaggcccgtgtggttagtttgtatttgaggaaagtaatattagataagggaatcaattttgtcccttgtaattagattaccatcggaccgccgaccgccctagctctatatagggggtgccagcataaaccctaaggggttaggacttttgcatcttttctccacatacgtgccgtcggctactccattgctgacccgcgcacttggacacagatccaatacatctcaactggacatagggtattacctctcgacaagggcctaaaccttagcaggtgagtcccgacgtcatctgctgacgtcgtcgggactcacctgaacgcatctcgggccgacgtcaccagatgcgttcaagcactacgtttccccgccgaccgagttccgctccggatatctcgacttcatcaccaacaaggccggcgtcctcaagctcgcatctccttcagctacaaaccaccggccatggcctctccagtgccgatcggcatccccaacttcgccgccctcaccattagaattaccgtactaccagtggcaaaagaacggcaaaaaaaaaaatgccaaaccaagaatgtatctaaccaaatgttaactcaaaaagttgattaggcaccacacaacaacgccgtttcaaaatgcaccacacaacaacgccgcttcaaaatgtcggtcatatttgtgacatggcagagagaacacggaaatgtaaaacctgaacaatcgataattattcaatggcgtacagccaagtgcaaagaagtataacattcacaaggcacttatagttttaatttgcctttcaagggtttttacagttaagcgaggacatctacaaccaccgcttagaatttcaactctaaggtatttttcagtagcaaccacagatctaatcatctttcaagctaaacatatccctctgtttctttataaaaaaagaaaggtgaacatatctgtacaaaaattcgttggcaccagttttacaactggaagcaagtgtgaaatgattactgcagcaaaagtaaccggcccgtttcaatatgaactccatgccgctcaaggttgacatcaatagtaaacagagatctgtgagttaacctgatggttcatgactgcatgcatgtgttcataactaaaatgcagcaatagtatctactacttcctaagtatttaaaatcatagaccaagaaaccacgctgctcatcatttccccaaaaaacctgtgccgtgatatacctgcaaaaaaagtatatatcttagtagagagtagtactccaagcatagaccaaagttcaatcacttatcagataccgcaataaaaatgaacatgcatctcaagttcttaacaaatcaatatatagaagctcatagatgagttgatcttcgtcttaaaaatatataaacaaattgattgtgatagtccaaaatgaattgcaaagagttataaaagtagcatcgagtttcctgcaccaagtcacaatagttctaccaaaaaaatatatatatgtattgaggaaagatgggcaatctatacatatttcatcattagggagcaatttcagctcctatacaatgtactctttgctctattattttactaagtgttgaaacaccatgtaataaaggaaatttatccataaaagaacaaaaggcttaccttcaatacaagccctaagtagcctaatgaaaacaatgatagtacacataaaagcaatcagaataaacataataaagtttctgaataataattccactgtatttttctttaaaaaaatgatgctttctcatgtcatcacatattccaaagctttgagcataaatatgttttaaataaccaaagtcttatatgtgaaagcaatactgttaaattgttcactaaaaatacttcatgaaaccttttttttttctgtaaatataaccaaaggttgatatgtgaaagcaacactgctaaattggtcactagaaaagtacttcatgtgacagccttctttaaattctacaaaaagaaaaca

SEQ ID NO: 44232 - DNA, 7341 bp, Oryza sativa
tagtctttaaaaacatactgctcaagattatctctagaagaacttcctcgtggaaactgctggtcgaattcttgtttgctgacaaagtactccaccccatgcttttcagtgacttttgatatagaaaagtagcttgtccttttaagggaatactcaggatgccttgctggaatgaaagcaaacaagatgaaaaacaaaacccctgcaaggtgcaccaacattgttaaatttatgcctgacccaccctgaaccggatgttcccgtctctgttgttgctgttgcctcactgttcctcttgctctgtaggcattgtgagactggaacatattatcatgggtcccataaaagaacgacctgaatatctcatctggatctaagtcttcttcataaccatagaagctacttcttgcttgcctttgtcgccttgtagttctctgcctcatgacattggaatactgataattaaactcatggtcctcaatggcacctgtttgatcataagttctccttgactgatcattgcttaggcacttgaaagccttgctgaccaacttaaatgcatcctctgccccaggagccttgttcttgtcaggatgaactttcagtgacaacttcctgtaggctttccttatctcttctacagagcaacttctctccactccaagaattgcataataatccttgttctttgtgatgttccgaaccactctaacattttcctcagtgtaacccttatcaacattagaaggaccaacagattctttacgcaaattttggctttcaccaacttcaccacttctagccctgtattggcgtacagcaccatccagggtatcatacttcttgggtgtgcccagcatatcatcaatcggaaggctggggtccaatctttgggcaattcgaaggaatttttctgctcgctgtctatctccagatgcaagtgcagtttctgcaagtttgacagacctcaaggcctcatctttgtttccatccatgcccttagtcagcctttttacaactggatcatatataggtaggacacccaaattgaaaaacttttgaacaaggacagattttcttcacctatgaagcagatatcattcaaaatcaatcgaaattggacttgatgccataatacaaatagccgagtaactctaattcgatagcatcttgtacttgcagtgacacaaaaatgatatctaatcagaaggtagatcaacccgagaaattagggtgtataaacaagtggtataactaagagtacaaaaactaaaccaacaaacttaggaatctctggtaaagcagaaaaatagccaaaattttgtgaacaaaagataacctaaatgaaacagattgccacaatgcatagtatggaactaccagagtacaacagaatgctttggttggataaaccaactgagcatggtcaacacaagtggcaaaaccatgccaaacaagcatgacttttaactaagaaatctatttacactccatttccacatgaaccacatcaacttggatattttgcttatttcactaggtaaaactactacgatggacacagttgcgctagcacttaaaatgcctacacctgcaagaaatatcacatttggaggaaagcattaaagaattaagcatcataaaggcattcaatgctgaattgctgagaaagaacttaataggtcttaaagaaaccaacaaccacttggatcaatgagcacaagaccagcttccctaggcataaccccccaatgtaataaagaaaaaagtttgtgctaccatcatccaggcagtacaaagtagtgccagagtagccgtttcagccaaatgaattcatcccagagaaaaatactcgtttgctatgaagttgaggcagatcacatttgccacaaagttcattggcatgtaaaaatccgacataatttagtgggaatcaactcatttgccacaatgccatgtgaaatgtcaaatttttcctcatcttcgttatgtgttaatctctctcctctactgccggcaaccgctgctccccatcttcatctagcacctagctccctctgctggcgcaccgcacacactttcctctacctccagcagccggcacacgctttcctctacctccggctgccggcacacactatcctctccttccagccaccaccgcaccccagctcagtttgtcagcaaacacacccaaagctccagtctccaccaacagacagctgaagctagtggcacgcgatagcgatcagacctatggaacactacacatgcttgtggccggagatgagctaagaggaacaagattggggcaaatttgcatcacctgtggcaaaggggtgtataaactattgaggaatttttgcaggccaacgatttcattcattgcaaatgtgattacacacatcaaccccttcgcgaaggaacaaccaatttttctcctatcgcaacaacatgaaccatcgaactagacagacaggctccacgtgtactgaaataccccgaatcgtcagccagcagcgaccagggaacacgatggactcctaacggcgggatcctcgcaaaaaccctaggttagggccgcggcttgggcgccgcctcgtgaccaagcaagaaacgataattccccccaagtcgcggcgagggaaagccaactaactaatcgaagatccggagcgggctctgagcccatctacggcgattaaacttaccccgggtcggagagatatccccggcacggctagtcggcgacggggagacgaggacgacgaggagcaccgccgcggcgccgccggagcggggagagaaagaggagagaactgcgcggtggcacttttccacggagcccctcggatttcctctttatttaggagcgcccatcgagccgagacgagagtgcgtgctggccgcgtgggacactgcgctgtggggcccactagctgtttgccgctgacgggtggggccacgcagccagcgcgaatcgtaaagcacgcggaccccgtctcctttttcatacatatcctcctctcgctctcgccccgctcgcttccgaagcttctcgagccctcctcctccgccgccgccgccgccgcctccgcctcgccgccggcgcagagtcgcaggttagctccgtactccgctcccctccccgaaccaagccgacgccgctgctggaatcctagtactcctgcgcgagttctagcgtgctctctctctctcccgtcccgtgccgttgcgtcctcgcgctttagttctctcggttgagcgagtgcgcgagtgttctgcttggttctccggtagatttggtagcccgcgatcatatctcctaggttttttttttccttcggttgagcggggcagcaattgaattcgtggtcgtcagggtttctgagagctggagatgcagtgctatgcttggtttgttttgctgtttgcgtgttatcgttacgtggcttgacgctacggccattgttggatttgtgcgtgctaatttagctgacttgatgtttgtctgtcaggaacgatgagccgacgcaacagccgcaccatctatgtgggcaatctccccggagacattcgcgagagggaagtggaggatctcttctataaggtgagccatgattacattacggattaggcatgtgtgtgccatgtaacagtgttatcctctagtactaaagtggtaggtcagtgcaaattttgttttggtatcagcgagtacatcgtaggctgcttttaggacttaggaggaagatatttgggggcaatactgctttcttatggaattataaatttgctatgttgggccctatggttttctgttgtgtggttggagcatttgttaaatacttcaatgtgaactagatatctaagttgcgtcttcacgcgaccataacctgtcttttatttacaaatatgataatgaattgtttgtaacagttacctatgttaaaatttaattcgtctagttgcagttttcaaattctacaattgaattttgttaaggattgaactttggagagtatttggcccaatttccgagcaattaggttgagatatagttttgcgttatgcatatcagtttgtttttctatttgttggttatggatatatctgtaggtgataggtattttttttatcttaattattcattctggatcatttctataaccgacacatctgaattttagacctgccagtattgtttaggacttttgtgaatatatgatttattatagttctattgacataaaatccatataatacacattattcgttatgtttattgggtctctgtggctatgtaaagatagtagtgataatcatttttatgtgcagtattttcactttatatggatttgatttcgctatatttattcatgtttgtaattgaatttatgaacaaattgagatagcaatcgaggtgtaagtggtggccatggatcgaagtactgacacgggtgatgttggctgaggaaatatatttcaacttgacagaagatttatcttaatatgagtttcacatcttgttagtaaaagagtttattttgcttttcttctaaacttgacctaggcgcacggagaaaagaggatggagtttgggcttgcagctgttgtagttaggatgcataccgatccaattaggcctatttatgtcaccgagttatacatgcaccacagctagagggtactctagaatactcctacatttttaacaactacttaagtttcatccaacggtaaagattgtttcgacttattttgtctttaagcgtatctgacggttcatattagtcagaagaagtggcacatcctggtttctttttgagatttacttttcacttggagagattccaccagtcggttgggcacttgggcacctctttgttgttgccatcttatgtggtgaactggtgataccgaaggatgttactggtagaagggtagaacaatggcatcttgtaattactaaattttctgatatctttattttcttgattattcatacagatagagtttaactttttttttcattacttttgcttctgcagtatggccgtattgtggatattgacttgaaaattcctccaaggcctcctggttatgcttttgttgaggtaagggattaagtatgttatggtgattacttgctatgagcacattttctatctagatttttgctcatctttttatatataagctatcattttatttagtcataaccttgttgttatttgaggatttttttttggggtctgtgagcaaatttagcacatgaaaaccgactacagacattagctttatcaaaatctaacccgaattggttgctattttttttaacttaaaaatggtccacactaaactggatagccaaagaaaactggacctttactaattcttttcgtatggtcaaaagttgccaaattttcataagataaacttcggcttggcgtgaaataaaacaacccctggataacaaactttagaggttctgttagaatgatgtgttaatatgaacccaggagtgttttgagctttgaataggaggtagcgaggtgggtaagcagagtgcttgcattctacccctgaatggacttcttcccaatcatggcaagaggactctaaggccggcaagtagatgcaagttgatgattaaataaatttcttggtttgaaatgaagcattctatggaagcttatatttcaggcatctcttagcaacccatgcgattagtttagagctgaaacaaaggaatatactatcgcaacaatttacccctaacgaactcctcaactggcttgcctgcttgcttattacaatgtgtgactacctctatataccttgctcagggaaaggaataggcaaatctctaaaatggataagctggcaagcacaggtttataaacaggagttaggtatgggttgtgtgatttgaacgatcaagtaacggatacaagacatagaccccctccaggtgcaaacattattgttctcatgctttgccttgctactacttctgttctttttatagaacattttttttatctataatcaatatatcatttttattatttttaggaaaagcagaatgggtagatcttggcgcgcgcgcgtgcacacacacaaaaataataataaaaaactggtttaagaatatctcgcttttgttatgttggacatgtggttctcattggaaactatgatgactaacgaaagtgcataggatgtgagcaaggggcaacttaagggttactatggaggcaagagaatggaaacacccaaatttgtttctttaagctcatgaggaatttgggggtgacggagactgacaaaaaatgtaggggatgagtgaaatttgacatacaatcaatgaatttttccatgtagcataaagacaaaggttagacaaacttgctttagaggaaacttaacaactagcctcaaatccagttttgccaagtgttgctgaactatctaaagaaatgcttgtcaaaattaaccttgtgcaatctgattgtacatatagcaccttagaggctaagaggacttgatactaactaaaagtggttccttatgcagtttgaagaccctcgtgatgcacaagatgcaatttatggccgtcatggatatgactttgatggccacaggttgcgggtaagtggatcttgcatgatatccgttatctttcttgagagaataccaggtggtgaagagggtagttcatatttatttatttttgttgcagcagcaaagaggatagttttgttctttgtcgtaatgttaatcttatacctttatttaggtggagttagctcatggtggcagaggcccttcttttgatcgatcaagtagctatagcagtgctgggcgccgtggtgccgctaaacgtactgattaccgaggtacgtacttctaaactcaagctttacaaacttgattggatacatcagtgttcttatttgctctattcatggaatgtgcagttatggttactggattaccttcgtcagcatcatggcaagacctcaaggtattgatgcagatgaactcccatacaattattcactcttcacgaatcttgagttttacttccattttcaggatcatatgaggcgagctggtgatgtctgtttctctgatgtttaccgtgagggtggaggttagtactgaacacttctatgctcttctgttgctgatattaattttggtatgaattgggcagtagtttgttttgataatacagcaaccatttaagctgtattatctttttccattcatgtttcagtagttcttacttcttaatactgaaatttcatgtgtttcagcaactattggaattgt

SEQ ID NO: 44233 - DNA, 7351 bp, Oryza sativa
acatagtacatggaatgctttcgattcattgcgatggtgtgatactgagattctcggattaatactatgttacaaagttaagaaactaagtagcatttgcatgcgttatcttcaatttgccaaaaaagaaactacatatgattttctaagaacccctccaatgttgtacattcaaatttgattatgtgattagcctgtgtgatcccatatctatctctaataattgcaatacacgaaatattgtaaaatgaaatagggccggctctttatattctcatataatttgtcatttcctttctggtttgtactttaaatgttatgctttcgagatgcattttttcttctgtacatgcactttgagtttccactctctgatgattaaacatgcagaaaactggatagctgtcatttgttgaaaatttgctcttgtctttcctagatttgggacatgcagctatttgggttgcgttggtaggatattggatgcgttgagaaccaaaggatggtttggaacgttggatagttctgctggctagtgacatactgtatgacaagtggactacaaccagcgataggagcaagatagggctggctctaaacatatttggacttatggagtgcatttcgtggtataattgaagtactattgacttacgcatttctattctcaaatgtaaacctcggccttgcacccctattggttattctcaaacataacctcaccttaatgttgaagtttatttctaaattacactttctgatgaaataagtgtgtttagcgattagctctttaaccaatttgtgatctattgtggcttcaccttcatttggaggactcgtgattttacttataaggtctgtcatagtttttcaaaagatgacatgttacatgtacagtggaaaaaggtggtccctttacctatgctcatccaaaacacttctccacatgtttactgtttattgctctcaatctcatgtgtattgatgttaccatattcacacatattttgatcaaactgttgtaatatccctttactgagtaacaatttcttggcttttggaacattttgcagatcaccatcaagatccccaccccctgctacttctgtaagttttccaaacaagtaacttatattctataaatttgttccatatagtaaccattgtctcgtgcagcctcctcgtgaaaagtcagcaagcaagagccctgtcaagagcagaagtttatcccgatccccatctcctgtccgtgacattaaccaaaaactctgtatttttgtgagcctttaatatgcttgaagtttcccatattgatatggtcaatgcttcctttcaggtgaaatctgagtgaagatggatgcacttgaagcctgccagaaactatttcatgatttgtggagctgagtttcggaaggcagtagattgtggattatggtttatctgtttctgcgttaccattgttgttacttttcagaagagagccgtgttatttcactgttgcttggtcatgtcgtaatatctgtcagaaacattgccttacatgcttagcgttttacttgccatcaccaatctatcagacctcgtagcacatggtgctcgaacttcatgctatacatacagcactatgaactctgctatattctaaagctcaactatctgtagtaactgcaggaagcctttgcgcttcaattattgtctttttactctagttttttagagcttgtgcttgtgtacttgtatgcacctgttatgttgtaattctacagagtggttttcctcgcttaattgttgacatgttttgtcgttcggtgtaattgtgcgaccactgatgcgtgatatggtcttgctgacatggcttggcttggattggcttgacctaccctagtattgttggttttgtttcgttcaatccgtgatgaccttcgactttatcccggttgtcttgattggaagttgtcatccacggagaagacgctatgctcagctgactcatcccatctcgggtgtgtttggttgcctgcagtggactttacctcttttgttgtaaagtctatttttaaccgccaaacttttactttagttcaattttattttgaaaaataaaactcaccctagcctttcaagaccaggtgagttataccctaacagtccgtttggttggagagagtttttaggaaggattgggagtttagagagatgaggctattaagtgttttgtttggttagaagatatgggaattttggtgggatggggatgaggaattgaggaaggaactccctccttttcaatacctgggtaggggcagttaattgagagggaattcctcctttactttgtctaagtaaatcttagccatccgtttttattaatgacctaatctccaactaaactcactatcaatttccatcacatctaccaaacaaaatattgggattaaaaatcaaattcacatcttaatctcattatcaattcgctcgtgtaaacttccaatccccttccctcgagttaccaaacaagccataggtgattttcgtcatgcgaacttttttcttttttttttcatacctaaaaccaccatcaagatcagagtcggggtgaagtttgcctggttttggaagtgcaaacaatcagtttatttagcttagggcgaaagatagacttggtaaaggttcaagggttacaaatagacttcaaccttttttttcttcgactgttttttttcttcgactgttatgtttgtaatttctatttctagaattgtttcagctaacatcctgatccacaaggcagagccctcacctagctattatatcatagacatggattttgtttaatatcataatgaattcggatggggataactagctatatcatagacaagtatttcgtttggtatcaatatgaattcgaatataaataagtccatttgatgccctaatcctttactttgtccaaaactcaatctttcaatacagtgcatttaacaacctaaacttttaatacagtgcatttgacccctcaatctttttcacttggttttcacctacgtgacgctgatgtgatggtctagccaacatagaaatcataggtcatatgtgttattctctcgtccctttagtactagctcctctagcttcatccactggtgatcatgaaggcaacatcacatagtgaatggtagcttccaatggctttctcgatagtagaggcttcaacaacaacgccatgtttgggaccatgatcatcccccttatcgctgccgccatgaggacaacattagggcagcgccagtgctaaatccagaatgtggagctccggctgattggaaagggaggtaccttggcatcattgattactcggctatcctcctgtgggttctagaaaatgctgagattaccgccgttgctctatcagctgggtcagcaaccgtggcaggagttggaatgggtgctgtcggtgcagtgggagtggcagcattgggtgcaagtagtatagatggccataaggcccgaggcctgatggcccggcccaagcacacacgacccgattggggtcatgcccgggccggcttgacctgatagctgggccatgcctgggccgatgccttggtacggtgggccggcccggcacggcccgatccaatgaggagggagaaaaatagttagggactaacattagacttaatgcagccatataattcactgcccaagagagaagggatgcaaatagacttattaatcattcagaaatggccccaagaaatgagggaaggaaattagacttctttttttacgaagaagcacgatggactgtcgtgccttcgagccggcccagcacgccccgagtcgtattgggccgtgcctggctcgatgcttcagcacatgggccgagagggcgcagcccggtgtattggtcgggccatgccggcccgatagattctggcccgagcacggcatgcctgggccgtgccgctcagatggccatctataggtgcaactggtcctgcagctgttgctggtttgactgccgctgcagtaggggctgctgttgctggtgggttaacagcagaaaagggtgtggcaaaggatggactaactgctgctgatcatttaggagaagatttctacaaagttctgcttcagcaagaacatttcaaatcaacacagtatgcattttactctatcatgaattattatgcatatttggcagtgttttttttcctctttgttaaatgtcgatcatttatagagtccagtcagtctcaaattatttgttatatattctaccctgaaccactgttctgctgtgtggctacaccgaagtttggctatcctaattacaatatatgccgcaacttggcatgattaaaagcttcctgtgatttcttagctgcaacttattgttgctaataatagtttggatatctgtcctcttcgcctcagttgaatattgcatgatgatcttctgatgtaaatcctgctaaccttcattttttctcattattgtaggttcgatcaattgtagaatcctaccgctggtctccttctgtctccattacactggacacttccatgcttactgtactaccgttgctaccgaagtacaggttaaggaatgtcccagtgattgagcctgataagccaattactcactccgtttcaaaatgtttgacaccattaactttttttagcatatgtttgaccgttcgtcttattaaaaaaatgtgaaatatgtaaaactatatatgtacataaaagtatatttaacaatgaatcaaatgatataaaaagaataaataattacttaaatttttttgaataagacgaatgatcaaacacgtactaaaaagtcaacggtgtcaaaaaattttgaaacggagggagtattaattaagaacttcattactcatactggtgttgttaaaggacttcagcagttgcaaaggaagggattggtttgattatatttcagcactccctctctcggacttgggacttccgtttatgtcacttgatgaggttattgcgtctccctaatccaattctttactaatgagaaatcatgtcccctacattatcaagataaaagttatatctcaagctgaaatgtacatttttttcacttcactttgcaatagattggtaattgaacaatgctgtgctttcttcaggttatcactgctaacagtggtgatctaatcttttaagcttttaaggacaacaaaattggtggtgtgcctgtagtagaaggtcccaacaagtttcaggtatcaaaccatccgactatttgttaccgcgtgagtcattttttaaattttgcatttccatgttcctaatgataaatcttccatacatacaggcaacttactgtcatggagttcatgaagaccataggctccaccgttcttgattcagggaacggcctggtgaagccacctctcacctgttcgcctgacgcttctcttggcagcgtgattgacagcattgcatcaagaataacccaccggatatatacgtcgtggacggtgacttcgaggttgttggtgtcgtgacactgcgagcacgagacgtgtgatctcttgctttatctatgagcctcctcgttattgtgacaactatttggcaccagccatggataattaagcttgaggacaaaggtgcaggttctgtggacacaagttgagcctttttatgtaacgtgaacaccaaaataacagactgaattagggagcatgcagtagcaacactgatgtattcaggtttaatttgtggtgttcctgcagtgaaagtgtgtagaacaagagtgatgctgttactccatggtctcttaatgtagtttgctttgtgttacttaattcctatatagggaaaagttaatatatcctcagtaaaagttcatctaacacctcatactttgaagtcagataaccaactctatcaacttcatagtactgttcgtataaccgctaaaagtaacttttatctaattattttattcggttttatctaattttacatgtacaatagatgaatttagtgacgtgacactcccactatccgaaaataactctatttttagtcttgggtgttcaaactaaggtcgagagaaaagaccaaagtctccttatcaacataaaaatagcattccattctgatgaatggatagatagataaaggacattgaaggagtaaaacttaaaacagtattgatgagtagatagataggtaaaggtattgaaggaataaaacttataacaggataaaagtgaacttatttttcatcaacaaaaaaacagtattacgagtgttttagaataaaaggtataaaagaaataagatttataataggctagaaatgaacttattttagaataaactgttcaggttagaaatgaagttatctttggaccgaggaataaatatattcaagatatatgtcaaattctcccttagactcttttttacaccaataacggaggatcgatacaatgacaataatcgaggatcaaggattaatgaagtgaaaatttatcatctttgttaaccaaaaccttattaagtatctgtatacggaaatcagcatgtccaaaacaacctcagaagttatatgaacaatattatgtagtaagttgaagcgtttaggttagggtgttagatatgcttgtatccaaagttatatttgtatgacgttagaacaaactgagattgtgtgccttcctcggattgagatccattgacttacttccttccaactttgagtcactgacatgtggatctactctgtcagtgacctacgtcagaattaagtagaggatcctcttttgtcttcctttttacccagagggatccgtgtctatccctccaagtactaatttgttttggggtgaatcgcttgtaaggtccttcaacttatactttaggttctatttggtcctgatattttatattattcaaaaagactttaaagtttatcatgtaacttaatataatccatatacccgctaaaaacgataacttagaatgccgcaccatacttgccttgcatacatggttaaaattgatattttgattttatccttacctatgccaatttttttaagaaaaagagaaataaagagaaaaggagagaaaaaggacaaatacaaatgtagtaaagacacaaagatacaataatcattatgttttgccgtttcctttcttctttcttatttcatacattcttcaatgcggtcaggtaaggagagcactccacacgtccacatccgacgcctggaagggtgtttcctctcccaacgcattaaggctttatgcattgtgcataaactctacagaaaggtatcaatgtcatttt

SEQ ID NO: 44234 - DNA, 7497 bp, Oryza sativa
ggaccatgggcaacgtaaaccatgcggtgggagaggatatggtcaccgccgtcgccggataagatagacattgcgcatggtttacattaatatagttatagtttacgctaatagagaaggacctgccatggccgctgctttatttagcgtttatagaggtagaacacaaggtaagttatatatgtagtttaaatgaactttcgtacaagatccggataagtgaatggttattcgtttatataaattcctacatggttacgcaaaaacttattgcgagttacatagccacagcagatccggactaaatgaatggattatgttctattaaataataatgttatgttgtgggtcagcctcacaaccagggtttgtaaaaattgtattttttttaaataaaagactgaaaagaccctgcaattcatagcggatggcccaacagaagtacatgaaaatagcccatctgcgttgtactattttactactaaaacccttacgttttcataattatgctcaagtttttacatctgtattccatttagcaccttaatatttttaggatttattaactactgttagatattttatttgatacccatagattgaaaggtaattatgtttgaatctctcaaaggtaattgagtaaatcatcatgtgactctcataggatctaccacaactactattcatcctccttggaacatttaaaaattggattacgccaagcaggacgacaggcagggaatcagcccatacaccaaaaaagatggattatatgtcaaggacaacaagggttacgccaagcacggaatcaacccatacactaccagctgctgtctacgccaacaagatgagagtttatgctacaaaatggtcaaattccaaggtttgtacgcgcacgcgggcatcgcgaggtgccctacatggtacacacccacgtgtggatctcgcgcgtaaacacatccatgctacgctcgaaaggttaatgtacacgcacgaaggatgagtttacgtctacgatccacgggcaggcatgaaccatatgtaggcaactcgacatcctccgtgtacgcaccaccaattacgcctacgtggggaaaccacatccatcctacgttcacagtgtcgttgcacgcgagacgcgacgtacgtgcctgaggcgtcgcaacactctgttgtcgctaatcaaaggacttgcaactatgcaatgagtagtatactagatatacgacgaagaacactgggatgcgaaagaaaaaaactctgaagtaacatctaacgataacaactccaacacttaacatggagatacgaaagaaaaggaagtctgaagcaacatctaatgataataactccaacacttgacccctcccccagcccagccagccggcacccattagcccattaggcccagcgtgcaagccaggcccaggaggtagggaaagaggccacgaggagggcgcagtcgtgcacatatgcacggtacaactaagggccgacgtgtcgatttgacgtaagccgtgcgcggtttacacgtacgcaggcatcgagaggtgctctacatgtggggcaggcgtgaaccatatgtaggcaacacgcgatcccccactcccccactccctgaccatccatgctatggtcgattgctcgaaaggttaatttacacgcacgaaggatgagcttacatccacgatccacgggcaggagtgaaccatatgtaggcaactcgcaatatgatcccccgcgtacaccatttacgctctaaaggttcacgtcaaaaattccccatttacgcatacagatgaatgggttacgcaccaccaattacacctacgtggggaaaccacatccatcctacactcacggtgtcgttgcacgcgagacgcgacgtacgtgcctgaggcatcgcagcactccgttgtcactaatcgaaggacttgcaactatgcaatgagtatactagatatacgatgaagaacactgagatgcgaaagaaaaaaactctgaagttacatctaacgataacaactccaacacttgacatggagatccacacgaggacacggtttacatgtacacggatgatcgcgagatcaggtgcccaacatggttcacgcccacatgtggatctcagacataaacacattcatgctacgctcgaaaggctaatttacgcgcacgaaggatgagtttatgtccacgatccacgagcaggcgtgaaccatatatagggaactcgcgatcccccgcatatgcgtaaaccttcacgcacgtctcgcgcgtacaacaacactgtgcccgaggtgtgtgcattatgcctaagtcgggatttcggacgtaaacacgtacatagagcgtaccgcctacaacacggtttacgcgtatgtgatggctgatatgctatttcgcgagtcgtgcgtgctctacgcgtacccggagatcgctaggtgcctacaaggttcacccctgtccgtgcctacaatgctttaacgcaactcgcaaaccactgtacgctaggcgtttacggcatacgtggatggtttacccacacgatgggattgcgcacataaacaggcacgtcgaacgtatgagtagaatcgatgtgtttacgtccgcaatccgaggacggtggtggcccgaggagaagaccttgacaaaattataaactatatatatcacattttcaatattttggataataataaggagctaacaataaaatcgatgatgtgtttggctcctaatagttgaaatataaaggactattatataaaacaagccaaaatgggcttcataatggactgccattgggatttactcctatcgttattcagtacacggttgagaggattacctgctaaatttaggtgggcctagcccaccataaatattttttcgttctcacagcatatactagagaagtgctatcgatcttatgtggctatatactttgtattttctatttgtagaccaacgtaaaccgaatgtaaccccaatcgcttggttttagctaggatcttctacatcagatcatttgtaccactatttacgtgtgtcgatgcaatggctttctctagacacgatctacattagaggcgcgatatagagcgtaaaccataaaaactagcacgtaattgaactttccactcgcctcttagctttccggggattcctttgtcctctctaacgaactctaacactgcgtacgttccttcggtgtggaatcacgacaagagtgaactaactattagagtttacactggtgtccaaatgaccgtcatacccctcggataaattaaccccattatttactcagctaacaggtggcgctccctcattggttgtgcctacctttatgcagctttatgctgaccgcacttaagaaaagctcttcttattttctatggtatatataaggtagaatgaacattttgattttaactatgtatgctaggatgatgtggcatgtatgtataacagtttcggtggatcagagactatatcaagtcacatgataaatttagaggtttgtttggacaatataaaataagggattaaactaatctctactattataaaaattgaagatgtttttgccggtattttagtacatcatctatgtatgagtcggttttttaatacagaaagaatcatataatagatttgtttaaaaaaactcgcatgctagcttgagacgatcggtcaaaccacctgctaactcctcccaccacccacctcttcttagctgtctcgcagaacagtgcagtaacacgacggtcaacgtgcagtaacactgcgtcttatgtgtagtaacagcgctcaaatattgttaacatatagtcatgatggatctacttttgataagcgttttttttctagcatcatggtgcaaacgattttaaaaaatagtacatcatgtgagagatattgttcttcaaatcttggcttttttagaatttgactctccacaagtagtaatgctatagcattacttgttactactgtcagttgcacgttactacaatcccatcgcatcgttactgtaagagtgcagtaaaaattataagtttttgcagtaactgtgttttactgcattttttggatagtgttactgcataaacatgtggtgacatgtacttgcctttgcagtaacactccacttttgtgtagtaacaaatatatttagcatgtgagacattaacctatatatcctccacatgcagtaacactatagcatcattgtgaaaacagttttaaaaataatatatatcttgtgagatattgcttttcaaatattggcattttgaactttagcactacatatgcagtaacagaatatgtaatttgtagtaacatgggtatatacatgcagtaacatggttttaccaaatgtataaaattgttcaaaacactcgtacatcaatcagacctcactcaaagccacctacagactttacctatagcccacctattcgatcttcatctcgtaaaactgacaaagtaaaactacgattatcgtgtagtaatataactacttggaagtggtaatatgcacctattatgtagtaacacttctacttttgtgcagtaacaagtatatggttagcatgtgagactttaacccatatatttttgtttcgattcctggtctactacaattttactacgacgttactgccaaaagtgcagtaacgtcctacgtgttctacagtaacgtcacgtgttactgtacttttacaacaatgttactactggagcatagtagcatgttatgagtttcggtagtgaaagatattagaattgataatcatattactttctcacaaaattcttgaaacaaatagcatcattagatgaattggttaaaagaatgtgctttgaactatgaggtcatgtgttcaagtcttgaatttggcaatttattttttatttttctagaaaaagagaaataatctttcagggagaaaaaaaacagaaaaaagaaagagagagagatcgggaggagggagggggaggggaagcgagagagagagggagggggtatagaataactattctatactcgggtgtagaatagtcttaccctctatatatatatatatatatatatatatatatatatatatatccaagcgaactcccacagtgaatttcatcttaactaaaccatataataataataagattaaaatagacctcatccgttgcaacgcacgggcattttttctagtcatacaaaaaattaagagaccgcattggctattcactcttgttgtggaagataaaactgtgcaagcgtaagtacgtgcgcaacatgctagtgatgccatccccggttgctcacttcacagatgtaggatctgttttgttctttgccaatatcaaattttgggcaatagcaagaagtagtggttaccatttttttttggtaaagatgtactttatcgactaattatttatccatcaactgaggctcaagtaatttattgattattccaatgattaatgttctagtgcgatttttttagataatatggttcaatgtaacccttcatgaagtataaataaaccacttaaaaaaataaaacacccaataaaaagagaatctcttgtatcatagcagaataaaaaacaggacatgcacaaacagagccaaagggaaagtgcaacagctcatatagtgcttaatatccataacaggatatggcacataaagtagtaccatggatatgcatgcgtataatgttgtaagatctgatcttagaaggaaacaaactggataaaatatatctctatcctctggccggccactgcatgcgctaatcatcctcagcccatgcaaaccaacgccaaacctcacttcatgtgaccaatcagcacgtatagatgagatagaatccaaattcatctcggtcacctcccttaacgctagcacagacctggctcctggttatgctttttttcagatcaacaccagaaggctttgattgcaatgaaaaatacaagaatccatatcatgtcttcatgttgtcaagctattcactgtgcatccttgctgttgtccatctaaaaccatgcatccatcaagcaccagcagaccaaagaacatgatgatctcatcaggcgtaccatctgcaccttttacagcactagcccaaaatctcatatacataaatctaccgaactacatgctatagttctctgctagtaactatagcaaataactgatacttctctgcacacacgcacacacgcacgcgcgcgcaacacacacacacacacacacatatatatatatatatataggatacccatatatatatatatatatatatatatatatatatatatatatatatatatatatatatatatatatatatatatatatatatatattaaaaatggccctgtctaacattttaggaagcgtgcaggcaggacctttcgacgacaaagagacagcgtgagtgcaattgggagagacggcggcagtggcgcttgcgtgagtgcaattcggagagacggcggcagtggcgcttcaggcagccgcacgttgctggaggggcaaggcggagggatggcagcgtgatctctttgaaacaaggggcgcttccggttgtgtgcgtgcttcaaacaactttgtcttctccatattaccacatctatagagtctaattttctatgaggaactactgagttcaaatgcgaagacggtataataatacgctatgatgacaatgcaacggatatcattagtaaaaagcaaatccaaatggaacttgcgtttttggcgcgatcgtcgagtaattgagagaattgaattttactaaaatagtttctagcttatgaagtattaactgtcaaaagggaaatttgagccttctttgttgtacttgctaattcaatgtatacacatataagctgtaacagatggtttcatatttgagccttttttttgctgtacaagctcattgcctgtaacaaatgctcattgttggaaaataagagagatcaatctagaaatcagctcctctagttgccaagctgcaaacgcatgtgaatggaaaaaacaacacagtgggtaagttaggagaaggtgactttttctctttttctgaagtaaaggttggagctttgctcattatattaagaagttggtttcagactataattcgaggatattacatagaacaaaaagcaactgaactttcaccataaactccattgcatagcgaatatagtaagaagcacggccagtttttttttttgttaaatttcctgcagatagaaccttgggtacaaaaaccgatccaaagaacatttgcctgggttcatctggtgcccaacataatgcttttgaaatttgtacaggtcattgaatgatgacatgagcactgattgcagctatcaatgcctccaaaaattctaagctattattagaggggcatcaagcttacaaagttatcttgaaaggagaggctaagtggctatggagaa

SEQ ID NO: 44235 - DNA, 29363 bp, Oryza sativa
agtctatttatgcaagccaatttatttagaaaagtgttgagcgtataacatctttttttcagaaaaaaaataaaaaaaagaatttgaaacctatttaattactaccaaaacctaccaccatacccacaaatgcatgatcaaaatgtgcctataatctggtgaagggaggtgtaggtgccaacaacattgacgcacactcctatgaccagtatcccgacaatcatcgtcctctcgaagcagccaactcctcctcgggacatgtagatcttgagatagctcaggcacgggaccagcacagcaacggtgacgttcagcgaggacccgatgaacaacatgagatagccgaagaagggcaccgtgcatgccagcaccactgtgctgatgacgacggctatgctggtgagcaccctggtcaaccagttattctcaacgtccgtcgtcgctgacaacttctcctctatcgctgttgtgactggctggatcacaagcgtgtagttcgccagcggggtgatcagtgtcgtcaggatggcaaacctggtgtacagcttccctgtgggtaagttctgtgtcacctgcgactgcacatcctcaccatagatcagatatctcaacactactgtcactgcgtagtttaggctacacaacaccgacgagatcaacaaaacctgcacattaattggagagtaatagaacattattggagtactgatccatcatcatcatcatcatcatcatcatggtttcataaaccaaattatgataattggaactgataatccatgatcaattatcattggttgccaaatccctccaagtgaaagggaaaacttaaaaatgcaacatcattgagcaacatcatctgaagatatggataattgaatgcaacgtttgatcaatatctatcgttagatcatggatatgtatcagtaaaagaatggtgaaaggtccaagattgttcaagaaacttccatgagttaatggagcaatagtcaatctcctaccacttttgcatcttatccctaaaaattctcatacctattggttgagtctaaacttagtacaaaaatatatacaacacaatagatctctattttaacttggcatagaaaagtttatgatgcagcacatcttccaaatttagatatgttgccttttaatttatctaaaattgtattggactatacataaaattacttaaaaacaaattttgtaaactatgtattcaaatagctaatataattctttcgttttaagtgctagacacatcttctaactttaggtttaacatacaaactaaataacattaggcggcacatgattagctttatatttaagctacattgcttttacatgggtgtgtatgagtggtaaccaaatatagttgagaggcgaccctaattgcctccagtcaccggtttattccgctggagtgataggctgtactgtagcacagtacaccttcatgtcaccgcacacgttaaactggtcgaaaggccaacccaacattacccaaaatttacgtcattatgcaaaaaaaatattaatgctaaattgtgaatattgcacttgcaattaatttcatattgcacccgccattctatatcagtgtaaattaacattacgaaattgataactagtacaacattttttttagggatggaacaactttttttaataaatcattttaatgttgatttcatttgatcttaattcttaattttaattggatggtcaaaataaacttattggcttaacttttatttgcatgatgtatatacacctgctatatgatgggagtgccaacaaaatatattaagtatgatgagaacgtagcaactatgatgattaagaggtgtgcaagtatagtatgcatgattattgatgtatgagttctaaaaaataattatgagtgtgcgcgtcttccatgcatacatgtaataaaaaaacaatatgtttgtattcttactaaacctgttgctaatttatttcaccatttactattcaattttcattaacgataattctaaatttacattgttagttgttatcataaattttaccaaacttactatcaagttcaacacataaatacattttaaagtgtaccttaggaaaatccttcttggacttcattgaggagtacacggtcgggaagacgccatggccggcgaagcaaacgaagtagagggtgagggcggtgggcaacccactcagattcaagaggttgttgcccgccatgtggaagcccttgtcgggcacgccggcccagaccccgtcagcgccactgacgagatgagcccgactaccgagacataggtgagcatgctgaggttcttgagccacgtcatcgggaggatgacggcggccgtcgcgagcacgaacagctgcttcccgtgcacttggtaccctaggatctccaccaccgtgctggggaggagcttatcgaggttgtcgccctcgaggatgaggaagctgatggcgacgaggtagagctcgacgtacatgacgaggccgatggtcgtccagccgtaggcgccgaaggcgaggtagccgatgtctgggtagctccgtacacagcggtcggcgcacatgcagcggtcgataaggttgccggtgtagaagcagatggcgccgaccatggcaaagagcgccaggctaagccacccaccctgcaacggcataaccagaaatcacattgctaaagttgaggcagctcctcctgaaggaagcaccggtgatgcagaacgagacgccgtcggtagggaagagttgctgctccatgtcggtagggaggaggagctgctgctccatgtcgcaaatcatatcttcttctcgtgtttgctatggaggagagcctcatcgatagggctcttatccgccaccataatccccatgtctgtgtgtacacctattaaaccaaaaatcacccgacagatttttaaatcaaaaacacttagatttttaatagttacataatacacatatggaaatagcatgtataacttatcatatgtatcataacacataattcattattaaagataaccttatagttaaaaataaagtgcaacttacactcagtgaaaaatagaaaaaaataaattacatacaaatctaatagagattacattgtaatttaggcctggtttagttcccaattttttcttcaaacttccaacttttccatcacatcaaaacttttctacacacacaaacttccaacttttccatcacatcgttccaatttcaatcaaacttccaattttagcgtgaactaaacacacccttacaatgagtgaaaatgtaattattacaaattacactgtaaaagtactatatttacactgtaatttttttcctcgacttaactcctctctctctcatcattaccaggctttcatgccctgtatgcttttgggcaaagtgaagttgacaggaatgagtacactagacgattaaaaacaactttaaaatatttaattagtgagagacaaagataatcagtcatatgcatggttgtacaataccacgtagtccagcacacgcgagttaagagtttcgtgggagcgctgacacaaagaggtcacggatctaaagtttcgattaacggttgaaaaatcgacaaatcttaacggaaaaatttgtcgaggtatttttagcttaattgattattaattgagagttgagatgagatctaatttagaatgggcagaatatgtgagattagttatatgttgatatatcttgagtcgataattcatgagcgtaactaactggggcgctagatcaagctccaactcttctgtgctcatttgcacttcgtggactcgtacaattggtaataaattcgctttttcttctcctattttgtgtccacggttcaccattacgtccacaaccggtagagacttacatatgtaatcttgggacttacattgtaaatacactaaaattacatatgtaattttgagacttacaatgtaaatacatgttgactattttttcatgaaaaatatggcggaataaatatagatactctcaattaataatcactttaacgcgcggcagcatactgctggactgagagagcaaacaaaataataatctatctattattcccatgctggttgttttgccgcctgcctattggtccaggtggcacaacgcttttctgatgcgtgtacgatgctgcctatacacagttgtgcatggctcatgtagcatcatgggccaagtgccatgcacgattgaatggactaggtaggcccacgtgtgaagaaagaaaaaaaagaaaaagattgatctatcactgtacgtattgatttggttgcttctgtttacaccgtaattttgacaaattaatccttatattaaaactttaaaaataaaccatgtcaaaaactaattaaaaaaacagaccgtgaccttagcgccaaccctaatgacactaaactaaaacatctcagcaccacccaacatggcacaaattagccatgtaaaaggaactcaacgtcactatacattacgatgacctcttaataggtttaaaatatatagcatgtgctgaaatcctgagtagtgtttaactttattcgttttatcaaaaaaaagtgcctataagtaataaaaatagacaaaacaattttaaaattaagtagtgaatttaaatttatacaagtaattcatagcacatactacgaatgcatatgtaattttcaattattaaataaataaaccaagattagtattgctatgtcttaaacatatggtaaaggttaacatatatactttagagaagtgctctcacgaattgtgcttatcgttgggtattcttgcaaaacgctgttaatcctagaatgaattcatactggtacatgtatgtcttcctgaaaataggaaaggaacgtgcatttttttcaaaaaaaaaatatatgttcaatgtgttcaaatacaaaacatgcaatttcattaaaaaaaattacttattaacccaataaaacatagctagcatatgttaccactctttctgcaacctttttacaaacacaaaagtaagaaaaaatatttaagagttttgtggacatgagactgtctatatgacagccagctgaatttttgggtagtatcagccgaattttggatggtggaatctttcctaatctgacacgtgttaaaaatcctaatgccgcccaaatctccaaccactggttgacgtgtgtcacgatgagttctattttgagcagttaattaatgggtctgtcattgtcaatatcagttcaataaaactctgttgctcaactaaaatggcacgtcaactattcttaggttatgcggttctgctatacattacttcttctgctacacatcatacatccttttcgttcaagttgaccagctttatatataaaaaaacatagtaaaacttttgacatgaaataaatattatttaaaaatatataaaatgatggatttaacaaaaaaatatatgttttatcaaacttaaaaaagttggcttaacccaaaacgtccaaacaactttaagtttggccaaatatatagaataatatagtaatattttcaacataatataagtatattgaatggtatatttagtggaaccaatttgttgttgtaaatgtcactatgttttttataaactttgacaaacttgaaaaggtttaaacaaggacaaacccaaaatgactgaaaacacatagggagtagtacttaccgaaaaattatagttttattgcttttcactatctatcagccattaagtccattaagtaaaaattaaatttttttctattaatttcctactgtatagtcctcttcagtgcacacatcgcaattatcttcacctgcacgtgcttccaatctcaaaattataataaaataagagaagggcaaaacaaaaggaaattaaccctcgggcaagagatacgtatggaggtagagtcacaatgaaggaaatgaaagaaattaggttgttaaccaatttttcttatggaaacataatttttaaataaagcatgtttctctaaattttacaatgaaacaagcgatgggcagattaagaaaaaactagtgttcccaagtcagtgacggtctggcggattcagcatgggtggccccgctcaaacccctcctacctagttggatcaccatggagagcaaggagagtgggggagaaaaagaagagtagagggggctagagaaaggaggcacagatccccctctaattcaaagctagatcatacaaaacacatggtcctaatctacatatatacggcattagaatttgcagacaaaacaaagagtatggtgaatggagacaaataacaaaaaagggatataaaacgagcatactggtagggttaggagaaggcgcacacatgcagggaggaggcgccattggacggaagaaagggatatatacacctttcgttttgtaattatatgttgagttccgttccgaacttatatcagtatatcagtcaggtacttcgaacttaaaaattggtagttgttttcgttggattactctatatacctaataaaaaaattagtaaggcttccgtgagtttttttgtccgtcgtttttttcgctctttcttccttcttttttcccgtatttcttttttttccgtccggccttttttcgttttttttcttttttttccatgcgtcccttttttccgccgttttcctcttttttttctatccacttttttttcgacgtcgcttcttcgggttttttccgtccgctttttttgtcctttttcttcttttttttttgcacgttttttccttcttctggttttttcatctgcttttttccatctctattttttgtcactttttttggcacgcggtgaggattcggtttctaatccacttggtttttttttcccattgccaggatttaatctcaagctgttgtcctggccaaaccctagcgccaccgccacagtgatatgcctcccgtgcgtttcctactataactgattgcaaaaattgattccccaatactccctcattatttgatttcctcttaaaattcggctttacatcactagatttaatctccatttaacagtcatcattttcccataatttccccttttcaatttggatttaattcactagatttaatcttcgtaagccggtgatcttccccttatcgtttttatcccaagttttgtggattcgctctgatttgggaaaatctgaaaaaagagatactgatgtttctgctgttgtatcactaaaagatgtcttttcccgttgcaacgcacgaccatttttttcttgtcccatccaaattacaggagcaaggaaattacgaaaaaaacaagtatagaaggatatagcagaacattcagggtaactggccaaataacaacaatagggaaaaaagagaagaaattatagcaacgtagctaatttctcacctctcccaccaatttgtagatcgatggcggccacggcgcgcgcaccgcctacaccacaaccgcacgcacgggagagatataccggtggagacgcgcgtgacaacaatgacacggcgagctgtggtcaggagctctcactagcgggggttatggaagaaggttaaaagaaaatagcgggagaggattagatctatatatggaagaaggttaaaagaaaaaagaaaggaaggtagggttatgtcacgtcccaaaacgactctaaaatacatcctctaaattatgcctagaataattaaaaaccgtgtgaaagcctccaacaattaaaatgtgcaaagttaaaagtcaaacaaggcttagaggatttttgtatatttcctaaaaagcctaaaatatgtaaataaattttagtggaattttcagagcacaaataataattgttaagaaataaacaaagttaaaaaggttttataaaaagaaaaaccctaaaatccctccttctctctaatgggccaacttcggcccatctccctccccctctctctcctctccccgcggcccactcggcctctccccgcgcgcgcgccgctgacgggtggggcccacccgtcatccccgtcctcccgccgctcccgccgctccgcctgcgccaagcgccaccgccgccgccaaatccgccgcatcccgccgtccccgcgtgcaataaagtgggggaaatcactccccgtgatcccctctccctttccccccatctttccctctctctctcgcgttcaaatgggcggatttgcccccgcaaatctcgccggcgccattgatggcggccggacctcccgcgccggtttccttcccctccggccgctctctcccccttccaaccctatttaaaccctccctgcacctcctccgtccgtttccgcctctcgccgcccttcctccttgccggattcgagctcgcgacgtcgctctctctctccgccgtcgccgccgagctccggtccgccgccgtcgtcgccccggaccgcctcccacctcggcgccgcctccttcgggttcgccgcatcttcgccgacctcgtccacctctccgtttcggtcgccgacagccggaacgccgtcaaccccgtcgacccgagccgcgccgccgcctccctccgctccggccgcctcctccgtcgccgccgtcgcccaggggtgagccgtggaccgtcgcctcctttcctccttccctcccctctctcggccgccgctccgccgcgccagtggtcgccggcggcaaccatcgggacacgggcgcgccgcctcccgccgaccgcgccagcgtggccgccctcgggcgcgccgagtggctgccgcgtggggcccggccgtcagccgcccacgccctcgggtgcggctgacgtgtggggcccacggcgccggccggtgtgagcccgggtgcacccggtccaccgtggaccgtaaggctgccgcgtgggccccactcccgtggacccggtccccgcgccccttcccctcggctgacccaataaaccctttttaaattaaaatttaaatgaagaaattcgtaaatattcatttaaagagcatataaacttcaaatggccataacttggccatttgaactcgaaattggaccattcaagtctctaatttttccttaagaagtcaagaacccatttttgtgctttgttcttgctggttatatggagtttattagagtaaaagccttttcttttccgttggtcgtgtagacgctgcagctttggaagatccgctcttcgtggaggttgaagccgacgtttgggaaagcgagcaaggcaagtcacatcatccttgaacatattgaatcccagtttataaaattattttgatttaaattattgcattatcgctttatttaaattcccgcgttatcattgttttatctagtcatgcctatttacttttgttatgaccttattattgttattgttattattaccttgttcaccctagaataaacaaaaccccaactagtggacactctactcatggtaccactagtatgaatttagttagatgcttcgccgcttaattaggtaacattaggtggttttacaactctagactttgggatattcatatcacctggacactacggaatggttggattattgtggaattggattcacacctccccctctattcaaaatcctcaaaatggttttaggctgggctcggggtgcatggttttgatagtagcacctcggccatataaggaccggtcttcgggcctctattgcaaagcactaccgtactttcacatgtctagtgggtaaggcttagtttgtggctcagtctggttataaacaaaagtacacggatggagatggacgaagtcgggggtcgatggacatctctaggacaaatgaatgctacacgagctgcggcctggtagttgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttttaattcttaaaacctgcttaacaactaaaatgtggaatggttggcctgggttggcttgggacgagctgggacccagggtcgggtttccagttcggtctgaatcatagtaggccttacgttaaggcaggttcgtgtgggttcacggccttgattaataatcttgtatagctctaggatcgtatttacaaaatagctttgagcaactaagtgtcttttaatgctgtttactgcaaaccctaacccttcatactataaccccccttgtactcccttgcatttattctgcacttgtgggtgtgtcttgttgagtacggtggttgtactcagtcttgctcaatttttcccaaactcagaagaggagttcctggaagatcaaggctttggtgtctagctcatgcctgccgtcaagcgcctgtggtcgtcgccctagtcttccgctgtttcccgtttgtctttgtgtgtgctgggccttcgccgcccatgtaataaattaattatttacgcttccgcttgataaactctgaaatatatcaacttttgggtgtaccttgcttcctgggacaaggaataatacacgcacgtaaggaacgcccgttgggttattttcggtcgtgacaggttaggagaaggcgcgcgcgtgcgggtaggaggcaccatcggacggaagaaagatgatatatacgactttcgttttgttattatacattgagttccgttccgaatttctatcagtcaggtacttggaacttaaaaataaattggtagttgttttcgtcggattactctatatacctaataaaaaaatttgtaaggattccgtgagttttttcgtccgtcgttattttcgctctttcttccttttttttcccttctttctttttttccatccggccttttttctcttttttttctttttttccgtccgtccattttttccgtctttttcccattttctttgcgtccagttttttttcaacggcgtttcttcggtttttttttccattcacttttttttctgtctattttttagtcagattttttgacatgcggtgtggattcggtttttaatccacttggttttttctgtcgccgggatttaatctcaagctgtaccgccgccacattgatctgcctcccgtgcgtctcccgtgcgtttcctgctctaattgattgcaaaaattcattccctactactccctcatcatttgatttcctcttacagttcggctttacttcaccacatttaatctccatttaacattcggcgtttccccataatttaccatttcaatttggatttaattcactagatttaatcttcgtcagccggcgatcttcccctagtcgtttttatcccgacctttttggattcgctccgatttgggaaaaactaaaagaagatatactgatgtttctactgttgtatcactcaaaaaacgtctttacccgttgcaacacacgggtatttttttctagtcccatacaaattagagaaacagggaaattacgaaaaaaaaaaacaagtacataaggatatagctgaacatgcagggtaactagtctaataacaacaatagggaaaaaatcggaacgtagctaatttctcacctctcccaccaatttgtagatcgatggcggccacggcgcgtgcaccgcctataccgccgccgcacacccgggagagatataccggtggagacacgcgtgacaacgatgacgcggcgagctgtggtcaagagctctcaccagcgggagttatggaagaaggttaaaagaaaatagcgggagaggattagatctatatatggaagagggttaaaataaaaaaaaggaaggtagggttaggagaaggcacgcgagtgcgcggacgaggtgccgttggatggaagaaataggatatatatgcctttcgttttgatattatatgttgagttccgtttcgaaatcagtcatgtacttggaacttaaaaattggtagttgttttagttggattactctatatacctaataaaaaaaatttgtaaggattccatgagttttttcgtccgtcgtttttttagctcttcttcctttttttttctcttatttctttttttccgtccggccttttttcgcttttttttcttttttccgtccatccgttttttcgccgttttccccttttttttccgtgcactttttttcgacggcgtttcttcggtttttttccgtccgcttttttcgtcttttctttctttttttgcacgttttttccttttttccatttttttcatctgctttttgtccgtctctgtttttttagtcacgtttttttggcacgcggtgaggattcggtttttaatccacctggtttttttccgtcgccaggatttaatctcaagctgttgccctggccaaaccctagcgtcgccgccagattgatctgcctcccgtgcgtttcctactataattgattgcaaaaagtgattccccactactccctcatcatttgatttcctcttactattcggctttacatcactagatttaatctccatttaatagtcatcgtttccccataagtttcccttttaattcggatttaatttactagatttaatcttcgttagctggtgatcttcccctagttgtttttatcccaagttttgtggattcgctccgatttgggaaaaactgaaagaagagatactaatgtttattctgttgtatcactaaaaaaacgtctagacccgttgcaacacacgggtattttttctagtcccatccaaattggaggagcacaagtatagaaggatatagcacaatatgccgggtaactggcctaataacaacaatagggaaaaaagagtagaaattataggaacgtagctaatttctcacctctcccaccaatttgtagaccaatggcagccgcggcgtgcgcaccgcctacaccgccgccgcacgcccgggagagatataccggtggagacgccgtgacaatgatgatgcggcgagctgtggtcgagagctctcaccagccgggattatggaagaaggttaaaagaaaatagcgggagaggattagatctatatatggaagaaggttaaaagaaaaagaaaggaaggtagggttaggacgtacggggagtaggcaccgtcggacggaagaaacatgatatatacgccttttgttttgttattatatgttgagttccgttccgaacttttattagtcaagtacttggaacttaaaaattggtagttattttcgtcggattactctatatacctaataaaattattgtaaggattctgtgagttttttcgtccatcgtttttttcgctctttcttccttttttttcccatgtttcttttttttccgtctggcttttttcgctttttttcttttttttttctgccgttttcccctttttttttccatccacttttttttcgacgtcgtttcttcggtttttttccgttcgcttttttcatcattttttcctttttttttgcaagtttttttccttttaaagtttttttcatctgctttttttccgtctctattcttttaatcacattttttggcacgcggtgaggattcggtttttaatccacttggtatttttctatcgccgggatttaatctcaaccagttgccctggccaaaccctagcgccgccgccacattcatctggctcccgtgcgtatcctactctaattgattccccactactccctcatcatttgatttcctcttacaattcggctttacttcactagatttaatctccatttaacattcgtcgtccccctataatttcccctttcaattcggatttaattcactagatttaatcttcgtcagccggcgatcttcccctagtcgtttttattccgagttttgtggattcgctctgatttgggaaaaactgaaagaagatatactaatgtttctgcggttgtatcactaaaaaaacgtgtttacccgttgcaacatacgggcattttttctagtcccatccaaattagaggagcaaggaattatgaaaaaaaacaagtataaaaggatatagcagaacatgcagggtaactagcctaataacaacaataggaaaagaaaagaagaacttataggaacgtagctaatttctcacccctcccactaatttgtagatcgatggcggccgcggcgcgtgcaccgcctacaccgccgcctcatgcccgggagagatataccgatggagacgcgcgtgacaacgatgatgcggcgagctgtggtcgagagctctcaccagccgggattatggaagaaggttaaaagaaaatagcgggagagtattagatctatatatggaagaaggttaaaagaaataaaaggaaggtaaggttgggagaaggcgcgcgcgtgcggggaggaggcgcgtcggacggaagaaagaggatatatacgcctttcgttttgttattatatgttgagttctgttccgaactactatctatcagtcaggtacttggaacttaaaaattggtagttgttttcgtcggattactctatatacctaataaaaaaatttataaggcttccgtgagttttttcgtcggtcatttttttcgctctttcttccttttttttccattatttcttttttttcgtccagccttttcttcgtttttttttctttttttccgccgttttccctttttttttctatccatttttattcgacgttgtttgttcggtttttttccgtccgcttttctcatcctattttttgcatgtttttattcctttttccagttttttcatccgcttttttccgtctctatttttttagtcacattttttagcacgcggtgaggatttggtttttaatccacttggttttttccttcggtgggatttaatctcaaacagtttccctggccaaacctagcgccgccgccacattattctgcctcccgtgcgtttcctactttaattgattgtaaaaattgattctccactactccctcatcatttgatttcctcttacaattctgctttacttcaccagatttaatctccatttaacagtcgtcgtttccctataatttccctttcaattcggatttaattcactagatttaatctttatcagctgatgatcttcccctagccgttgagggagatccgtcttccccgtgatctcgtagtaggatgtgcattatcaactcaactctgctcatgtccccttctgtcgccgtctcgatgccacatattttaagatcggtgtttgtgctgattaggggctgttacatactacctccgtcctaaaagaaaatcaaaccctacggatgcgtgtgtccagattcatctctagagtttgattttttttttacgtatgcccagattcattcctaaggtttgatttttttttacatgtgtccagattcattcatagggtttgattcttttttagacggagggagtaagtgaataacaatttctcttgaagataaattgaacggttttgataattaaggtgggtccaatgccctattttagaattgggcggtgtatttaagataaacatagtaattcaggggatcaaatgggctcacccattgtaatattggaactatttgccacgagaaagcccatagctgtatagccgatttcttgcaccattagtgtgcatctcgttactactagttgggtttcgcttgtttcaactataatttacattccagagctaattttgaattttataactaaattttagaataaatttaggtgttcttttaatctctttcatcaatgaccgtgatgttcggactgataagagtaaaagtgtaaaagtcttaaacggacccctttagatagcagaaatggcaaaacacatgaatagaaaaaacacaatacttttaaaactgtataacgtgcagtagtatcgatcgagacgaaatacacatatacaaattttcaatgatgatctaatgctgtatgtttcttgattgtgtataatataataataagacaaacagaaaaatatgctagtgcttttgtctaaaactgcctgtttggaacaacatatttgggcaattggctaagatatgatataaaatttacccgtatgccgtgatggatcgaggcggcacacttgtcatctttcggtaatacagtaagagttgggccagaatagtattgtggctgacgtgtgggcccagcttagctgaaatggtattggggcttaacaatttttgccagcaaccttaatttgtctattattaatacactacgtttcagtactctgcaaggttacatatcccagatacagaaatctgcatgttccaactacttttacccagtcgtgtaggcttcgatttactccacaatctgcgtacagaatactgctgtttccagaaccaattgaagccatgacaccaatgcaacagtaactcatctgcagtatcatgggttattcttccatgagtcacagcatgtaaagtgagctagatgaatcatgatatcgcagcaagcaaaatacagaaagacaaggccaaatagcaggtacttgctccagacatccactcaaatcaccattacggatgaaacagattgaaatgacagttttttccgtccaatttatgttcctacccttaaaagtttattaggaaattaactatgaattaacccagtcacttctatattcatctgcccgatgcaatatattcctctgaacctttgttactgaagagataaaaaagatatcctcaaattaggcctgaaaagtgagctactggtagaatggtagagtgcaagatcaaaactcaagtttcattatctcatcatatatcccaaactactcctgaaaaaaaaaacactgcaagggtagatgatatcaacagtaataatgtgcaaaagctccatctaatgacaatcacgattatgcctccatcagtaactgagagccttcctctctaatcacaccccagaaagcctaactgagggtcttcgtctctaatccgactaaatgaaaaaaaacactgtaagaatcacaccccagaaagcctaactgacagtcttcgtctctaatccgactaaatgaaaaaaaaaaacactgtcagctgtaagggtagatgatatcaacagtaatgtgcaaatgctccatctaatgacaatcacaattatgcctccatcagtgactgagtcttcatctgagaaagcctaactgagggtcttcgtctctaatcacggcgcagaaagcatccctgtgacatgcaacatgaataacgtcatcagaaattcagaaacagatttcgttaataaaaaaagaattcagaaaagatcagttgcaagttgcaatcagtaaagcaattggcgcggatcggttgcaatcagtaaagcaatcggcgcacctcgatccacgtaacggagtgaccaacgatcagcccgagacccatcatgacgtagcaagccgcgtccaggaacctgccgctgtcgccgccgcgcacggcggcgaggtagatgacgtagagccccagcagcgccacggccatgatggcggctcgccccatgttctcctcgctcctggtgtaccgggacgggatgcgcgcggcggcctcgtcgtcgtcggcggcgcacgccgtcatcgccaaccccaggatcggccccatgagcagcgcgccggccagggcgatggcgcacagggccacatcgcccttgctctcgcaccaggggaagatctcggcggcgaacacggccaccatcgcgacggcggcgatgatgcagaaccattgcgggagaagccacatcagactacgatcgaatccggcgagaaaaaaaaaactgaggaaatcaacacggcttaccctaatcgcgaggagccatgggggcgtcgggttgcacgcggctgcgaccggaggcggccggccttcctcgagcaagcagaaccggagatcggccgccgccgccggagtattccccatgccgccgcggccaggggagggatcgagagcgcgtcggcggcggcgagtgtgcggcgagatcggaggaatttttttcgtttttagattttttttaatatttacagaaataatctatcgaccaaaaaaattacagaaatagcccctgccgccccaatggtgggcggcaagctgacgtggcagacggtgggtcaaccgcgccgtctgccaccgtcggccaaaattgcgattaggcccttgccgcccatacagagggcggcaaagggctaattgcaattttggccgccaataaagagcttgcggccgtacttttttcatctgggtcccttgccgccccagatgtaaaacgtacagccaaaagatttttctatgttatgttaataataaataaagaagtatttattggtaaaacttgttaatattgttataaaaatgtattgaagttggttgttgcgcaatttcatatgttaagtgagatattattttgtaccatattcgacgtattagtactcggataatttatataggcctatcgcagtctgggtcgtagaaacattatatggacttaaataaggagaattatgtaacatgaagaaatagtagtacaatttgaacatgatacaactatttgcattgcggttacatagatgatattagattcgaactaggagggaggtagtgtaatagttgaacacaacgacgatgtagtaatgggacaaggaagcatgacagtagaaatttcaatatgccaagttgtccgataatagctaacccctacgttaggatccctctcctctctcaaaccgcgctttagtaatcctgtattgctctggtagttcaagctgcacaacacggctaggtggagttagaacccttctggtgtctatccattctctatattgacatctccttggtggttcctgggaggaaagaatagatgtaaagcaagcaaagttagtaaatattgtgagaaaataaggattcatgtaatcaaaatattcttaccatgaaatcatcgtcaagaatatttggacaaacaaagaaccttcgacccaatgttgtaggatttatggaacgaagaacctgacaacgatcaccacacctgcatcttggacgggcttcccatggagggagtgcgtagttagcacccgccagtcgctctgttgttcacgacattgtcgttcataagccgtttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcaattgcccgtacggaataaataagcatatgcagataataaaatacctcacggtcatagttagggcacctaaaaaagcgccttcctcgaatatcaggattcctcgaagccattagttggcatcgatcaccgcataggcagagaggacactggcaccaaggtggtagtaggtatacacaaggatcgctacgccagtttggatcctcaacaccccggcgtctagccattgacaaaagccggtcggatttgtaatgaagcaagtgggaaagagagtactgaatgtgactgagttctgaaagattgtgaggcctcactcgttaaggcgacttatataggcgcaaaaaatcgagtgatacccctgacatgtgaacgtggtggggtatggtgggtacggctgattggcgccgaaagttacatgcctgatcggcgccgaaagttacattggtcgtatgcgccaaatggcgggcaaatactcgtatcgcacgcgaataaaggaggctgcatcggtgcggcagaaagtagtcgtgcatgcgctgaaaggtatcgtgcatgcgccgaaaggtatcgtgcacatataacaaaaacgtagtcattacacaagcatacagtactagaaagtgaagcaaataaacaaagagaagactgctctactggccctgccccacgccgcgaccacgcttggtcctccgggcctgtgcttgcacgtggtcctgggagtaggtgaaacgatccggtggcacagcacgggtagcacgagtgtcccgcggaggagtggcctgcgcctggtcctgtgtctgcaccggcggtgcgcctcccagctgtgaggggccgatgacgtcctctgtcaagcctgaagcgaagtcgaagtcagaaatgtcgaagagcacggtggaaggcagcaagcggtccgacgaggtcccagcatggtccagtggtggaccctgactcgacgtgctagctgcctgtgacgaagtcccggtgtactgccagaactgcactgagtgcgaggtcgacgcagctgcctgagacgctgaccctgcaaactgggagaagtgggcggcctgcgtcatagcgaactgggcgaaacctacacatcgacaacgggacccttgtaagctaagacataaaatgcatgtaaattgattgtcgaagtaatgttgtttttttaagtacctgtggggggcacaacagaaggcctagccaaggaaggcggggtgctgaacagtgcacgaaaccctgaagcaatcggcaagtgaaacagctcacttatatgtgcgaggcatgtacagaaatagtaataaaaatacttacctccgtgcggagggggagtcggcctaggaacgtgcgcagctggacggggaccagtcggtacgggtggccgctgtacagctgcatctgcccgagcaacgtcgtctgcacgacaggtgagcactcggagaatcgagtgcatcgactccaccatccgcgtgtatgtcgtcaggtgctcctctacgggtaccagaatccccgcgcctaaacgttggatcgtcgttgaaccgtcaacgacgacccggttgatgtcgtcgacctgcatggttaatttgttcgtaaatattcgtaaaatttgacgaagagaaagacatgaaaacataaaggaatggtgcgatgcagggtactcacagcacgagcgaagtcctggtcgcggtgcctggcgtagaggtctctagtgctcgcaacatggggctgctgctccaagggagtgaaggtgaccctagtacgggtgtgtggccctccaggccttggcatagctaatagtatacttgtatgtctcttcgatgtgtcggattattgaccttggttcatatgtgagattatcgatgacatgcgcatacatctaagatgcaacaaatgcacatgtaatgttcttgtggtatttctgaacaccaggtagaaaacatgtatgcttggtaacaactgacactgtccaataatccttccatttccccttatatgcgtgcactctccagggacaaccatatttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctaacgaatcaccttcctctacatgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcatttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcatttgcccgacttactataacattgattgttatgtcacttgtctgtggatcaactctcaagcccctcattaaccatccttttatagaaggtacactcctctcagccggtctatcaattcccctttctgatacaataaaatctgacagatctaccccagttggcccgtaacggacgtttcctggtctatggtaaacttggaatatttgtttgttcgacatatctgtcaacgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctaaaaatataatgcatttattcaaacaaatttttaaaaaatacacactatttaactcaatagtcacatataggatctatgaatattacatgaaatcggtatctgaatccggcagggcttcgccccttcttttcttctcctcccctctcttctttttttttttcactggaactgaggagggaggaatgagggctgggggctgggcggtaggccttttataggcagcgaggcctgccgccccaccagagggcggcaaggggccacctgcaaaatagccggccccgactggcttttttgcattcggaccccttgccgccccaccagagggcggcaagggttttcctgcaaaaaaccctccctccgtcaccgcccgttcctcccccgtttgccacgtcagcttgccgccccagaggtgggcggcagggtctatttttgtaatttttttggccgatagattatttctgtaaatatttaaaaaaaaatctaaaaccgaaaaaaattcgagatcggagggggcgtggctgtttcggattcgttggtgagaaaggcccaatttgtaacattagttgggccagaaaagtattacgtgcaggaaaaaagtacactttaactctcttaaaaaagtacgtcgaatctaattcgtacctctcaaccagaaaaccagataagacaacttcccaactattgaaactagtgtaatttaactcccttagtggttttgaagtgtggttttgctaacatggcggtgttgagctggtcttcatcccacgtggcgcttaggtagcattacaacccgttttagttgggcgaatttgatatatatttgtcgacaaattttccatcaaaaatttgacagatgtaattacaatacaatcgtggtataattacactgtaacttgtatgtaattacactataactataatgtaacatgtatgtaactttcaaaaatctctccataacatttatttcggtaaaatggaggttgtgagaacaaatcctttcacatatgtgtgtgatgtgatttttcttcttcgtcaccagaataaattttttaatagatctaacgattcaaaattacgtgaaacttatatacaagttacactgtaattacatacaagttacagtgtaattacatacaagttacagtttaattacactatgattgtactataattgtatctgtcaaatttttttagaagaaaatttgtcgacaaatatataggtggtccccttttatttgggctagatctaacggaacaaatgagctcaaactaatgtgccaaatttttttatttgccgtgcgttgcatttttttgtgatacatccggtattaggtagggtgaaaacggtatggaaatagacggaaaccacctttatcgtttttgtttttatattttttttagaatcagaattagagtcggaaaccccggatacgaaaacggaatcgaatattattgaaactgaaaacggagcaaaaataaatcggcgcgaatacggtaacgaaaatttatcggaatacaaaaatccctcaaactgataaatccaattctcaagtctcaatggtcaacaattcatcataaaacacaatcatataagtccaattgttaagtctcaacagtacatcataaaacacaatctatggaataaattatctatgtttaagagagtaatgctgttgataaatcccaatataggaaaaaaatattattatgtaccctcacatttgcataacaaataatttttaaaaaataacagccaaacaccatggtattcactattcagtgtttaaaaaaaagaatccagggtatttcagtcacaaaatttctggaaatttcgagaaaatttccggaaattttccaaccgattccgagttccgacgaaaactacccttatcattttcgattccgtttccttgaaaatatttccgaatttgtttctgtttttgaaaaattccgaaaagaattccaaccaatatattccgttttcgaaaataggtccggaatccggaaagtttccataccgttttcacccctattaggaactgagcaacgaattgaaacatttggatcgctatataatataattgaaaaagttaatgaaaattgttccttggttttgggtctttttgtgctggagctgatccgaatttggtttattccagtaaattaaaggtgaaatgaaagggagaaatcaagagaaaaatcacgagagaggagggggaattgatttttgcaatcaattggaggagaaacacacggaaagatagatcaaagtggtggtggtcctagggtttggtccgtctgcagagtacaataggtcggatgagataaaaattcgaccaccgaaaaaatagaaaccggatgaaaaaaaacacgaaaaaaaggaatctggcaaaaaaaaaacagcgaaaaaaaagatacgaccaaaaggtataccataagctttacttatttttttaattattattattaggtatagatatagatagatagatatataacatttgttttgttattaaatctatctatacctctgtagttcaacaaatgattccactcattctttcattcatcactcaacggtctagattgtctcgctaagatccaacgtcccagattttcctccacctccccacgaagatcgcaccaaataattcctcccacctgcgcgcgcatacgtaccccctcccacctgcgtggatgccgccgatctctccaaaaatcacgcgctcgtggcaatgccagccggaatcgctggggcggtctccttctccctgaccttcgcgacgatggcggaggcaaggaaaggccgcccatggatctgctgccgaagaatcgtggtgccccttctgcaacaaagtcagaggtgatgtgctcctgcttccgtgcactcctccaatctagtagcgttttcgatgtgcattagacctgctaaaaaggtacttttcgtgttgatctggttacgataaatagttcactagctgtaatttgcctttctatcttaatgattactatcgagaatatagattataatttgtattttggttgggaggcagctgtagaagcagtttctgacgttgggaggtttcaagcaaccatagaagttaaaggacaagcaattgtcatgagtttggcggaccaacattcttcagttggatctggttgatcctacagtttaacaaatggtttcacttattcttttattcatcactcaacggtaagattgtctcgctaagatccgatgtcctagatttgccccacctccccacgaagatcgccccaactgattcctcccacctgcgcgcgcatgccccctcccacctgcatggatgctgccgatctctccaaaaatcacgcactcgtggcaatttcagaaaccaaaaaaaaataaatcatgcactcgctattctgccccaaaaataccgcatctcctagccctaaatgccaccgtccaccggatcccctccacctcgccctcaagtcgccacggatccgtcgccggcggacagtttccgtcgacaggtcaccggcaatcgctcaccatcatccgtgatcccccctccctcagtgccgcctcaccgtccaaggcaaccgggcctcgccactgccccatccgccgaccaccgtcgcctcatcgtcaagtcatcgctcccttgatttctcggtgccagctcgcatcaactccacacaggccaagtttcagggcgctagctactcttttttttttcaggggatagtattagttttatatttctgttggatatgaggtatttttttattatgtttgctggagtgcttacttttatatcttttatggtttaaattacaatttcaatgaagcttgattatttgttcttctgtgcatgcaaatggattgccttgtgtatagagtatgcaaaatgttagtttgaagcaatatatattgtgggagatatacatttgttatataattagcaatatattaaaccattctttttattatctgaatcatatatttctgtattgttaaatatatccgtagcgttagcacgggcaaattactagtgtagtctaataacaaaacaaattatagattccgccaagaaactgcaagacgaatttattaagcctaattaatccgtcattagcaaatgtttattgtagcgccacattgttaaatcatggtgtagttaggcttaaaaaattcgtctcgcaatttcttggtaattggtttttttttctacatttaatactctatgcatgtatcaaacatttgatgtgacagcgtataaaattttgtctgggaactaagcagcccttagtatatcctaagtcgcacatgtccgtagcactggattcggtatgctaagaaagcaattcgattgagtgtgcttagatgaggctagcccaaatgtccctgtcacaagcaattgctcttcatgttagcttacctctaaagtctgaaccaccttccatttgcatgccaaaagaaagagggcactgtcgttggttcgtatgcccgatttgattgtgtagctcttaatgctcatagtcataattaagttgtaagcagattgtttgaacgagtctcatcttctgcttgaattgttagcttatatatgtgtcataaccaaaattttatttctagaacttaatgttgacttttttttcattgcggtatatttttcaacattaacttactgctaataacatagacataaaagttttacatgtaaactattttcattactttatttttttttatagttcatgagttagagtcgaagtcaccaccaaagacattatttctctccctgtgtggcaactacttgactcctcatttggcaactacttgatagggctagatgaggcacacctctgtgaagtcagctataaaaaaaatttaagttctcaaagaatatggttatgtatggctaaaatagtggcactctaattgtagtattgaatcaaattgttactcataagcagggacagatccagcgtggccttagagggaggggagggaggggggctcgagccccgttggatctctatggagagagaaggagatagtggagggggaaacaggaagaggaagaaattatatcttaaatctcaggcaaacttgtcacatcacctataaattattacattctatagctcaatgtaagtatgtcaaagtatcattctaaaatattttaacatataatcatccattatttttataatatttaatatacttttatccataaatttcacatcaaagtgtgggccatcatctagtttatcatttatttattatattctcgagctcaatatgcaagcatgttaaattactattccacatcattttgaaatatttcaacatatgagcatccatcattctaaagtatttaaaacacatttatccatgttttcgcagcaaattatggggtataatatattttatattgtgctccctccatccaagaatttaacatactgtttcgagagcaagttgaaagttagagtggaatggagtaatggagtaacgtatctcactctttgggtattctttccatgcctattccgcagacaaacgctcactttccaatcatccaatatgctgatgatactctgataatcatgaaaactgatcaaaaagaactgttttgtctcaaagccttgttgaacacatacactctctgcactggtttaaaaataaatttccacaaatcttgtatgatccctaccaacacttatagccaaaagttgaaaatcctggctggaacctttggatgcaccataggggccctacctttcacatacctgggccgcccaatggttactaccaaacaaaaaaaatcattgactttgccccactcattgacaaaattgaaaggagactcccatcaaccacagctttttttgaaccatggtcaaagattaacaatggttaactcagtcttatcatcgtttccaacatactacatgtgcatcctacatcttccaaagaaagtgatctagcacattgacagagcaagaagacattatctatggagaaaaagcaatactctagaaactaaaactcattgcttggctacataggatctggtttgcaaacctaagaaaaaagggggacttggaattatcaatttggaacttgagaacacggctctgctaatcaaacatctagacaagttttacaacaaaaaagacatgtcgtgggtacacttgatatggaataaatactactctcactctaccatacccccacataaagaaaaaggctccttttggtagaaagacattttcaggctaacccccctgttcagggcaatcacatttgtacatattggctcaggagaaaccactcttttctggaaagacaaatggaacaattcttgtctacaaaataagttctccattttattctcatatgcaaaaaatgaagacatatcagtacaagacttcttatcaatccatgagttcaaacataattttcacataccattatcaaatcaagcaatgcagcagtggcacatcctagagaataatcttctaaacattgacctcaccaatgaacctgataaatggaaatacctatggaactctgatcaataccaataaaaaaaggtctataacatgttctttggacacatcacaacaaacaaaccattgatactgatatggcatagcaaatgtactatgaaattaaaagtgttcctttggctgatgttactggacagtctcaacacaagagaaatgattcaaaagaaaattttcaacattaagagtggtgacaagtgtgttatgtgtcatactacgctcaatgaagacatgtttcatttattcttctcctgcccttttgcacaacaatgctggcaacacattggaattcaatggaatctgac

SEQ ID NO: 44236 - DNA, 9645 bp, Oryza sativa
aagagattatggaaataatcctcacgggtaagtgaaaagcagagtcctactcgaagaggattaggattgtactatatcgtgctgggttcggtatctccgagttctacttagagataaagttaactcatggtataaatacacaccccctgggaggggtcctatggcatcgaatcatagcgccaataccaccaccatagcctacaattcggaggacgtgaagcctactcgccgggagatctcgtcgaaaccatctcgacaagggtctcgctggtaatctcgagatcgactgttctctattgtaatccttggttttccatatcaatctcatataaagtggattagagctattaccttacgaggagccttagccagtataatgtttgtcttcttgtttgcttgatgtcgtattgtgtagatcctcgtaccaacgtacccaataccctatgtatccggtctacgtgtatcccccgtcgataatcacaactgcctataacaatttccatcacaaattcttcattaaattgcttgcaattggatcttggcacatttcgagcagaagaaatgattacgtcttcaacaatatttcggtcagttttgataaatggaaggacagctttaagactgaatttggcttgcatatgcacatggcaaaagaagtagacaaacccctatggtaatcatggatagatagcattctgtaatttcgtttctttttctttttctttctttctgtttcttttctttcgtcctgtacgtaaacccctattattattattattattattattattattattattattattattattattattattattattattattattattattattattattatagcacaataggcgactctccagctgtttcatgtaaaaaaaagtaatggagtaagggagaatgtgagggtagtttgatccaattatacttataataccatactaatacatatggcatgtcttttattcctctcctaaaagaatccaagccggctatcatcgtggaggcatacaactacaggaattcaagtctgctacagtgttgctatttatattccatggtaacttttacctaagaaattacttaaaaataaagtgaattgcatatcgggctgtttttattttgaaagttttactttggatcacctttaaccaatcctctcactttggactatctaattttacatttgttatattttgaacaaaccaaaataccttccctagacatgtcaggtctctactctagcaaagggtatagtctatgcatgtataagaggttggccatttattaataatggtgtagtatataaatatatgtaactattatatgagtggactactaaatgacgtgtcaaatgtgtttttacctaggagagtgggtggtaatgcaccattcgttctaaaatactactgtattcgacatcacctagtttcatccagatgagatggtggtatctagtacagtactatggatctcatctttttgcttatgcttatgtttatcagtcaaaatttgaattttcaaccttaaatttgaagctgattttgagttttttttttcatcgaagtttatttttcagcctttgcttttaggttgctaagaacacgaatataaaagttttattcacaaattatttttcatctgtaaatatgttgtttttcttattcgcgtatgttgatataatttagtgctaccagtatgcttatagagcttattttttgagtaaagtgcaatgccggtccctaaacttagttcgctcatgtcatccaggtccccaaactctaaaaaatacatttttagatacttgaacttgttaaagtgtattattaaggttctaaattttcatgatccctctgagatcttacatggtgctcacgtgacatgctacatgggtgttgactcattttatttatctttttctccattttttctgttcttcctttcttttgatgtgggaaaaagagggaaaaaaaagaataaaatgtagtggaggaaaaaaaaagaaagtttggatctgaaatgttcatgtgacatgttattttagtatccacgtggcacgatatgtaagcatcacgtaggatcgtagaggggtcgtggtaatttggagtcggaataatacactttaccatgttatatattttaacatgttaaatgacatagatgaataaatttagttacatgtgtcgcattttactcattagtattatttttagtgaatatttagagcggcgcaacagggatccgcttctctcatcatttgcaggcactagtgattagcgccacacgcacgaactccatccacacgttctcttcccccaacaaataataaacaatccatggacagaatgcatcatccccccaacattacatcgcctccacaaaaaaaaaaaaatatccaaccaccttttccacttccaccaccgctctcttctccaccgcgatccaaaacccaaaccaatttcatttttatgcaccccaaaataaaataaaaataaaaataaaaaagcttcgtcgcgccgggaaagttggagaacgaacgccatgagcgccgacgaggacgcggcgtcgcggggcggcggcggaggcgggaagaggaaggcggtggcggaggggggctcgccgtcgccgctgtcggtgctggcggacgacgtgctgctgcagatcctggggaggctggagggggacccgcgggactgggcgagggcgtcgtgcgcgtcgccgcggctcgccgcgctgctcagggcggcgtgcctcccgccgcgcctgacgcgggcgctccccgccgagctcctcccgccgccgtcccccgacggcgcgcccagggcgtgggccgcgctccacaagctctccgtctgctgcccgggcctcctccgcgccggcgtcctcctcgagccctccgatgacttcggcctcgagctcgacatcggccccgacctctccgtccccgccccctccccttcctcctcctccctcgaccacgcctccaccgctacctccgcccccgccccaccccccgactcctcctcctcctccgccgccgccgccactacgtggtcgctctacgacgacctctacctcgacaccgcctacgactgctccccctccgaggcggcgcagatctcaaacacggctgcgacccccgcccccgccgcggcgcggcgaggggtggcgtcggggagcaggaggcgggcgcggcggtggctggggacggtgggggcgcacctggcgtccgggtcgtggacgctgagcagggagcaagggaacaagctgctggcgagcaggttccgcggcgaccgcctctacatctgcgactggcccgggtgcgtccacgccgaggagcgccgcaagtacatggtgttccgcggcgtgttccacgacttcccgaggtcccaggtgcgccgcgccctgcgggacacccgccgccccaccgtcgccgtcgactgcgccttctgcggctgcaccgaggcctgggacctctacgccgccttctgcctccgcagcttctacggctaccacgacgacggcgagcccgtcgtccgcgcctacgtctgcgagaacggccacgtcgccggcgcctggaccgagcgccccctctactcctgactgcgacacccacacccatggttcggtatgcccactctactgcttttgctctctcatggatgtgcagccatggccgccattgccaagaatgccaagcaaacctttacttgtgcttgtgataattactccatgtgtatatactactagcaatgtgggtatcagatcatcacctctggagattatgcagggctgatgtgatgtgatatgcatctctttgtcttgttagagatgaatcagatgatgcttaagctagcttaataacgcgattaccgcgcttccgtcgagcgaattctcagcgcgattcggcgcgatcgattaagagtgtaacttctgatgatttgcacaagaacacagttatgatgcaggttgatgttgtatttgatattaggcagtgactcggttacgctctctacttgctgatgagctggggattcagaacttgcatcaactgttcttgcttgctgctgatttgcagtagacctgattgttgtacatgcactgcaacctccttcagctttattatcttcatgaagtagaatttgcaaggttcttgctctctagccttagttctgatacaacctgaaaatgctttgcttgccctttcctgattggatttaaacttatcatcgatctagttcatatacctaatctttggctactcagaggcaactaacctcactcatactgtcatacacactgtcaatcatgcatgcctctcctttctgaatattgtagtagtagcttgcagcctgcagaaagggcttaattttttatgatattatcaatggcaacttggcaatgacagccacttgttgctctttttttccccctaaactaatgggtaatggcagtggaactgtggaagtactaacagctgagtcctctccgaaccgcaggagatagttgcccgcctttgaaccaaactctagggaacgctcaattgcctgacggtttacctgatatagaaagagggagtgtgtaacatacaatttttttggatagccagtgtgtactttgtagcatggtataagattagtttatgagatagtgtatggctgttgattctcctgccttttcgggactgattcactgccggctacttgcctgcctgctgcatggagcgttggagctgatgatgctgcaaaatggcgacgcagaggcatttgttttatccattgcgttggcgtggcagccgctcggtcaccatctgacggacagaaacttatcatgttggttcttgtatattattgtatggtatgacaaattactagtagtacctttctgtcattctgtgtgccgtatccaggggcggaccggggctagagtcccatggaagttttgggaggaagtagaacgtacgagtatgaagcaatgacgtttcggtttgcttaactccggggggaattataattcgttttcgcagatgatttaggtgaaagaaatcacggtcaatgaatctctaaagaaaatttacatggaactgttgtaggttttggccctgtttggatcggagggctaataattagccctccaaattcttattatttaagagtattaaacgtagattactaaccaaacccattctataatccttaggctaatttgcaagccgaatctagtaagcctaattaatccatgttttgctacagtaatcatccgctaatcatggattaacataccttcttagatttgtcatgcgaattaacccaggggttatgaaatgagttttgtcagtaatctgcgttaagtactcctaaataataagattttggagggctaattattagccctctggatccaatcagggtctgtttctaatcgggagaaattttctgctatcaagagagggtgggacagggctgtctgggtaacggtgcttctacgagtttggtgacaaatggtctggattttttatgttttggccccttttaagaacttattttataaatagatcattagaaaacttattccagaaatggattattttataggtaccaatgaacctagcgccgaagtataatgatgttgggcattggcgccgtccccctcacacccgagaggccaagacatagaggggtcagtgcccaacattatggcgttgatgacttgtttgtaaaatattttttgaaaagagtcaaaatgtacatatttttttatcacaaataggcctgatatcaatatctttggtgttgaggacctatttataagaaaaatatttagattttaactctttttgaattttctttataaataggtcctcggcgccaaagagtttagcgccggcccctttcatatcagcgacttagctatcacaggggctaggatgtgtgccgagacattgaatctcggagccaataaccctgaacccgagaaaaagggtctactcctgaaataagtttttttcaagggtatatgttcaaataagttttcaaaatgtaaaaattccaagacgaatggtgggtgaaaattttagctttcctaagacacggaagacggggaacctccttcacacactggtccctcttcccctccatttttggtggctctctggcaacacgctagggggagggggtaagggtgggcattcggttagaccaaaaattttgatctcggtcttcggttttcggtctttcggtcagttcaattattgaaaaatgaagaccgaatttcaacacaaaaatgctaggaccggcaaattcggtctcggttctgaccgaaattcaacaaccgtttcatatatacaaataaatcatataatttttcaacacaaaaatcacaaaaaaattctaagcacgtctcagtaaagactcttattgggatgcatgcctataaggagtagggatgtgaaaattagagtttaatcatattggagatttttaattcggtcttttcatttttgggttaacggagagactaaccgaatggatcaaacaaaattcagtctttcactgtttaggactggatttctcggtctcagtcttttcgccttttcggttcaatccttttctgattctactccctcaccaataggctaggcttccttcaatccaaatatttgcttgggctattcgttgaaaaaaacggtgggttattgtgtatgattaattaagtattaattattgtaaaactttaaaaatagatttttgaaaaaacttctaggtaaaatggtttacagttagggaagtgcgctcacgtcacacaaggcttacttttcccataccgtgcaaacgaacagagccacatggtgttgcctcaaagtaagccatgtggcgttgcctcagagaacttcggtactagtttcggtgtccatctccttctcgtggtagtgatggagtgtccatcttccttagagcacccgcaatggtaaagtaaggtgctctctataaaacatgtacatctcagcaatagactagattaatagtaaaccacagcaatagtatgtttacgtgggtatctatagctctctcatgcattgcctcgtttttctttataaactatctccaggttagtagatagctttgttatctctcttcatttaatcttttccaagtaggaaaatatgctgacatggatctcttgtagagagcctatagataaccattgtgggtgcccttaatccttcttacgatggtgattgattcaatccactctagtagtggaagatgtttttccctatggtcaaaacctattttccgtgcgggtaggccatccttatgtctgaaagtatctgagaaaatcgttatttttatgtgcgggtggcgcacccgtatgcgaaaattctgattttcgcgtgcagatgattatgtcgtccgcactgcacgcaaaaaagatattcgaaaaaaaataaaaatccttaagaaaaacctagctaggtgtgtcgtcgcctcctttgccgggcaccttctagtgccaccgtcggaccagcgcaggggatggctctgccgctgctatcgtcgcccctcacctcctccatcaagctctggacccgcccttcccgagcccgaagggagccactcccgctcgctgccggtgcgctcgagcccgccaacactactcctacccgccaccactactctcgagcctaccaccgtggcttaggagaggaggataagaatgaaggagaggatgtgggaggagtggagaggctggagtggataagaatggagaggataaggagagagaatgagggagtgggtagaatttttaaggtagagggaggtaggctggacttttcgcaggtggacctcttaataggcccgaatgagaaaataggtgtccacttgcagaaatgtatttccgtatacgggtcttttaaggagctggatgcgaaaacacaagttgatttttgcagatgcgatcagttatagcccgtctgtaacctataggtatccttatatagaaaaatcgtttatatagaagtgggtgttccatacgtgtaatttgctttgcaataattttgaccctagtttctaacatctcctcgttgggaaaatcggtatgtctcggattagcccatagcattttacaagggtttgtttgtaatattgtatgttcctaaggacccttttgtaattctatagtataaaaaaataaatagcaatgcacataattctctagtatagatattttgggtggaacattcccatggtggattttttaaaaaaaataatataattttcattttgttctttattaaaattaatatattctaagtggccataattagttttcttaatattttttatggttcttgtttagagttcaatatttttcgtgaaacatctacaagggcgtaacaaccttttagttgcaaacttgatggtcattggtcaacaacattacacagtgataaaaaaaaatagaaatacatactaaggaggatggtcaaagagaactgcaaattttcagtggcaaaagtgataatacatttataatgagtggcaaaaggaaacaaatccctttctgtttttagaagaggagccatcaaatttctagccattggatgtcaaatccaccgtctctaatccttgcaaaatgatatatatatatatatatatatatatatatatatatatatataatatccgtctctctccttcccaaaccctatcaacctccacctcccacctcatagccgccatcgctgaccgtggcccttcaccttgctgcttactaacattggtctaatggcaggaagctcccatcggcctccctttgccacttcccaccacccttatgttccccttccaaccacatgttttctattggtggagctctttattttctttggggaaattggtttagttgtgctattcttccccgtctttagtggttatctccattgatttgtcgtcacctctaaccaattggcatctctcgcctagtctccaaccaaactcattgccaattcatcacacatggctttcgttagcagaaactcctctccgacttctctctaaatcatcattatcactccaatctctctttagatctagaacctaccaccctcaactccaatgctgaacctaagtccaaatgtcaataaaagaagatgaaggcagcacagagcagatggtgataactcgagtagggatctccacacgaatcaaaggtcagaaaattgcatcttttttgggttattttcatctaggatatcctatagaatccatatgcattctataaggatatcctagatgagcacacttaatattccatatctaaattcatctgcgatggacaaataagaaatacacattgcttttataagaaatcaagggaagaaacagaattaataactcatcaacagaatttgttagttctagttggattactaatatgcattttatttatttattttgcaaaaaaaatgcggtacacatgatttcatcttgacatatataaaccctatttgctagtgtaagtttgatgtgaccatttgcttcatcattcctgcatataaaagtgcattcatccagcatacatttgaaaacagaataacacagatagtagattgatatgtagaatcatacc

SEQ ID NO: 44237 - DNA, 1569 bp, Oryza sativa
acacaacacacgttttggtagttagaaatattgaagtaatcaggcaatctctacttagaacatattttgagaaaatgttgcaaggatagtaccatcttttgagaaaatgttgcgatggtagttttcaaagtgtgtacagatcggtcaaaaataagatctgcaaattaagtagttgaataccgcccatcacagcatgtttttcaagaaacatatcgatttcatttaacttcattacataaaaggcattgacctattaaatgacatgtaattgcatctgcccatcaacacaagtgacatgtcaacaacaaacacagcagtcaaaattcccatcattcaattccccaaaattagcaccttacactaaatttctatcatggcaaaaaaaaaaactaaatttccacaacatcctacaacactgaattccacagatccaacaccatgacagttttatcagggaccagaagtaactactaaaaggactacgcttagtattatctgttctaaattaacatagagaatcatttctaaaacaagaacacgccaatcatccaaaatactaagcatatagcacaaattaccgactctgcaaccgtggaatcatagcagatatacgcaaacttctttcacggctatctcattagtcagaactcagaacaacacatttcaagaaaagtgagatcaagattaataattccagactcaccgccttgcgcagcttcttgatgagcgccatgggcttcctcttcagacccctctggaacctgcaagatcacagaaccaacggatcacaccagatcacacccgcaaaaaaaaagagcattcccgtaagggcaaatcaaatcactggcacgatttcatcacagatgcgagatgtgtgggcagcaacacaacaccttctgcgggcgcgcgcggggaagagctggacgaggtcatcggtggacatgtcgaggagcgcgtcgaggtcgacgccgcggtagctgtacttgcggaacgtcctcttctttggctgtgcgccggcggcgacctccgtctcgacttcgacgtccgcctgcggaaaaacgacgcggtcaccgacggagacatgcacgggggatcaccaacggaggaaagttcgagagcgaggaactcaccatgatgggctcggagcgcgcgggaggagctcgccgacgtcgcggaagccgaagccgaaggcggagcctggcgggtagggtttaaaggggagagggcgagtcaggtgggtaggttatatagtgcgcgtggttgcgaagcccattctcgttgtactgatgggttgggctgaatgatagttgggctgtgtggagtttcggctgggactaatttgccctaggaataagttcatctgaggtatgtcaacgaatccgattatctataatctatgttacctggatacagcacaaaagtggcgtatcagtatcggatacgtgtatggatatggatacatattggatacacttcgatacgtatcccagattttcgcgattttcagttaaataaaaaaaagatacctcgccgatacgtcccaagcgttcctgaaagggttaattggat

SEQ ID NO: 44238 - DNA, 750 bp, Oryza sativa
agtttacccctctatggttctatccaccagtaattcaaaatgctagcttgcagtttgatatgccaatgtattacggaccttgcttatgtatgcaccacagcccaaaaagttttgaggcacataaataaaatgttgaaggctgtaatctcaagggaacaatacaggcaggagctctatgctagtaacaattagcaactcatacttgaaacatggatctttgcctgctttagaatttctgcctagtgatctgtgctgatcagctgttatgctctggaaatccaaatcaaccgtaaccctaatagattcgtaatttttgaattccgaatttgcaaatgaaggacatgacggcggcggacttgaaatcttacctgagcgcacatgggctcccagtttttggaaagaaagaggcacttgtcagtagaatcttgactcatctaggcacgtgaaatggtccacttcgacggactactcagtgatagctaactctgtaagctatctaaagttttctgaacatgttgaagtgcctatcaaaaaccctctccctgcttaggctgtgccaaattttgtagcaatatgacaacagctgaccccagttcatttggtatcatgtgcttttgtgacatgtaccactgggatttctcttaaatgtcactccagtctgcagagatcagatcattgttggtagaggaaagtgatccattagagaaagcaacaccaaacaagattattaagacattttttaagtgaagc

SEQ ID NO: 44239 - DNA, 1070 bp, Oryza sativa
agaatcattcccctggaagcaaggcttcacttaccccctttctacactttcttttcactctctaccccttgctttctctctgaaagcttatctgtcccttgttccttcaggcagataagggaaacaatgagcttgattaattacctctagcaccacaaaatgctccaatcaaaggaatggttactactaaagagaacaatggagttaaaaaaaaattggtcaccaaccattgtctattaaagcaacatgtgtagatatgatgaatgatgctggtaggacttggtataaaatccgccgtaagtcgtctttatgatgctggcgacaatgacggggtttgaatctcctgaagataaagatagagatgaatattaagtgtttcacgtaaaacgaggtggtaatagcgtgtgattaattgagttttaattattataaacttgaaaatggattaatcttatattttagaacaactttcatatagaaagttttcacacgaaacgcaccgtttagcagtttgaaaagtgtggcacgaaaatcttaatcttcatccaaatcttattagagaaagaacagggccgattccgaggttgtattgtgcaagacaaaattccatgtgatggtaaaagacaatggtgtcgctaacaatggtaagaaacgcactggagttgacacatagattcctcttaccaaggaagagggaattgcaaccgatggtgctcaccaggacaaccattcccagcataaggtcgggtagcctgtaaactgaaaaatgccgatgaacactactaagatttgaggtggtcaccagatctgaatctccaagccgcattccaccaaattgtaggataaatgtgcttcgggtgttcttgctggacatttggcaatcaatcttggcggcggcggcgaggtgtccgtcggtgaatcgatctgcaatctctggttcatcgtaaattggcatgatcatatactccctcagctccgtttcattttaagtgtggttgtaagttttggtgtccaatatttgaccatccatcttatttaaaattttataaaaaaaattaaaaaataaagtc

SEQ ID NO: 44240 - DNA, 886 bp, Oryza sativa
aaaaactcaaaatcccttatattatgggacggagggagtacctaacagcccattttcctcaacggtatcggcatgtaaagactatatgtcatcggcccaccagccgatcggctatcgtttacaagattaattattttattttccttgttggttgcaatatcaaaccaactagtacgcccttgaagaaagcgagattttggacttgcactagagttatgtagatctcttaggccactgtgtgttcttttgcatcaacagtagttaagtgtcgagatacgtggttaaagagatgagtacgatttagattcgacgacgagttaagacagtcaaagcggacttaatccgatttttaataaagatggactgggctggccaaaaacaaaaccagtcttcggctcacatcgcaataccaacacaccgcatcgcatatttttcctcacctttgctcaaaactccggaaagaaaccagacgaaaccctaagaaagagagacgtcttcggctcttcgcccgccgccatggcagctattctccgatccctgggtcgctcggcaaccaccgccggcctcttcggccgccgctgccgcctccttagcgaggcagcttcagatcatcaggtcagttccgtcgctcgccatcttattctctttctcgcgacacagacccgaaatattttcgacgaaaattttctccatctcccccttatcttcgatctcccgcgcgttggggctccttcaatttcatatgggaaggaacaaatgggaaggaatagatttgtaggatcttgcttggttaatcaatttcatcatatgggaactagattggaggggatttgggaggtgtgcaatgtcacagaccaacacaatcacaccaaatctctcacacaca

SEQ ID NO: 44241 - DNA, 906 bp, Oryza sativa
aaagttgattttgacgttttcatcatagttcacaacatatgtatactaggggttgttcagaatgatgttatttttaaccataacttctttttaacaagattgccaaaaaaaagtgtctacatttagtttgttaccaaactttggtaaatatataagaaatcctatcaaaattttaataatattatcaacttgccaaaattgtaaggtttattttggctataatatgaacaacctctaattttatctatgtattacttttgtttgctagtaaatgttatggcttataactagttataggcgaaatgatggattaatagtttaagggagtttgagtatgaatagttttggatggttaactgagttttaggtccgcgtcacttatttgtataaacaaatttgttttcaagacaagggaaatataaaatattcttgttggaccgggtatatgttgcaaatcgactcaaatgattgatttccattgtttttttccccattcgatattaatgcatcggcacttgttgctttagaaattgtcccatattagaaattgtttgctgccaagcgtccatgcgcaatagtcaatggaataagtgtccacatgttgcgacaccattattcaaattcgatgaaaggtacctcaacgttgaaatagtgggggctttggaggtggccatcaatgtgttcacttttgttctcaatgtgatgtgtaagaatatatctttggaggcatccaattgaggtcattctcctcttttgcattgagatgcccaaaaaaatgcatggcttgaattaagatgtttttttcttcaacaaatgtcactagagtaaatgtccaatgtgatgcggtatatgtgtcttatttattatcatatataataataaaaaagtagaaacatgcaacttgaa

SEQ ID NO: 44242 - DNA, 2522 bp, Oryza sativa
gtctttcctgcaactagcttgttggccacagaatcaaattccgggcaactgctccacagtgatacactagttataaagtattttggtgatgtctccttgactgactttgctgcaacaattatgggcatgtttagacatgcaaaaaaaaaaagatatcacatcggatgtttcatcggacgtcgaaaggatttttgggacatgaatgaaagacctaatttcataactcacctagaaaccgcgagacaaattttttgagtctaattaatctgtcattagcacatgtgggttacttagcacttatgacaagtcatggactaattaggctcaaaagattcgtctcgtgattcccccctaactgtgcaattaattttttttaattctatatttaatgctccatgcatgtgtccaaagatttaatgtgatgtttttgagaaaaacattttgggaactaaactaggcctatgttcataggctgatttgtccgagctactcaattgcacttataatcgacactaatctggtggttcacaaaaaataattgccctaaaaaattgtaaattccactgaaactctttttttaatcaaaaccactcttgattaaaaaaacaaaacccgctgcaattagtggtagtattttttttaagagagtggttactcctaccgcttgaactagacacccaagatttccaaatacgttgcgacaaaactattttggcatccataataaagatcatgatccaaccttgttcattagaaaaagaaaagaaaagcaggtcttttttttttccttccgatttactgcatgtcgtgcacgatgaggagcatttccctgctgacttgacccagcgaccccatcgtgagtcatggcgtggcattgccggatattctgcgaatgtgccatatgtacaatgcgatgaagccatcccattttgttaaaaaaaaagaagctcattagttacaaaagagtttccatgcgccattccttgtggcttcacatagttcagttaactagaagcgttttccaccatcagatcagtaatcatctgtaataacagatttgacaaggactactcatctgcctttctcaaagagcaattttactgtatgagacattaacacatgatgaattcagcattcactattttaaattttaaaaatagattaatatgattttttcaccacacccctcgaataaattttattttacaaaaatcccacaccgtttacccgttctaaaagtatgcacgcgagaaatttcttacaatcctcggttgccgaacacaaccaccacgacatgctccttgggcctgcatctgtgcagtggtgcggcgtgcgacggcacttcgtggctgttgggccttggtccactcaatcgtcctggctagacctaaaggggttgataccccagaattataagaatcattattagaatcacaatggcccccttaactagtggcatattccttagttttcggcccaataactattaaaaccggtgtaaattgactctcttggtggttttagagaaccgttttgttgacgtgacgttcacgtgacatcttaatccacaaattaattaaaaaataaagtcgggtccacgtggcatcctctttctctactactggcaagggtatggataccacatacctaatagtagttgactaaatctcggcaggacccaccacataccatgtcctatatggaaacaacctgcggatatggaggaagttccggataaggaaagacaaccagagttctacatggaaacgacaagaactattcggattatatccatattggtttccctagttctacttgaacaaagggacacctatgggtataaatacaaggccctctaggaggagagggggacggacaacacgaccacctcaattgacacccaccatagactggagggaacaacagaggccacaacatacaagacaacatacaccaagacaagacgccgaatatcgacttcagggatagacacggctagtcccctatggtgtctctggatactgtcagtagagacgaaagcgtttctcatataatcaaggaatggtatatatctaaatccaatctaatttcacctataaaaaaagattactattccttggtaatctataggaagggattgtctttttctctgatatcgccgggcacggattcgaggaggaagactaccctgttgtcgactactagtcagacctttagaccgccatgtggacaacagttagataggctaccccacatattgtactggtgtgattatggtgaataagagcaataccggcttcggccaacaggatatagggttattacctgataatccaggggcccgagcatgtataaaagtccctgtcaccgtctgttttacctcagtctcgcgtatatcctagcaccgacgatctccatactatgcaaacaccagaagggggacatctaacgtcgacagtggcgcgccaggtaggggtgttttggtgctccaggatttcgacgagatgggttcaaaagatgga

SEQ ID NO: 44243 - DNA, 9748 bp, Oryza sativa
  unsure (1)..(9748): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggctcgaaaggttgctcttggagaggatgtgaagacactgcaaaagaagaataatgatgcaagcacttggaaagaggaaaataaagaactgttcatgtcactgaatgaacaagatgaaggtcccaaggagtctggctcacagggagttgctttggaggggaaggaagacctattctggcagcaagggctgctaatcattcaaaccatataccatggtgctacaaaagctcttccttcaagcttaaccttgcggaagaaattcttagagatattgagtagtgttgacctagcacattctgacgaactgaaggtagaggtcatggatgacctgaagaaagagttctctgacagtgaggactactgggattggcttgctaggcttcagcttagtgactcaactagttccagtaatttgaatagaatggaagctttatcaaataaactgaataaatcaatacaggtaaaaactcattatttggttatttttatctgtcactcaatcttgcctgctttctttgggagaaaaaaaaggttgttgattaatgcaacctgccctagacttacgaataatcaaactcaatatttaaacatttcaaactacgttttttgtattgtaggtgtatgatgaagctgtcaggaggttgccaacttccagaatgtattccctgtatgcaaaattttggatgggtgttctgtttgctgatacagaagattccatctcattgtttcatggcggtgaatttgatgcttcagggttcacttcatgtatactgaaagtctatcaaaatgccgaatcaagcggttgtcttactgaagatcttgcttgccaatatgtgtctctttatttgagacttggaggtttggaggaggcacctggaagattagaggaagctaggaatcttgccaaaaagctctgcaatggtcctctttcacatgctgcggatttgtggaacctgagagcatctattgagatgaagtcacttgctacttctactggcatttcttcgttcagcaaggagaacttgagttctctatttgatctatttaatgttgcacttccaaagttacccatacctgaggctgaggaattgtggcacacggtatagacccttctcgatctcttttactctcatgtgttatctctgaacttgtttcacaaagttttattctgctcctctattttcactgtgattatggttcatcttttcttttgttgatttgtttcttttacctttaacgatgcaatgtatttatataatagttccatggatgtattaatgtgtttgactgcttgtactaatttctactatctgtaatgggcacaatgcattacttcgttgcatatttgttcaaaagcttgttgtaattcatttcaggccatgaaattgttttctcatgagaaggtttatttcgaaaagctggtgaaatgtgcaatgttatcattaagttctgctggtggaaatgattgtggagcttcggtttcttctgctattgttggatggattttacaaagagatggtatcaagcaagctagaaagatgtataagaggtatgaactttatggtccttgaatgaaatatcactgtaatattgttcattgcatgaattgaatttgctttgctgcaagatttggagtttttgtctattaggcaagtagtgttgtctttgaaactgagcgaagcgtgctatgaattttcattgcacattccatgtttcagattctgccttttgtgtatgaactataagtgcacatagattcttctagaaacatgtgcgggaatcaattcatatgtattgtttgagtaagcatgtttctgacacctctgcatcgatgcagatttctggctttaccacgtccaagcttcaagttcttccagtactgcatagagttggaaacaaaccttgcatcaatcggaaaccaagacagccttgtgaatgctcgtaagctgtatgatgcagcgctcgatctctatccccaggaaagagaactttggaggaactactacaacatggagctgaaggtgagatccatatcgcttgtttcctcatccgattgttcttttaatcgtgattaagttccttatctgtattttatttgctgacattacattgaaaatgcacatgggcagttgggaacatcagaaacagcaaatgctatatactggcgcgctcgtaaggtgctcggtgattccagtgccctggacattccccacagctagcaatgtgtgacttgtgtatcatgcaatatcatttttgatctgatttgattactttgttgtttaagcgtatcaagtcaagtagcgcggtggaagaaaattttggctagtctatctgttggatttgtgttatgagcccctaactagggttaaaatttgcatgctctgtatgattgccgattaaaagcttgtacagatacggcgatagtggccgatccccgaaacatactactagctattggtgtttgtgtcaatttagtttgtgccaagcttgccttgacaaagaatttatcatctactagtccagttgaatggttaagagctgacgtagtgatgatgacggaatgcatactgctgtgttggtctggaaatgctccagcttgtcaggcagaaaagcaaagtatccagctgcacggggcgccgccacgtacgtgggtggcgaagggcacccgtccatgccgccgggggccagacacgacggcgatggcggctcctagtgtgctctgcagccaccccaccatcaccgtgaagctcctccggcgaggacacaacatcggatgagtttgtgcacaagcgtctaccatgcatgtttaaacaataataattctgcacgattatgataattcaccaatcgtaaaatctttctaattattaacacgaggtcagcttctttagttagtagacttgtaggtacataaatgtttacaagttgctaaaactaaaaaagaaatcatacatgtaatgtagagttgttctctcagttaaagtgaaatcttagtaatttggcggtgccgtaataatgtagtgcagttttcaacaaccaaaaaaatcgtctaaccaaatacatgtcatcctcttgtcttctaaagggctatatatattcttggtctttgatgctttcatacgaaaggagcatgattttataagtagtagtgctacactcttaaattcataggaattctaagggccctttaaatcgtaagaatgaaaaaacagaggaataggaaaaacacaagattctgacaggaatacaattgtaaaatagaggattgcaaaacacaggaaaaacacaggaatgactgtttgattggaacacaggaaaaacgcaggaatcagatgagagagagagagactcagaggaaatgttccaagaggttagacctcttgctaacttttctccaaaatgtgcataggattacacattctatatgaattttaaaggattggataggattcaatcctttgtttcaaaggccttcattggatttttttccataggattgaaatcctccaaaattcctacatttttcctacaaatcaaaggggccgttaaaatcagtagctagagatgttatattctacttttgaatggtgtagttcatatagacattaattagttacatactagttcatatagatgtttgtatttgatacggagtactttagttggatatggttaagagggagatagagacttgtcctgtaaccgtgagtctttctctgtttaaatttcaaaacttatcggttgcttgcctattggtagatgttttactattatactccctccgtactttaatatatatatgacgccgttgactttttgacaaacgtttgacctttcgtcttatttaaaaaaaaatttatgtaattataatttattttattgtgatttgatttatcatcaaatgatctttaagcatgacataagtatttttatatttgcataaaaaatttgaataagacgagtggtcaaacgttggttaaaaaatcaacgacgtcatacattaaaatacggagggtagcatttattaacatttttttaaaaaaaaataaaatcgtaatgtactgaatatgtaacttcatctgcttagaatattcatcagaatggaagtagacagaataagagaaaaggcccataaacaaaaggccggccctatcacctatgcgccgagaggtggagctcgccgcaggcggtggctgtcgcgtcgcctgccgccaccgccggacctccctgtgaccccgtgagccgtggcgcctggaggctggagagaggaggggagagagatggagagaggggagatggaaagggaggaggaagaagataagggggggtatgacatgtggggcccacgtggtcccacttttatttttattatttgatgtgtgaaaatgacatgtgggtcccacgtgctttattatttttccggatcgaattgccgcgtaagcgctacgtcagatgaataccgagttaaattagccacgtaggtgccacgtcagccaaaaccgctgagggaccttgtttgcccggttttcgtaagttgggggacgggtcgtatccggttttacggtcaagggacgaaaatcggactgtgcgacaaatagagggacccaaagtgaacttattgctaggctaaaattgggtggcccatgatcgaatagtactagtactaagtagatggagggagggaggcgcgcacgggcaccacaagctcgtcacctgctttctcttccactcaatccaatcctctctctctcttttccaatctcaattactacaatcctctcctctcctctcctctcctctccttcctttgtcgcgagtcacaggcacacagacatggccgccgtgaacacagtgtcgtcgctgccctgtagcaaagctggcgccgccgtagccgggggagctccgaggccgtcgacctgctccgtattctaccctcctcgttgctggtccaagcgaagcagcggtaatggcgtgcgggcgcaggcgtcgacgacggagacgaccgcagcgccggctgcggaggtgactactaaggtggagaaggtgtcgaagaagcaggtggatggcgtggtgacgaacaagtacaggcccaaggagccgtacacggggcggtgcctcctgaacacgaggatcaccggcgacgacgcccccggtgagacgtggcacatggtgttcagcaccgacggcgagatcccctaccgcgaggggcagtccatcggcgtcatccccgacggcatcgacaagaacggcaagccccacaagctccgcctctactccatcgccagcagcgccatcggggacttcgccgactccaagacggtaactagctagtagtgtttttcttgctccatcgatctcaaccacaagacatgagctaactaacatcgacatcgtccctgatcgatcgatcaggtatcgctgtgcgtgaagaggctggtgtacaccaacgatcagggagagatcgtcaaaggagtctgctccaacttcctctgtaagctaggagtctgatcatgtaatagcagttagattgtacttgtgtgctaattaatggagtataatttaggtgacctgaagcctggttcggacgtgaagatcacggggccagtggggaaggagatgctgatgcccaaggaccccaacgccaccatcatcatgctgggcaccggcaccggcatcgcgcccttcaggtccttcctgtggaagatgttcttcgaggagcacgacgactacaagttcaacggcctggcgtggctcttcctcggggtgcccaccagcagcacgctgctgtacagggaggagttcgagcggatgaaggagatcgcgccggagaggttccggctggacttcgcggtgagccgggagcagacgaacgcggcgggggagaagatgtacatccagacgcggatggcggagtacaaggacgagctgtgggagctgctcaagaaggacaacacctacgtctacatgtgcggcctcaagggcatggagaaaggcatcgacgacatcatgatcgacctcgctgcaaaagacggtactgtactagtacttcttttaatctccatctctattcgattcctaattactttctttcttgcattatatactgtatgtaggcatcgactggcttgactacaagaagcagctgaagaagtcggagcaatggaatgtggaagtctactgatggatatatatatgttaataattaattaatccctttttatctcgattttcatgcatgcatgcgcaacctgcatacgccatcttgttgtactcgatctgatctcatctgatgagatgcatgtagatattatactgacgattcgtcgactataaagtggtttcccattttctgctgtattttgacaactttagtgtcccatttatttattatatatgcgcatgtgaattaaaatgactgggctgctgcattacaatctacaagtcgcgagcgtgttgattgggcccatccatcatcattgaacggcccaccagaaagcctaggcccaatatggcaaaaaccctaaggccgtgtgcgtcacccacctatataaagcggaaaacgccactcgtctccttcttccttcttcttccacgccccgcatcgccgccgccgccggagagggagagagagagagagagagagagagagagagagcgagagatgaagacgatcttggcttcggagacgatggagatcccgtcgggggtgacggtgcacgtggcggcgaaggtggtgacggtggagggtccccgtgggaagctgacgcgcaacttcaagcacctgaacctggacttccagctgctggaggtggagggggtgaggaagctgcaggtggacgcgtggttcggcacccgccgcaccatggccgccatccgcaccgccatctcccacgtccagaacctcatcaccggcgtcaccaagggctaccgctacaagatgcgcttcgtctatgcccatttccccatcaacgcctccatcaccaactccaacaccgccatcgagatcaggaacttcctcggcgagaagaaggtcccccccattacccctttccctttctttctattaccatctaccagcacgtacatgatttcatcctacgcgcaatgtattttctccactccacgattacacgcctctattgattcatctcaactagtagctgcaaatatttaatttatgcctcacagattgcctgtttagcctacattcagcttcggatttctgctctagttagtcttgcaacacaaaatgctgattcttctgttaaaaacacattattagggatcacttgcacatacatcatttctgccatgcttcaatatttctcatatttgttctacacaacatagacatgtggtttagactctagaaaagcaaatcattctctggccttcaacattgtttttttcccaatctgctgtcacattcattcagtatatagcttggaaaccacagataataaaaaatgttatgacatccttcgtttccttcaataataggtgaggaaagtggacatgcttgagggtgtgacaattttgcgttctgagaaggtcaaggatgagctggtccttgatggcaatgatatcgagcttgtctcccgttctgcggcactgatcaaccaggttagatttcttgcacccctgtctctcttagctctgtgaatgtgtgctatgatgatcctgtaaatcacaatgcttcgttatgtcagactgttactactttaatttgctgctgtataatggagtaggtgttctgtgtgcatatgctttaagattctgtatatttcttagagtttgttcatgcttcccaaatctatctattatataattaaaggaatagaaaaaggagcttccacgttctctctcatggcttagaaattctcacattaatcagagaaaaagaaaaagcagagtccatatagaaatacaatttagaaatagctgaaattgggaataaaaaaataaggaatattagaagaggagactatagtccatatagaaatacaattaggaaataactgaaattcggaattaaaaaataaggaatattagaagaagagactagagtccatatagaaatacaattagaaaataattgaaattcggaattaaaaataaggaatattataagtagagtatagagtccatatagaaatacaattaggaaataactgaaattcggaattaaaaacaagaaatattagaagtagagtatagagtccatatagaaatacaattaggaaataatagaaatttgaaattaaaaataaggaatattagaagtagaggatagagtccatatagaaatacaattaagaaaaaaaaatagaaattcggaatttaaaaaagaaatactagaagtagagtatagagtccatataggaatttaaaactaactaaaatttggaataaacataataaaattaaaagtagagtctagagtctgtataaaaaatacaatttacaaataactaaaattcgaaattaagaaaaatatgggaagaagagtttaaggtcaatataagaatacaatttattagtaactgaaattcgaaattaaaaattgaagaatattgaaagatgagtttagagtccacatagaaatacaattagaaataataaaaattcagaaataaaaataaataatattgaaaaaaaagcatatagaaatacaatttacaaaaagttcggaatttaaaaaagaaatattaaaagacgagtctagagtccatataggaatatatataatttacaaataactaaaatttgatattaataactaacaagtatataaaatataatatgaaaattcagaaataaaaataaataatattggaagaagagcatagagtctatatagaaatacaatttacagaaaattcggaattaaaaaaaggaaatattaaaagacgagtctagagtccatataggaatatatacaatttacaaataactaaaatttgatattaaaaataattaataactaacatgtatataaaatataatatgaatattacacatattgcaaaatttaaaattatgttgtcattttaatatatttgaataatataatgagaaaacatatatgctattatatgatagaaaatataatgatgctaggcgcgcaatttgcacaggccaccatgctagttggatgtataacaacagtgttaagattctgctcctacttgacttaaatcaccaataggtggggtgatatctttgctactctgtgctgcacgagtctcatcttgttaggtgtctttactacctgatgcttagttgatctctgtcctaaaccatgtctatttcctttttgctcccaacagaaatgccacgtcaagaacaaggatatcaggaagttcctggatggcatctatgtcagtgacaagggcaccatcactgaggaccagtgagctgcgtttccttactagctgtagcaaaacctgtcctagagagagtgcacaaggaacttttactgctctgtttttgagtcaaatta

SEQ ID NO: 44244 - DNA, 721 bp, Oryza sativa
ggccgtgtaatgcttcagcaatggctacaggttagcatctaatgctcatgctctcaaggaacaattcatcgccctttgttcttaccccaacatcagctgaatgacactagaaccagtcagtattcatgcactttgtaccaatattcctcaggtcacgcaatccgatcatgcatatatagcttgcttgttcggttgttccactgttccgtgaggaggcttctgttgctgcatcaacaaagcggtgctctgcttgccaacctattgcattgctacctcatccatgtacaaatgtttgtatatgaactagttacctaatgacctgagaccgaatcaaaatgttccattcaagatagctacatgtgtggcattgccttgttccacctgcagccaaactgtgtaatataagcaagcttgctatagggggactaggcactctaggcttacctaatccaccccttcaggcttcagctgttcagtgcagacacagagaatgaattgggtggagtttctgaagcccgtagtcgcaatgctggtgtttgaccgctcttcgcgctgatgacagcattggtcaagaaggctttggctgatgggttaaaccacgttgtctttatcaccctacgccagtttgtagcggcagtcccgctcgctccgattgcttatttcaaagaaaggtttgtgacaagtaatctgatctcaagtgtcttatcaggttgggctgcag

SEQ ID NO: 44245 - DNA, 12308 bp, Oryza sativa
tgcaggaggaggacatggtgggtcagtgatggtgaagaacaataagcaatggacgctggggacggtgatgctgctggggaactgcctgtgcttctcgctgtggctgctgctgcaggggaagctgaccaagaaatacccggcgatctactcctgcacggccatcatgttcttcatcagcacgctgcagggtggggcgctcacactggccaccgagaggctcacagcctccgcctggactctcaccaacaaagtggagatcgtcactgtcatctactcggtaattaatcaattaattacatatgccttgctaatagtacatctatcaccatgcacatatatacagatgaattaattgtgtgggggcgcatgcatgcagggggtgatggcgtctggagtagggtacctgataatgacatggtgtgtggggaagaggggccctgtgttcacggcagccttcatcccggtcatccagatcatggttgccttcatcgacttcttcttcctccatgagcagctccacctcggcaggtatatatgtatatagtactatgcattgacgacgatatatatatatatatgtatatgcatgcatgatatataattaattgatttcatccttgcatatatgatgatatatggcagcgtgctaggatcagtgttgatgatcctaggtctgtaccttctgctgtgggggaagaagaaggacgctgcagctgcctcctcggtggtggtggtggtttgttgtcctgaacccaagcacctgcctgttgatgatgaagaggcgcccaacaccatcaaagcccaacagcaaccaccttcaccactcaaattataattgaccataaattaatataagtatatagtttgttctaaccaatactattattatattttagcaaagaccaagagcaattagctaaaatatctatagaatgtttccttgttttcttagtgtcacctaaacggttataaaatattttgagaaaaaggcaagataaattagtatgtgatatatcactccgtaaatatgtaattttaaatttaacctatataaattagaaaaagaacaaatatgaccataaatagtacatgtactagttagagtcagatttgttcttttattataacttatagaggttgaattaattgcatgtttatagagtaacggtgatatgcctcatatttatctattttattaattatttttttctatttttttcatagctatttagacaacacgtaacgacatagaagaaatgaggggacatcttttgggacaaaaatctatctccgatcaattagtatatatatagcatcccaatgcatggttcatctgctgtactgtaagtggacaatgaaaagaagataagagtgattatatactatattggtcgtgggatatatcacaaccaaccgatgatggatgctcgcatttgccaaaactgcaactaaagtgaagtgattgagagtaaacatatatagctttattccacgccattatcacgcaattactttttaaactgtaagatagtagtataagacaagaacaataatatttgcactcgctcatgcatgcactgagattcgcttgattagttctcttggcgtcgtcttaatttatactatcgtctatggacgtcaccacgaatctggaccaattgatttgtgcatctggcagcttagcttgcaattatataccttattaatcgctggctccggccattcctactgggcttacctcaaaaccatgttggccctcttctggtcggaccagtggatacatggccgctctatggcctttatggcgccggaccttctccttgtagtgcccccacgtctcagggcatcgcgcaatgtggccttcgccctcgctggcaactcctgggtaagggatatccgtggcgtcctcactgtcccggtcatatcccaattcctgatggtctggaatgcagtgtgtcctatccaactctctccgagcactggagaccgtctggtatggcgttggacgggggaacagtgctactcggcccgctcggcctaccatgccttcttcctagggcaacttccctttccttgcaccgacttaccgtggcaggccaagggccttgccaagtgcaattagttcctttggtttgcactctagcaatgttgttggactgctgagcttttgcaaaagtacgacattgacaaccactcggtctatcccttttgcgcgcaaggagcttgaaatggtgaaccacatcctactcgactgtgtgttcgctcgctaaatctggcacaacatcctgtcccctcctggttggactgggctcgtcccttctcgtggtgacacttttcaggactggtggccgtttgcggtttgctagggccgcttcccagagcaccttcacaaggccttcgactttctggtcctccttgtatcctggcagctttggaaggagcggagtgttagggttttcgagtctttcctctcgccggtcttggaggtgttagtttccatcctccaagagggtcgcctctggtccttagctagtgccgctttgtttggggatcttttgggaggatagggtttttctttcgcttttctccctctgtttaggagcaacaattttagtttaatctccttctcttttaacccctctcttccccgtatctttgcaagggccagtccattccgttgtgctatgtaactaaaactctatttcttctaatatattgacgtgcaattttttgtgcgttcgcgaaaaaaatacaccttattaatgtattcgttccacatatatccataaatgatttttttcaataacatagtcaaggatgaatttttaaagaccaacccttctttaattaaagaaaggaggaaagtaagaaaggatgagtgtgcatgcctagcttgcgtaattgactaatatgaaggatagttttcattacttaggagatattgttttgtttcttgcatgtctaaatagttaaatgattaacataaaatatattactctacaaattaatatacatgttcaaattcaactgctataaattgtaaataaaaacaataaataaatataattatgcaggtatgttaactagttttagttgtagttttatttgatctttttgttacagcctatacaagtcgaattaattaatatgataagatgatatatcttatagtaattaatttatcttgtcaaaattttaaaatgtttttttgtaagtatttagatgatatatatgcagatgtagatgtcaattgagagatgaaaatccatgtatgagtagtaaatctgtacatatatacgtgacggatgcatattaatggatgaacggcaagcaggcatgcagatagagagttgaagtattcaagtcgataagcaattaatggacgtgaagaaatcgcgcgaattgaacgagcgagcgcccgtcccggactcccgttggtccaccgtctccggcagcccgcactctgcgctagctgccgcatgcatctatccatcgatcgatacatgcatcaatgtgtttatatatatatatattccatctagcctaccatagccagctaattacacgatccatccatttgcatcatcgtcgtcgtcttcttcgatcgatcggctgatccagtaattcctcgatcggtggacgtacgccacgctactatcatcatatcaatccccgatcgacaggttaacatcgatcgatcatccaagccagccatcgatccatcagaataagcagctagcttggagaccgatcgatcgatcgatcatatgtcgattcgattcgatccgatggagagcagaagcagcagcagcagcagaagcgtggtgatgatgtgctgcgtgctgatgttgatgattgcggcggcggcgcatgcgggcgagcaggaggcggaggagtgcgctagcccgatgagcatcgaggaggcgtgccggggggcatcggagacgcaccacgcggtggcctacgaccactgcgtggcgtcgctgacggcggacccgcgcagcagcagcagcgaggcccgcagcctgcacgggctcgccatgctcgccacccgtatggccatcgaccacgccaccagcaccgtctgcaagatggacgacctcgcggagctggagcccgaggattcttcgtcgccgtcggacgcgcgcgcacggttcgagcactgccttgagcagtacggcggcgccgccgacctcctccgcgacgccctggacaacctcaaggtccgcatctacgggacggccatggagcagctgtccgccgcgctgggcgccgccgagagctgcgaggacgcgtggaagggcgacgagggcaacatccccatcgccgcccacgacagggagtacggcaggatggcccacatcgccatcggcttcacccacgccgccgcctaatcttcctccatttcttccttacttccatctatcgcctgcctgcctctgcctaattttatttctactactccttattaatttgcattctcatcgatcgatcatccgctggaatttcttcttcttttacttaaattattattattattattattaattgctgattgaattgaatatgtactgtaggatttaattgttcatcagatgaaagacgaatgaataataacacgattaatttactgtgtactttttattttcctcagtcctgttgatttggtacatatgttcacatgtgcatggtttcgatctcaatgatcaaatgtaaaaatattgctcatcgatctaagaaattcagatcaacaagaaaaaggaaatcgaacgatctctatgagccaatgctactactagctagtgcaaggaaattttatagattacaagcatgtcgtcagactaaatgaagtgaataacctgttgtcataatctctggattatcttttttttttctaaagaaaacaatatctggatttgagatatactgcaggagtctgttcgatcggttccaaatgcaatatttatttgccatgcaattaattgagaaactgaacttgtatcaatgtcgacaaaacgctgtctagtactagtactgtacacatcattacaattaactaatgcgagagtataagtgatcacattgatcaaacacaagcggagattatcgtacatccatgtcgaggaatccaaaattttggacccaatatataaatattcaaggaaagcatccttccattttaaaagttaaaggggatgcatttggctaaacaaggacaactaagatatcacaactaagaagctagagctatagatggagtactatttagttgagagcagagcaaagctgttcaggtttcggttgcaacataactgctaaccactcgcagaacgaacggcttgagtagtgtatactaatagtcttagaattaacacatgtgctcatatttacgataaataattttttaatgttaggtgatgtacgcgtcaaaagtgatgcgttaattttttagataatgatcagtgatgcgtcaatgatgattttagcaatatcaagatatatcagtgataggtgacgtccacatcgacagtgatgtgacaatgataactttgtcaatatcaaggtaacatatatatgctcattgacagtgagatatttataatgacttcgtctcaggatatatatatataccggttcaatctatcagagatacttatataataggtgtacatgtgtgttgataagaataagtgtagcatgtgtacggcgtcgctctccccaggagcggctcgggaggcgacgacccggccgcccctctcccccacccccacccccttctccgcctcgccgtcgcccgagcgaccgccggcgaagccgcgcggccgcaaggacggcggcagcggggcgctcctcgtctcctcgcgctcgggcggcctggggagccgcccggaatggcgacggcggtgtccgccagatccgcgccgttccggccggatctggcgggatgggctggcggcggggacgacgacggcagcggggacgggcgacggtggcggtcgaggtgagttgcgccgggtggtgttgtgggtgacggcggcggggatggcgacggcgttggggtggcgatggtggaggctgcggatccggcggtggcgcacccggatccggcggcggcgcggcagccggcggaggcaagagcacgcaggcaccccgcggctgccactggcgtcggccggcattggtggagaggaagacggccggatctggctccttgcccagatccaacgcgtcctcgggtgggaacagggtggttggagtccgatcgtcgtgcaggtggtgtgaatatcgcaggtatcctcggtgtgcaggtgacatttggtggctcccgtcgtggatgctatggttgatgggtgctccaaggcgaaagtcttgctccgctctcggtgctagcaacggcgacgcccttgggcgccgtttaccttcttgaaggcgttgctactggagccctcgttcaactccacttcaagagttttctccgggtgaaaacctagattcgttaggatcggacgatgtcgccgttctgtcggcgtaaccttcttgaaggcttcgttttaggagtttatctcttgttggacggctgtacttaggttcagtttgtcgatgtcgggggttttgccggttttcctttaattaaccgtgctgttgtaaggtttttaggtctgatttcccttataaactggatcaactctcttcttctacggtgaatcgcaggagctccctgcctgtcccctcgaaaaaaaaaagtgtagcatgtgtactattcgtactgtgtactatctagaagacgttgattagtaactaatcccacaagcatgcatatatacactagctagcttgtacgcagtggtagtacgtcgacgttgctaaccataaggtcggtcggtcgatcgacatggccactctctgcggcagcgtctgcttcttgtttgtaataatggtcattgcgtcgtcgccggcggcagtggcggcggcgggcgaggatatagtggaggagacgtgcgggcaatgcagcaggagcaaccccaacgtgaactacaccctgtgcgtgtcgtccctgtcggggtacccaggcgccgacctccatggcctcgccctcttctccaccatgccgctccgctccgccctggccaccatcgcctccgaggccagggtgctccgcgacagggcgccgccggggtcgccgccgaggtcctgcctcgactcgtgcctggaggtgttccgcgacgccgcctacaacctcggcaacgccgtggcggcgatcgagtcgtggaggtacggcgacgccaagacggcgatgagcgccaccaccgacgcgccggtgacctgcgaggacgagttcaaggggcagggcatggccacgccgccggccatcaaggccaggaccaagcccctcttccagcacggcgtcatctccctcgccatcatctccttgctctagccatattgctaccagctactactaccaattaattcgatatccaaatatcactagctagtactatcatgcatgcatgtctgtgtagtgtgtacgatcgatgatccattaatcaatgcatacttactgcatgatgatatatgcagaactaatatctttgcagcaagcctgcacatgcatacataaatgcaaatgatgcctagaatcgggcgcccacgtggggagtaaaatcgggcgccccatgtcgcgccctgcccgccacgtgtatgactaaggctacgttcgttcctaaaggttcccaacccatctccttcattttccgtgtgcatgctttttaaactgctaaatagtatatttttataaaaagtttctatatgaaaattgttttaaaaaatcaaattaatccatttttcaaaaaaaaatagctactacttaattaatcgcgcgctaatggactgctctgttttccgtacggtggagttgggttcccaaccccaagtatcaaacacagcctaagtgtaaaataccttgaacatcctagttttgcacaacaaatgcaaagatgaaactaagtcacaacaaattcatcataatttccgccgcaaatgtcacacatgaatcacaattctcgctaacaacctccgcattcccctgcgtactctggtgatcttggtatcctaggaaatatggtgtgagcgaaatgaataaattttttgaaacactgcatcgccaccggcatccatcctcaccaagataaaagaggaaggtcaggcatgagttaaagtaggagcctctaagcttcaagagttcggaatcttgagagatatcacttaatcatcaccttttgcgggcttagttcttttttagactagccatgtacataattctatcgtcctgtattttccccatctctatcaatatacgaggcaaagcttttgccctcctttcaaaaaaaaacaaacacatgaatcacaatacaattttgaacagaatgattttctcaattgtacatgagagtataaaaaacatgtggttacttgtgataaaaagaaagaacaagatgtgtatctagtggactacatgcggatgctcaaattagctgggcgaatattattagtgttttgacgcatgcatgccgttggtcatcagttaatcagttaattagctaatttgggtgaatccatccatccatccaaaaattagccgggcggccgctcaaaattaggacggtgagcgagctataaaattctatggaaaaagagagagagagattgtgatagtagatgatcaagtgaggagctatagagatcgagatgagcctttcgtcgtacctgacgtgcaacctggtgaccaggcaacggcaacgaggtggcgtggaagaagacgagtacgatgggcggcgtcagccgcagacggccacctgctgcaccgccctgaaacgaggtgtcaccgctgacggactcctcgcgcagccgcgctacgccccggtcaggacgccccaatccgcattgctgctgctcgatccaccaccaccggcgcccatgacgcccacgtcgtcgtccagcaacagcaaccacgacgacgacgacgaaaagaagaagaagcagccgatgctgcagcagcagaagcaggtgcgcaagtgcaaatcgacggtggaggaggcgtcggcgtcgcagctgatggaatgtaaaggcggcggccctcctcctcgtctccgtcgcagcggcggcgtccgccgtgactggagcttcgaggacctccgcgccaacaacaccgccgcctaataataataataattcaatccccccaccctcctgctgccctgcctgtaactaacaacccacttcttgctaaatacatatatatactcctccttaggccctatataaacacgatcactgctaactcgattatcatgtaaataatttatttattattgtaatctgccaatgcccccttaattaattaattatatgtttgtaactcgatctaactagctagtaaaatcatcatctactccaacgacaacacaatcctctcccggttattaccaactacttcagcttgcataattctcaaccttaaaaacattatgttgcactgtttcagctcttctgtaaggtcgagcaacaataaactgtcataatgctggccattcataacctactactcctctcatctgccacattgacgtacgcaacaattacacacaggaaaagaaaaaacgtctcagatgcaactgtgaaattctgcctgcctccagtgtaaaaatggttgccaactgccaaaaagggtactcctcttcttctaaactaaaatccaaaacctgaacaaaaaacaattagcaaactctgttcaagcatacaatatatactactgtttgatcatgatgagcaggtccgtgtacctgatccacccattgggttcccagcagcagctgctttctcaggctccttgatgtccaccacaacagcatctgatgtgatgaatgttttcgccaccgacgcagcatgctccaagcaacatctcaccacctgtttcacacaacgttagctttatggactcaaaatactaatataaaaaatagggtggaaaacatccttgtttgattgcaaggaaagaaaatccatatcccagaggttcatcttcatgcagctgatcacttctatcggttcaacatggtaaatcggttatattaattttacagcacaacacaaaggcacacgtgcatttcaatatatattctaataatgaaagaattacttctgatgtgactacgaataagaaagcgcattgattcggcagaaaattaccttggtgggatcaataataccagcagccatcaaatcctcatattttcctgtagcggcattgtaaccatacctgaagttatcattggcaaggacctgaaatcatacatgttcaaaaattcgttacacacgagctgcagaattgcatattcatcgtacttaagaacaaatgtcagagtacaaaccttctcagtaacaacactgccgttaacaccagcattttttgctattaatttaagtgggtaactcaaggacttccttacgatttcagccccaaccttgaagccaaaaagaaattttaattattgacaatagaaaacaaatgccttgaacctaggatgaaatgaaacaataaccaaagattatttcatttgttttcctaccttctgttcatcattctcaagtgtttctataatggcatcaacttttgatgcaagccgcaaaagcgtacagccacctccaacaacaataccttcctcaacagccgcctgccacagagcaaactattaagtaacaaacaacaaacccatatactctatgtgcatcagaaggctctctgaatgcaatcccaaaattaaattatattaacaaagagaagtattcaccttggttgcattcagtgcatcttcaaccctcagtttcttttccttaagctcagtttctgtctgtgctcctacctacataacaagtagcgtcatttcacaacaattatcttctgcaaatgcagcctagtagtacattaacaagtgcattggttcaattgcagaacatcgagatcacctggatgacagcaacaccaccagagagcttagctattctctcattcagtttttctttctcatattcctgttcagcaacctgaagaaaaaataacttgtataaaaatccacaaaaaaatactgagacatgtgaatccaaaagatctgccctgtaaattcatgtaagcaaagaaacccccaaaaaagagcagggtcaggagaaaatgaatacaggagtggtttgacgagaagtacaggaacacatagaatttttaattttaaataatacagacctcaatctggttcttgatttgtgtcacccttttgtttacttcgtcctgggtagtaccatccccaactattgttgttgaatccttggtaactacaaccttggcggccgttcctagaacatctctatcagctttgtctagggacaagccaacttcttccctgatgacagtacctgaaagaagaacgatatataagcgcacgtgtggcttagagtgtagacaacttatgtcaaaagctgaatatcacctccagtaagagtagcaatatcatcaaggtattgactcttgcgttctccaaaaccaggagctttaatagcagcaatcttcaatgcacccctaagcctgttgaccacaagagttgcaagagcttcctgctcaatatcctccgtaactattaggattgggtacccacccctaatagcatcctccagaattgttataagatctctggcattgttgattttcttgtccacaaggagcaactgggtgatagaatcaacattagcatcaaatgcatagagcccacaaatgagtatctggttaatgcacagtttaagtacaccgaattctagaatgcatcaaaccttgcaattctcatactccactgacattttttcactgtcagttacaaagtagggagaaatatagccgcgatcaaattgcattccctcaacaacatagagattattttcagcactctttccttcttcaagtgtgaccaccccctgtcgtccaaccttgttcatagcttcagctatcatgttgccaatttcgtagttatttccagcacttaccgcagcaacatcagcaagttcgctgtcttcaacctgcaaagttgcatgcaatatgatagattcaaatttcaagcaaaaatagtgctgtagcggatgagtacgattcaaactggcagccaatgctcctgaattcaaatgggtgttacttaaatatcagcacagaagattcccagcactcatgtttagtattactgaaaaagaaacgtgaaacatggcacact

SEQ ID NO: 44246 - DNA, 2523 bp, Oryza sativa
tcgattgttccaagttagttaattaccaagtgaaaagaatagaaggaaactggttgcgattcttcagagaagaatagatgttcgggaacacaccatgtcctgagtagcaataaccatacagtccaattgcgatgggaattcctgggagattcagtgcagtccctttgttctcaaaaccaacatggtcaacaaccccaacccagcataggcagacaactacaaggattgatgcaatgacacccccagctacaaacacaacaacatcatgagacgatgtgcagtacatacataaggcacaacaaataacgtgcatgttatttaaacaactctagacccagtaagatgaacagaagaagcaaggaaatgcaaacctgaaagataactcagacagctaaggtcgcggagccaagtggttggcatgactatgagggtggtcaagattgcgaagaacacatgagagtttagtgtcatgctcccaatggttagatgtgcattggggaataactttgacaaattgtcgctctccaatatcaaatactcaatgcaacaggcctgaaacagtacatcagggtcaattaacatgttgtgaaaatgctttaaatagtattactattcagaaggaaataaaaaaatatattatgtttccgtggcaactcttcacaacctaaactgagctaactcatacgtattgcatggttaagttaggtaaatgtattgcattataatctcaagatctaagtaactaaaggtaggtattattttggttctgttttaaagcatagaaatttcaactgaaataaattattattgaagcatgtgacactattatcaatgagcttgaatacatgagaggtcatatcagagttgcaaataatctaatagtgtggtgggctggtggccttgtacttatcagaggcacgtgtgtgactatgtgttttgtcccggatatgaagttgatgtgtgttaattgtatgaattcattccctggggactagcacgtagcaatttcgattgaaaatggcttattagtaataagtacttacatacagttcgatgtacaggattatctgtagatagtggagccacatacaaggaaaaagggttagcacaagagcagtcatttttgcataacctgaagcatacagttgaaatatcatcatctacaagagattttaccgagattgctatacgtccagtggtgccaaaggcggcatgaccaatatcagggtatgtctcaagaccctccttgctgtccagacaacgtcgaaggagcactccggtgtaccaagcgagcacagcaaataagcaaagtatcaccagtccaagccagcctccctgtttaatggcatatggagtcgataggatccccacaccacacagaacatttattcctgcataataggaaaaaatcccctagactaagtaataatacgtaggtatttggaaaaaaaaaagttaagttatttgtcctgagtaaagcaaacagatcaatttcttgggttaagaagaattagataaaaatagagagattggtacttgtacattttattttggatgaagtatttctgcatataatttgataataattatatgggtttgtcttgaagcaaaagtacagcctgcagatctatctacttgctgtttgtgacaactgtcacatggtggggtgactcaaccatgtgatgtccctattgatgccaagaacaagaagaaaagttgaactggtggacctgtgatgcggcgtatcaacaaagagaatagaccattttcaggacaacatgattgaccatttgatgtacttgatgtttgcacttaaactgataaccgctgggctaatctgggctccagatgtttgctgaactaactaatgttttgcatttcgctaaaaaaaaactaaaggtttgggtcttctatcaatgctggtatatcaaataaaatgaaacagcatgtaaagctagtataactactagttcaaaacagtgtgatctcaaattctcaatccagatccttagaaattcatgctctgattgtttggactggtctgagcatcaatacactgaacttggacatgctggtctgtgggagcgtgtccaggttcaccaaatctgattgtgtattcatcaatgctacgtactccatatgacaaggatattctgtggtgccaataagtgagggggtcctatttctcatgttctacttcacagtagaagcaaaacgacttccagaaagtcatatgcaagcaaattatggttggatctataaattggtttacgagaagcaacatatatatctagtatcaatcattgcaggataaataacattctagtatttcccttccataaaggaaaaaaaagaaatgatatcatcattaattaaaattggtagacatgcgtaccattcatcactgcctgggtgtaggagcattgttgataagccggcacctcatgagccggcaccaatggtttttgatcctccgggatctgttgcaaagacggttttcttgagggaagcaagtactgggaa

SEQ ID NO: 44247 - DNA, 1334 bp, Oryza sativa
agattagagagaatttcaggggttttgccacgaaaagagttggtgaggaatgagttggagagcctgcttagagttggagttcccaaaaagctcaggttgggagactgcacgctactataaatgtcgattgattgcctgttaacatagaagtaagagagaagagttactccatttttatttttagtttagtttagtttgaataagatgagatgagcaagggaggttggcatctagtagtcctatagtatgtggactgtttctcttttagatgaacttatttaaattggaagaatgaggatacagagacagatacagattaattgatgggaggataaaaagagaagaaacaaatctgaattttggcaggaagggaggggaagggacctgtagctttgcggccattggtgggtggcgtaggagcttgggcgcggggtagcgcaggaggagtcgtcggagtcggagtcggagtcggcatccttgaggaggatggaggagtgggggtgggcttcctcgtcctcctcctcctcctcgctctcgatgaggaagctgttgctgccgcgctcctcctctgacgcataacgagaagaagagttgttcatctcgtgggatctcatctcttctcttggaatctcctctcctctcttgggctctgcaagtctgcaactgcagtcctcctcctatacaagattagtagcagtacaagaacaagagctgtgtgtactgatcaatgttagagataatgccaagacctgattaggattaaattagttctcctctctctctctctctctctctcactgtcgcacacacacttttagccccagctgatgcaagggagaaggaaccattggatgactccacacatgcatactatacgattggagtagacaacaagtgcatgattaaggctgtgttcgcacataggtgttcccaacttgcacagtaaacacagaaaacggagcggttcattagcacgtgattaattaagtatttactatttatttttcaaaaatagattaatttgatttttttaagcaacttccgtatagaaactttttttaaaaaacacaccgtttagcagtttgaaaagcgtacgcgcggaaaatgagagagataggttgggaaaaaggggttgcaaacacaccctaaataaattgatgccgtccgtcatcaacgtcatgattccctcacacattactctccttcgcctctatgacgatgattccctttctattattcataaccatattccccttcattctccaattcaactttaaataaacacaagacattactactagtcctagcagcttacatgtcaaattttgctgcat

SEQ ID NO: 44248 - DNA, 3109 bp, Oryza sativa
aaccaaccaattggtaatactcagtgtgattgatatattgaatctaactaagacaacaaagcaatctaagaaagaatcgatagatcacataggcaacacaagtaaaagcttaactagtatatcgcacttaaccaagaaagtactaattccgccaatacaagcgaagttgatgatacttactttctcgctagagatcaaaactaatgcagcccaaacttgaaaacaaaaactcatcgaaactagaaagttgtatattgaaccgttgttaaattaaaaggaccttaggtgtacatatttatacccataggttagatcaagtccaattctactacagttagatcagcttaggactctatcccaaataaggaaactacatgatacaattccgactcagacatgactctgatcggcaaactagctaagtccgaatccaacacgagtccatcagctcataactctgtccatagaaaatagaaaccaaaataaacgttccttataacggaacgagataaatttaccaaccaaatctacgaaaatcatggtgttaattctctattttgattcagtattggctaacgaaaatggccaaatttcaccgttaacaccactgttggctggccgcacctacctctggcttcgacaacatcgacgcgttgaaagttactttcctcagcttcaggggcacgtgtgtgtaacccttttgtatcctcggcctttagctgggacgagatcggatctaagcaacacaattaaatatctcgtgtactggtctactaggcatcgggtgctcctgcttgaagatgctacgacattattgtggtgccgcctttggtgccttgtctacatggtaggaatggacaccaacaatgagaaagaactaaggaaggatggcaaggaagcattgatggccactgcgtacaaaggtttgatatggggagtgggtatcaaacgagtaggtcaagaggaagggcagaaggtcgcccaatattcaacataaggtaaaagatcatagtttaaagtgaaaatattatgtatgacttggttcacgataagattttagttatagtccaaagtacaatttactcaaataacattgactggcattcttggtgtttcgtggtcaggagtacgaaacaacgtgataacattggcaatgaggtattggatgtcaatgccaagatctttctgtgttgaggtatatgtccattttgtttttgttagagtttgtttttatcgagatctatttcgaaaacaactttcttaagaaagaaaagagcagtgtcccctagaaatttgagtgatgtggtcaggtcagagcgcgcaaagcccaaatgaaagcccacaacctggatctggaatgtactccagtattgttttgttgggtcggcggcggcgggtgagagtggagaatgatgatggctctccgccgcgccgtcggaattggctccgccgccgccctccgctctgccgcctacctccgccgcgcctccccctcgccggcgcggccccatcccctcgtccctccaccgcctgccgcccgaaccttcgccgccccgccccaggtatcgtatcaatggatccccttcaccctcgaatcttaactagtctagtctagtgtagtgtactactatactccctaactactaagtatcttgttgttgtattacaaggtgatgaagaggagcaccaaggacgacgacgacgatggccctcggatcaacaacgacatcacctctccctttgttcgactcgtcactgaccaaggtacggtaccccctctcccgtctacccttgtcctcaccgcatgctctctcactttttgctcatttttgcaggccatagtgttgtccccaggcacgaagctcttcagcttgcggccaggatggacttggacttggtcgaggtacttactgccctctatctgctttcttcttgtaaccaaaccaacctaaacatactagtatttcaattgccatcaccatgtcaaatccatttctttgtttatctatctgtgactctttcatcattcctttttacacgatttaagatgttcatggatgatactgacagtggatataaacaaccaaaccgattcacttgtatttccctctacaacatatctgaccatttgccacatttcttgagatttgcccaatgttcattaccgtttctcttttattcaggtccgcagaaaatcagaccctcctgtctgtaaaatcatggattttcacaaagagaagtataagaaagacgttaaggagaaagaacgcctaaaaactaaggtatacttacttcctggctcagttttcttaactatccattgatcactcattcgaccaaggcgatcaacgtacaaggtttgccttcttgtgagaaggtgatggtggtttaaaagacctgtgttatgttatgtagctgtatggatcaaatgcccaacatactgctcaatattgatgctcctggttaatttaatcatcctaccattgggaaagactgttaaccatatcgtccctgcttgtgtttggatctgacaggctataacatatatctccttgtgttgttctggttttgtgcagtctgctattgtcttacgcggtggggagaacaaagaagtgcggtttaagggtaaaacagtaagtggttttttcttgctttagtttgtttattgcagcctatcatcttggctgcaatagattgctgatctggtaactggtatgatatggtcgtatggagtatctagttggcctatcatacttggttttgtccaaggcatttttttttcagtttgtttggatccatatgaacggtgcctagtttgtttggacttctctagtctttctgtttaaattattgaacctttctatggaagtatcaaagagtccaaattatttcaaagtttcttttgcagttacgtttgagaaattgttggtatgaaggcctaacttggaaggttgctgatgaacataaattgttacatgtaggaactaaaagacttgaaggtgaaagcagatggaatcaccagattaatggagcgaggttacagggtgaaggtcagcttacattccatttccctttcttgcttgtaccactgtagaaaaggtcactttgt

SEQ ID NO: 44249 - DNA, 886 bp, Oryza sativa
ccgacttatcacttgatggtaccttgtccatccgatacgcgtatccagacttatacaacactggtttgtacagctctgccaatatttagtgacaattcatgcagtttctgttagcatcatcttatgctttgctttgtctttttttactatcatttactccctccttcccaaattgatcatcatctaatggacttcaaaatttctcaaattgatcatcatataaccgcatggacatggatttcatcataatacaattaatgcagcatgagagaatgtgtgcatgctaaggtgtaattggcatggtgttttgatcgatgcatgcattgtgggagaatgtgtgcatggttgtcttgattgatgtgatttaaattatccttggtcttggtgcataaacatatactccctccatcccataatataacgcatggtaaaagttacacggtctccaaaactaatctttaacttataatttctcatatgctataaggtttgtagcaacaaaattataatcatatgaaagtaaatttaaatgtcaatctaatgatataatttttaacaaataaaattcatttcatattatattaaatgttggtcaaatgttttaaaggttgaatcttgaaatacgtgcacaccttatattatgggatggagggagtatgatgatcattttgggaaggagggagtatataattactttttgtcatcagaggcaacagctgtcggttttctagtcaaatattgctttgtaattttcagtagacgattatctgagaaaaatatgccaaatgatgggaaatgatgagggagctttgctgaagagtagcgattcttaagtacattgttctccatctaatatgtcacactattgcattttgacactagagag

SEQ ID NO: 44250 - DNA, 3870 bp, Oryza sativa
  unsure (1)..(3870): unsure at all n locations
cagctcaaattgtgcctccacatcatgtgagatgtcaaaatgagtggcacttaacgcttttgatttccctttggcttttgtcacgacattctcacttgcagaatttaactttgcacagagtgttctcagtttaagaagatcgtcagtaactccaagatctcttgattcatggtcagaagggaagtatttatctttgaacgactttgcacgatcactaactgcaaatcgaagactggtgttttgaacttctgtagagcatggtgttgagctggcaatcccaggattggaagtgtttgattcatctaatgagctgttttctgttggtgcagcagcaccacgccggcgctggcgtctagaatgcgagggcatcacagattcattgtctttatcatgtggcaatacctgagaaggcaccatatcggaggattctggacatataagcgactccacagcatgaacgacaccttccctcacaaacaacttagagaatgtctcaggaagtttttccatcataatttctgctatttaagagcaggaatcaacacttgcggatctttccacgcaanngaatgcccntgctaaggaagctgcaaaaatggaaattatgtagcttagcaaggatcagaaatgaaggtgtgtctacttgcacaatacaagaaataaaagcttccaatatacatatgccagtaaatcattaggttgtgccaaggagtgactggatcatttcagcagggctgtagcacattattttccagttttccagtgattgataagcattagttttcagcagtcttattcttccaacataaatatgcttatcaataaaaacttccaacataaatacaagaaaagaataagactgagcagaatcttgtattagcacctggatatgtttgttgtgccaaggagggactggatcatttcagcagagctgtagtacattagttttccaatgattgataagcatttgtggcgtatcggtgcatttacacttgagccatacacctgtccaagaacagatgccattaagtacagaaaccctgacatattcccaaaagtagtagtactccatctgccccaaaatatagcaacatctggctatgcacctggacaaagttgctctattttggaaggtagtagttatgttcactgacaagaaagaggatctgggcacaaacctgcgtcattatgggtaataagtccataccgaactgctttagaagctcanggtgctcacgtaatagtctctcatgtcctgacctttcattttctgttgaacttgtgccatcttgtttggtggaagctgatttctttgaagaagagcctttaacaagcacatggaagtatgctggtaaagaaatgattcccgaaggcaaatgtggaagcaaatcatcagcaaggctcactatctcaaacatctgcagaggtaagagtaaatatgtaaacatcacacataaagaaattaacaagcatgtatcaccccctcaatcaaacataggtgccaacaatcaacataagggtgcgtaagtgagataacaagcagcagctgctgataacatcatgcgttaacaatgctcacaaatgtcagatattttgaatctcagcaaatatgtttattggcatatgtatgatataagaaataagaccaaaaaaatgtaactcagcaattagttactactggtaagcgttggtagctttggatcaatcacacttcaaattagatactgagtattgtgttcctttatgtctccttaaaacactatcccaaagaaattaacttaatgcaggacgcgttatttgagaatagtgtctcaaggactgttgtacagcatttgaaacaatggcactgaacatgaacagagatccaccgataacatgttccctttctgcgtggttcattaaaacgtcaacagactagtttttgtttactaaataacagtcctaccttcaatcctcaagaatattaccatagggaactgcccactggtatggaaaattgtacatgtggcataggcgcatagccttaacttttaggaagttgtggtaagccatggagataggcgcagaagacacaagtttagaaaacatggtctgctaaagcaagtttcagaaatacataagaactgagtctcagctacccgcatgtcacttcatctgagatagatgataaaaatgccataaagcttcagattaagtaaattcagtgacacaggcaatcacctgttcagcaggccttgacaaagctggggagactgatgctccagcaaccaaaccagaacctgaaagaatatctttaagagtaccactgattccaagaagaagaagtgttttggctgctaaaagcgacccactcgcacatgttgagagaagacgaattaatccctgaaaaaagttccagtctatccttagcaagagtacagaaaagataggaaacaactcgaaagaatgacagaacatatttgcgtgtaccgtatatgttgatgtactcaacgaggcctggcctgcggagttgctgattgataccaggctagcagactgagcaaccaacccatgattgcacaaatcatccaatttctctggataagaagcaaaagcctgtgcaacgcgtgtcaaacaaacagaagcatgttcgagcacctggaatgagcataaacagaaagttaaaaccgcatgttataaaggtgaagccggatcaccaatgcgatgtttggaaatgaaaaataccttagaatcatggtggttcaagagattcgtgagcaacggaacagcttccatgacaaactcggacgcatcagatggcagcttcctgcatatattagcagcagtagacaacgcaactctctagaagcatgtccaagaggaaacagatagtaagttaatagagcatgcagaaccagaggaaattaaatttaagtgggtttgaagatttgagatatccggagtggtgaattaattaatagcatacctgaacaccagtagagaagaagtccagatatgacaggacagccattagcgcaccagctcgtaaacaggcagttggatgctcctgggagatcttcttgagggcttgtagcgactaagaacatcaagaagtggatgttagcatctcggtaaacacatgcttgaaggggcaaagaacaggtgttccgagtgaatctagctagcctacctcatgacggcaaatggttagattcatcatttatttatgacaccacagcttatagttatgcactttaaactaatcatatgaataattttatttattcatcagtggtgtagttattcagttgggtatggaatataacgagacgacctaataaccacatgagtagagttcatgcatcaatggtactagagcgtatagctatactggacctatcaaagacaatggctactgagtcgtcgttgtggtggcataacaacagcagagcaagatgagagtattcaggtaaaaatattcaactaggtcatatgaacaattttattaattcagtggtgtacatacacgagtagatgaatgaatcgatggtagcagaaaagcataacaaagcaataataataatatgaagaatgagatgagagtaatgagtaatgagacaaggggcggggtgagtatacctgctcggcgaggtccatgtactcgatggtgagcaggcgagcacagaaacagggtatagccccatagtgcacgacggcagagcaagaggaggggaggacgtcgacgagattggcgagggcacgggcggcgagcagcatgacatcggggctggcgccgcctgcaccatcctccccggggccgagaaggccaacgaggatgggcacgaaggcatcgacggggaaggcagcgagcgactcctcggtgccgatgga

SEQ ID NO: 44251 - DNA, 3331 bp, Oryza sativa
aggaggaggcagcggaggagcggcgggtgcgcttgggagcagaggctgaggaggaggaggaggcggctgctgctgcggctgcggcggcggcgcgcttgcggctgcgcgtttccatacaagcggtgacgggcgggggggagggggtggctcgcagccgtgcctaggcggcgaccggcggcgggcgcatcgatcgatcgatcggagctcgactcgatctgcggcggatcggattcgctcgccggagaggagaggatggatcgaggggggcgagggatttggggattttggggcttaagacggtgcggtggacgtggcttggctttggttccccccctcctatagccgctcttcaaccaaacggaatggaatgcttctcctaaaatcaacctcccattttatttttattttacttaattttattataacaagactacatattttttaactaaattatcacaaactgtagatataataagtttatatattggaaaacttccaattttatgcttgagttatcacaaaactacaagttttaggttatgggagggatcacaatcttaacaaaattcaaacatcttgagctagctcaaacggtgcatctcaaacggatttcttcaaaaattgtagaatatcattcaacatatatcaaaatccgttcataactaattaaaaatcaacgtccagacatggctcaaaacttgcactagccaatcaagattgcaaataatgtttcagtcccatatacaacaatatctaataaactaggtcttacatatttatatgtatcccacgtaagaagagttttatttttagcggtaaatatctatgttcatgatcttagaaagcgtttctaggtacattcaaataagtatggacattttaccatatcaagcataggtataagtatggacattttacccatagcaaagcatgggtattttgctagtattgtaacaaagataattcactgttgccatctctatctatacttatagggtcctcctagcgttgagggcaatattttttttattgaaaattgaggacaatatttagtaagacgtttaaaactttgatatcaaatacttgttattccattacaaatgtcttgaaaatataacttagcctcaatattccacagcaacaatttgtaaaatcttaccatctgtacagtattatgacaacatgtatacttgggataacttgcaaggttaacttgcaacccctaccagctcgagtctttggttattatttacgaatgttttcataacatgaaaacggttacccatccccttaaaatctttgttgacctatattattattaccattctgaagtataaaaccaaccaagggattccactgtctaacttatcttccctgggttattaaggttaggagcactataagcaaggtataccagtttataaagcgaagtaaggattaaacagatgtacaatgacgagaattgcctccctatttacatttgaactgcattgcgcatacgcaacgagtgcatatttacatagaaatgtatattcgcatgagcacaggcgcatgtacccacacgtcaaaaggtcgataaaagatgaacaagcaggtactgcaaaagacaaccgtggaagtagtagtacgtgattggtaccgcaaaatgagtgaacatcctacgaaataacatcttccgatcgaccttgtaaacaagaaagaaagaaagtagagaggcagctcaggacacctccacgaccaaaagagaagaaagaagctactactgggctcgtccacgggcacggggtgggtggtctgtcaacagtcgaataagcttgtcggatctccccattgcatctcttgacgatttcactttttcttcctgcaccaaccacgcctacactttgtcagcagctaatccaaatcaaaccaattgtgcatcaaacagacagtggttttgccgctagctataaataatgtcatgaatcagcgcttaacaagccatctgcatcagcgatcaaccagagcttagatttagccgccccattattgtgaaacacttggatgtggttccaattgttgctgaggtttcaaagagacgtacctttctggtatccacaaatatatcaggacctgtgaattctttgagcatcatagctgacacaggctgcaatctcctggtcgaggaaatgaaaggtaaacttcaattccatgacaagcatgcttttttttgcgggacacaaaaagcaagactcttaagcagtaattatgcaagaaaaaacatttctgaagtactcaccttctagtgttctttctattgcaaggcttagaagcagagagatcctctattttatctgtcagtttttcagcctgattgtccttggttggagacttcgaacgataaccataacaaaatatgactattagaaaggcgcaataaaaagaaactagcctaacagagcatgtcatttttctttttacttcttaactaacaatattccagtagaatatctccaagtgtttatagacttagcattatatttttcatcataatgcaacaagcaaagaagtgccatccgccccagactagacagtaatgatcttactattggagctttccttggggaagattttccatttagcgtacatggatacatgcctccatgatcatccactacatgtggaggttgagcacagcctacaaaaattgtgttccattgataatgtaatacaacatttcagaaggatatagacaatcatatacaacatgcccacaccaaattaagcacgaccaatgcttttgttttatgagatattacacattacataccatattccacaatggttatttctactgttggcttgcatctttctgactgaggatcctgctgaagagcaccctaaagaaaaggcacaaacatatgtcttagactttccaacaaggcaacaacgatttagcatagaaagaagaagcgccacttgcatgcaatcatatttcatcctgagaaatagattaaaagaataagaatagcagctaaccttgattatgtaaggaaatattttcagtgcacaaagggattatggacagtgttctacaacttgactaggatattattgtgttatttttggaacttgaaggagctcagtaccacagtgaaaatagaatatgcattacgctccacatccccatacttccatagctctaaagaatcaatctcttctttcttcccaagagctctcttcccagcctagcaagaaacatccccttctaaacccccaatggcagccatcaccagttcactaccctccccaaactcccataatagaaaaacacaacgaacaaatcaaaggt

SEQ ID NO: 44252 - DNA, 921 bp, Oryza sativa
tgacgtaaaacacgaggactgggagatctgcttagctcctgtgcaggtccaaaggttggtgatatgagggcgtgccagttagtttgatcctgcaactgacaagatatgcaaatagtagatcaaaacagccgatcggctgacaagccgatggagtagttctagccgatagccgataatagccgatgccaataccagccgatagcgatagggtttaagcaatcggctatatgtccaatgtagatgatgatataaaggcaatcggctgatgatggtgtaataaaataacaatataatccagtataaattaatcggtaaataatgatatgataaataagcatcgatccgaaagttaaagcacacatcggctggaggtacgatgtcatgaaatccacaaagattagattaaacagtgaaacctttgttgtcatctgctaaatccaacttatatatatatatatatatatatatatatatatatatgcaatccttatgagccgatgcaacgtccagataactcaccggctgaaaccccgatgaaacccttattggcattcaagaagcaggctagagattatggttctaagcacgacttagtagatcaaacttaactgatacagcactaagtatgaaaaagaaacataatatctagacaatcaagccgttgactgagttttcagggtggtagatgtataagttaatctaatctagcatgacgatttagccgataccggcataaaccctaaagcgagaagcagccgatagagctaaattgagatgctaagactagattaacatagacatatgataaatagccaggcaaatatattatccaaaccagagtaatccaagaggtcgaatgtatgatgcagccttgaacgacgccgacgtagacgatacaattgcctggaccggtggaacatt

SEQ ID NO: 44253 - DNA, 32243 bp, Oryza sativa
gaggaagcagagtgtcttggtctattttgcgtacatgtacattcaatagtattacacttagggataaaatcttaaccactaatttattatattttagccgtaaaaaaaaatctgatagttttaagattgtaattatgtcagaattttatcttctttttactctatgtataatgaattttaaaatgcaactttgcacgtaaatgtaatactattggaagtacatgtgtgatttttttaagaattttttatgataatttttagttggtgtacacggtgggtacacacgagggtctgtgtgcataggatacgctcccgtaaactgcggacatcacttatgtgtgtgtgtgtttgtgtgacctggcctttgtatgaatggaagtgatatccgcagtttataatttgtatgtatatatagcactggtattatggctgaagatcgagtagagaagaagaaaaaaaagctagtagaggttaatactagtagtagtatatagttaaaaggaggacatgcaaaggccattttggtgttaaataatggagtgtaagtaaataaaaaggaagggggggcggcaggcttcacacaaagctggcgcgcacacagacgcatagcatatataggatgatgcgtgtgttgtattccatcatcatcaggtagcgcgcgcggatagatcatatctagcgtggacgatggcgaggcatcggtggtatgtgcaggcggtggcgctgctggtggtgctgaaggcggcggcagggtctgcggcgccgccgacgacgacgaggagcaggagcagcagcacggtggtggccgggatggtgttctgcgaccagtgcaaggacggcgccagaggcctcttcgactacccgctctacggttggattgcttttgcatttgcatataaagatactacaatttgattgcaataatccatgatgatcgatgatcatgggggcggcggcgtgcttgaggcttgagcaagctacctgtccgtcatctactctactgtgtgcagtgcatgctattctccttgcctacctaacctgatcaattagtactttacttcctttattattctttccttcagaaatttgtggttaatttggatatgctgtaaaatggaaggaatgcatttgtggtgggtgcaggtgcgcgggtggcgatcgagtgcggcggaggggagagcccggtgacggtgcgggagtgcaacaccaactggttcgggggattctccgtccgcatggagggcacgcccgagatgaaccgctgcacagcgcgcgtcgtccaggccaccggccactgcggcgccgccatccccaccgcccctcgcgacctcaccctcgccttccgcatgctcggcctcgccctctacaccgtccccccactcctctcccagccgctccgtcccatggacttctgcccatctccattaacatctccatctcctcccgccctcgcgctcgccccctctccgattccgactccaatcatcgcgccgccccccgtgtcctcgccggctccccctctcccgcccctctggcgccgcaggcctcgccgcctgccgcccatctggcgcccgaccccaccctcgctacccgttgacaccatgccgccgccgccgccgccaccgccaccgcagccgcagggctccgcctgcaccttcgagtacgtatctatctactagtccttccttaataatttgaacaacatatagatgattaatgaaatgaaatggatcgtcagcaagtgggcggacgttggattgcacgggtgcaactggaaggtggtgacgcccaacacgacggtggccatggcgttcggccccgccgcggcgcagaggtacggccccgacatgacgctgcgggaggcgctggacgggaggggagacatgtaccggacgctgctgcgggaggccacggcggcgctcctcaatgcctactacaaccccagtggctccggcttcctgtaccccaccaccgccagcgtcatcgaccacatcaacgccgccctcctcacccccacgctccacaagcttctcctcgagggtgcgcgcttccgccgcgccaactccgactccaacctgccctgccacctcaccccctgcaactaattactactcctgcttgcttactcgatcgctaatgcactcgtttttcattttattactcgctacgctaatgtattactagtgtctcgactcaatacttaattggtggatggattttaatactacactactactactggagtactatagtacaatcgattcaattttattattacttaattaactaatagtagcagaacatgcataccgtatgtactggaagcatcatcccttgaccagccaatttattatactccactcgcgcggtcaaaccaagtcaatacgacaaaagcagagcagagcagaggaaacgtttgctgttcaaactaatttaaacagggagctactactacagactactcctccactagaagtagaggaattaccactagtagtagagtagtacattccaattccaattacttgagtagatccttggattattcattccatcaagggttggattcaaaaactagacatccaaattcattcattaattagaggtaggtggagtagtaagtaaaagaagaaaaaaaacgaaaataaaagaaagaattaggagcagattgggcaaagcacgaggccgttctcgttacactcgccgcagcgcaccaccaccaccgcccgcgtcttgttgctccttgcagccgccgccgccggcaccggcgtggggagggagaagcagagcttgcggctgccgttgcagtcgaagcagggcaggaatcgcatgccgccgcatccgtcgcagcagccaccacctgggcgcgccctcggcaggccctccagcagcgccgcaagcttgccctcctcctccaggcgcgccacctccgcggcgccgccgacgtggttgccccggacgaacagccgtggcaccaggggcgcgcggtcgtggtggtcgagggagatgcggtggcgcaactcctcccggaagccgcggtccatggagatgtcgcgctcccggaaggcgacgccgtgcgagtggagcgcggcgcggacggcgttgcaggcctcgaaggtggcgcgcacgccgcgaagcgtggtggtgtagagcagaaccccagcaggaggagcaggaggaggagagtggtgcgtgggcctccgtggtttctgtggggtggcggggtcgaggagaccggccatgagctcccacgagttgatgacctccgcctcgccctgcttcttcagatgcttctccggcggggctgcacatggtgggttggtggtggtggtgggtcggggaggcggcgtgggcggaggaggaatcctagtaggggattgggattgggattgggattgagctgatgatactagaatgttgtcgaggatgccgtaggtggaggaggtgagggagacgatgtgggaggcggagacgccgatgatgcgccggcggcggtcatcgtcgtcgtcgtcgtccacgaacgcggaggcagcgcaacccatggtattggtattggtatggtaggaaggaaggattcgattcgaggatgattaaggagaaaggagagtgaagaagaaaggaatgcattcaaatttcaaaacttgaaaccgccatgccattggatggcactgtactgtactactcctacattactctattgggcctgcctctctggtcgttgggcttggcctactcctgcatcaccatgtatgggcctaacttaccatgctttaagatggtaccaccagttaccagaagtaatcatttagatcctctttattttaggcttttaaccgatcttttagcttactagacaaaaaaaaaaaccgtgcgttacaacggaaataaaacacgagaacattaagaaaaagttgagaaagatttacattatgtaattaattaaaatacaaatttcaccatccttcatataaagaagatatatttatattcctatttttatttcattcccattacatatgaaatcgcaattatacatgtatacgatgttgaagaaaataaagtatcatgaaaatcaaggtaaatatgggtaataaaattttccaaatattggaactaatttttattaaattctccatgattaattacattatctgattttatttttcggaattttctgagctccattactaattttaaccatacagacatcatttcagtttttatttaaatgaaaatctaaatgaaaaccatactttctctctgggccattttcagcccatttatttcctcagcctgtagccgagccggccctttttccttcggaaaaagtacatccaagatccctcaacttgtcatcaagatacaaaatcgtcccccaattgcaaaaccagataccgggcatccctcgagtaacaaaatcgttcgctttaggtccctcgtagttttaaccccagttttgtccgacatggtggccgagtctgcgtgggacccacgtgagccccacatgttaggatgccacgtcatctatcccttcctcttctatcagttttctcctcatctggtaggcaggctagccggcggttggggaggaagtcgacggggcgagccgggagaagaggaggttcggcggcggtggccagcgatcttcgatgcagcagcggcgacgaccacgcaggagcaggccggtcggcggagcgggaaggcgacgggcggagcggcggcggcagctgcgcctgccgcaccggcgtgccggaggaccgggcaagcagggggcagagctggcgacggcgcgggccggagcgaccgaccggcggagcagcccgcgccgtcgccggcgggcggtgggcaggcgtgctgcaggagaggaaggggctgcggcggcaggtagacgccgtcgtcgccacgttcaagctcggcagccgccgttgtactgctcgacggcggtggccagcaactacaccaccgacagccagtactcgctcaacctcaaccagctcctcgcactgaaaaatggtcaatgtgtggttaacgtgtggctttaactttgcagtccctatagatgaaaactgaatgtgatttggttttgtgttggccatctgaacttgtgaattgattctgacattggcaccatgtatgcaaatgcacaatactcggaggctgagagcaacgatggcttctacaaagcttcgctcggcacggcgcccgacgaggccttcgccctcgccatgtgctacgccgaccggaattgaacggaatgcgagagctgcctacgcgcggtggccatcgggatggcctccctctgcccgcggagccgtaatctaatacggactagtagtctcttgcctcattacacgtaaggggaaaaaagaactggtccaagctagtttttttacttaacagtgtaaaagtgtcttatgacttttcaaaaaacaacaaaaaaatcagcttattttgtttacttaatagtgtaaaaatgtcttatgacttttaaaaaaccaaaaaaaagcaacttatttgagtccaataaagagggtcccaaatccagctattcaattgctaggggtcaaactggactttttcctatcaatttattcacgatccatccatccatccggcccattaatttccttcccattaaggcaaagtgatgattactactccccatctcaaaataaatcgatttaatacttagatatgattaatattttctagtataaaaaatttagatataagcatatctaaatacgttgtatattagaaaatatgtcatctaatattagattggtttatttaagacagagagataagaagaagtaaagtactccatccgtattttaatgtatgacgttgttgactttttgatcaacgtttgaccattcgtattattcaaaaactttatgtaattattgtgacttaatttatcatcaaatgttctttaagcatgacataatattttcatatttgcaaaaaaaattgaataagacgaatggttaaacgttactccctccgtcccataatataagagattttgagttgttgctttcactgtttgacaactcgtcttattaaaaaatttgtgcaaatataaaaaacgaaaagttgtgtttaaagtactttagataataaagtaagtaaaaaaaataaataataattccaaaattttttgaataagacgagtggttaaatagtataagtaaaaactcaaaggagtagtaaaaatatcaacggcgccattcagagggagtagcagatattattgatacgatgaaacgatggatggatggatgcatgcctgccttacctttaatttttgcatcatcccattgattgattcgctgattggctcacccggccttccatgatcgagtagtaaattgatccatgattgcagcccaagaaagcgatctatccacagtacgcaccaaacccaacccccaccaggaggttatgactccgttcaggttcaggtgtgctacctatctgacgagaagcgcaccatgcaggcagctactcctactacttttccttgttcacatcatccatccatccatgttcaacctaagtggagtaataactatacttgcattaacacaaatgaactgctatagcttcatcgtgtaacacatatcacactccaaccaatcatacatgcaacttaaaaaaaaaatcgatattctaatgcccatgaatattacttatacgcaagtgggttttcaatggaaatttagtgagataagtgatgtgccgctaatttttgtctcttttaaacatgtgttagagggtatattcgtgggtgtgtgaatgtggtattgtgtgtatggtggtgtgtgcgcacgtccgccatgtaattgaaaaaaagaagatatatgcaactcccataaaaatatcgatatatcaatggaacacttcacattttttagattatttgttagttaactgatattcccgtaaaaacaatcattttttaacagatatgcagggcgatatcttactttgggctagagggaggctcattgccttcctcctcctccggtccctggcctattcttctttctctacctcatcttcctcttccctctctccttgttctctatatatggtgatattcagcgtgggtatgcatcggaccctggatctgccccggactacagtcaatgcacatgttggatacgacgatatagccatcatatccaacttaaagtttattttgcttttctctttaattaatttggtgcgacaacgacattacactaagtctgaaattggtggattttgccggtctcactacctttctccctaccggtatgtatgtgtgcactactattaccacacaatataatgtacgatcattaattatttgtaactatatatgcaacagatagatgctgatgagatgcaggtctctttcgtgcatgtcgtctaaagtgattacaagtaaagaaagaatctctaagtggatactatgaaatgtctatatagtagggtgaaatggatcaaattaatcccccggcctctagctactaaggctacaggtgcagtgtttcagagcaaggttaatagtatagcccactactaacttcaattcatctatagctaatttatacaatagttgattactatactataaatatatggtcccacctgtcatacacacactgcgttttggagttcgtgctgcaactggctacaaatctgtagcctgctgctcttctctctcatcttttatcttattaaaatatgtttatagctggctaatagtctgctattgtacctgctctcacaggttccattaatagccaattgcaaggtaattatcattagtctagatgagctgcataactagcctacgaccaggcctggacatgcatgatcgatgcatggcacaacgttgcaaatatgagtagtatttggtatttcaggttataaaatatttttgattttggtcaaagtcaaactgctttaagtttaacaagtttgtagaatagtaacatttacaaccgaagacaaatttattatgaaaatatattcaattactgatttgatgaaactaatttagtattataaatattattaatttgtttataaacttagtcaaacttaaaacagtttgactttgaccaaagtcaaaatgtcttacaacttgaaacagggggatattattttcaggggtgggggtggggggaggaagaagggattgccgcatgtggggtctaacaccatgttgtccattttgttttcatgtatgtgccacttcagaccgaaaccgccatgtacttattaagagttaagatatgagagtagttcatacggtttcaaaaattcacaagtgttaaatgtctggtgttaatgtagtagttgaggagtaaatcatgcttttttaggatcacaattaactgtacatgtacaatcttccctactactgcaaatgttctatatatcctccctccgtttctaaatatttgatgctttcaaaattttaaaatatgtttgaccgttcgtcttattcaaaaaattaagtaattattaattcttctcatatcatttgatttaagtaattattaattcttctcctatcatttgatttaagtaattattaattcttctcctatcatttcattcattgttaaatatacttatatgtatacatatagttttatatatttcacaaaagtttttgaataagacgaacgatcaaacatgtgctaaaaagtaaatggtgtcaaatatttagaaacggagggagtatatatgaccgcaaaaatgtatatgtgtgtttgtattatttgtaagatttttttaaaaaaataactactgcatagagtatatgcatatacatggtgaatggttagatatgtaagtggtaagttcaataattacatcctcaaaatattttatgtttttactgtaagatttggttaaaaattatccttaaccgtcaataaattatcaaatgtctaatttaaaaataaacaagataaacttgtgttaaatttgtataatagtaatatacaaatttgttagttggaattaattataaatttttgacagaatcttgtgttagacgttaaatatttataaaccagccaaatgaggtaatagcgaataattatatctaaggcatatatgagatatttagttgagtccattacaaagaatttaaggaacatagtgagaaaaagtaaaaacggtactatatatataatattgtgtttatatttgggacggagggagcaagtagctagcctcttaaataagtatcatcctagtgggggagtaccatctatctatcgatcttcttccacacgcgcgtacgtgtgtgttggtcgtctcaaggttagttattgaaacgtatgtcttatattactaatttgtttcatccccgttgtatatgctatatatgtttttcttatcttatgtagtatatgtaattaaaataaataggagaagaattaagctggttaattattttttctggctggtatatgcataatagtaatatatagaagagattgtgttgcagggtatatatagcaaattaataatagatagatcgatcgatcgagtggagacgatgttgccgagaagccgaacgctcccgccaaggattcatgatggcgtcgtggtggtaagcaagcacagatgttgcagtgttggtaatggagcatattgatagatgctagctgcatgcgcgcgcgcgcggggtgatcgatatatgatatgatggatgctgcaggtagaacgcgatgtgaggaggtaccagcagctgccgcagcaggtggagatggagatgacgacgaccaagaggcagcaggatcatcaggtggagacgatgacgacgaagaagattgatgaagaagatgaagaggtggacgacgacggtcgggcgaagcggagggggacggtgtggacggcggcgtcgcacatcatcacggcggtgatcgggtcaggtgtgctgtcgctggcgtgggcgatcgcgcagctgggctgggtggtgggccccaccgtcatgctcctctttgctgccgtcatctacttcacctccaacctcctcgccgactgctaccgcaccggcgaccccgccaccggcagaaggaactacacctacatggacgccgtcaaggccaacctcggtcggtcgatctagctccttggatcttgcatagtactagtatatacactacacagatcgagatatctgatccatcaatatatcgatgtgcaggcggtgccaaggtgaaggtttgcggatgcattcagtacctcaaccttttgggagtggccatcggttacaccatcgccgcctccattagcatgatgtatgtgcgtagttgttatattttgggagaaagagagagagagagagagagtaataataattaatggaagaaatgcatggtataaatatgcagggcgatccagcgttccaactgcttccacgcgagaggagagcaggatccatgccacgcctccagcaacgtgtacatgatcatgttcggcatcgtccaggtgttcttctcccagatccccgacttcgaccaagtctggtggctctccatcctcgccgccgtcatgtccttcacctactccgccgtcggcctcgccctcggcgccgcccaggtcgcccagaaccgcacgttcgccggcagcgccatgggcgtcgccgtgggcttcgtcaccaagaccggcgacgtcgtcacccccgcgcagaaggtgtggcgcaacctgcaggcgctgggggacatcgccttcgcctactcctactccatcatcctcatcgagatccaggacacgctgcggtcgccgccggcggaggcgaggacgatgcggaaggcgacggggatcagcgtggtggtgacgagcgtgttctacctgctgtgcggatgcatggggtacgcggcgttcggcgacgacgcgccggggaacctcctcaccggcttcggcttctacaagccctactggctgctggacgtggccaacatggcgatcgtggtacacctggtgggggcgtaccaggtgtactgccagccgctcttcgccttcgtggagaggagggcggagcggcggtggcccaacggcctccccggcggcgactacgacctggggtggataaaggtgagcgtgttcaggttggcgtggcggacgtgcttcgtggcggtgacgacggtggtggcgatgctgctgcccttcttcaacgacgtggtgggcatcctgggggcgctcggcttctggccgctcaccgtctacttccccgtcgagatgtacatcgcccaccgccgcatccggaggtggacaaccacctgggtcggcctgcaggcgctcagcctcgcctgccttctcgtctcgctcgccgccgccgtcggctccatcgccggcgtcctgctcgacctcaagtcctaccgtccattccgctccacctactaattaacgatcgatgattgtgctactagaaaggaaataggtatccgatgtatcatgagcttgggctggccataacgatgcaatattaataaggcctcaacccacaagatgcaacgatggtttcaattataaggttgggctagacacggttcatccacatatactagctttcaattactaagtattcttattttcttattgaaagtcgcttgctttttttacacgacaatgcatcacatcaacaaaacatactactagttgaaacctcatgttttactgcggaatttgaggtgaacactcgtcttatgggaagatttatagaacaaacctacaaagggattcacaataaggacatacgatttacatcacattaaaccactaaataagtagaaactaggataaaatgtagaattggacaacatgaaaagtcaaaaacagatcgatcaagtgtttgactcggaaagatcgatgggttcgtggggcgcggcatatattagtctatggcttcatgccagtagtttgcacacatcccgtacgttcgagatcaggccatggcccacgggagtgcgtgggacatggagtacataatgaaaggtacggtggcccaaactcgatcggagaaggcacgtacgcttccggctacacgatcgagcggcgggacgcgggatgatgcaatgcacgacgcgaaacatatatatatatatatatatatatatatatatatatatatatatatatatatgtatatatatatcggtggatgaaaaaaaggtcaacggcgtcatacattaaaatatggaggtaatagtagctagagatagaaattttgacataaataaataaatttgtcctattgccaattctaattgtcaacaatatgttgtcaaatatcttccgaaatgccatggatatgcaagaaaagtatgctgtacgtaatacaccaggactagatcaggttctttaattttacaattaattaaatgcgtggaattctccgttattagaaaataaaagacgatgaacttcctgcctgccatgatatgagataatgaagtcacatctctcaacagagatgatcgatcgatcgagtgctcctagcttgcccgcagccagcacagaaaatcagcgctagcttaattagctagctatacgtggatgatatcatccattgcatcatgcattcatcttcaatcacacttaattagtgccttcatctctttctttctagagacgcaattttaaattaaaaatcggtctccgtacgtacgtcgtccgtcgatcgatgcctaattgagcacgccttaaggtaagacaagcaccaataaggaaaatattatcccttgtgtgtcaactactaacagagaacaaaacgttctctgttgatgtgtcaatcgatccatgcatgttgcttaagccaattaagacaaattgccaaaaaagaaaattaagactttgcttgtccccctcatgacaacccttaattaaggtgcactttgatatagtttatacatgatactggaaggacagacaaaagtaatgttccttgcaatcaaaggttatttcctgatacatttacaacataaattatcctttcaactacataatccaggaaacaagtttgattaaattgtctaacattatacataatattttcgagcattgctccggtccagcatattgtacctcgaggtaccaatttaaatctggccgttcattcacggagggtaagatagaaaatatcacacgctaagcagctcgtgatgctccttctctctgactgagtgactgtgtcaacgaagactccaagagcaactgagcaagtccaaaccaagagcaagggcgtggtgggagcgggacgaggggtggtcggcgccggtggtgccggaggcgttggcggcggggtgttggacggcggcgcgttgggcgccggcggtgtctgcacggcggcgaggtaacgaggagcaggaggggtggtcggcgccggtggtgttggacagcggcgcctgcgtcggaggctgctacgcggcggcggaggcgacgaggacctgcgtcagttgtcgatgtgctcgaatccggtagcgataggggaagggccgcggtaggcgtatgtcaccggcgagcttgggggaagtgatgcacggaggctcgtcggccccctccacctccactccggttagcctgtccatccctggtgagagccatcgatcaatgcaggcatgcagcatcttttggagagagaaaagacaggaggaagatgaagaagatacatgcgaaattacttaactacccttgcttctttagtacctctctatgctctgtaaaatcacgtggacaatactactaggtacaactctttctcacccgttggatcaaacgaaatcgatggctcaaattgcatgtaccggtaggtaccaaggtacctgctggacagtaaaaattatcaatattttcatgtgttccaactcttaatgtatgatgctatcacataaacaacatgtcttttataccggtttgggtggcgtagtacctacgtaatttatgctaaaatctatgtgattttagaaatgacatttcaattcatctatttattagcgggagttggggatatgcccccatcaccttttttttatgtctttcttcttactttaagatttttttttactatgtacccattggtagaactagagatgtaatccatttctattaaactttaattaaattagagtgacttcttcaataaaggatctttatcaggaggggacgatctcaagtagctgccttttttttttctttttaagagaacgctataaaattgatcatatattgaaggacgaaacaaataatccacgataatataatcagataattaaaaggatcagatggacagagggagagagccaaacatagaggggcgggttaatcaggaggtaagaacaagtggagaagacaaggataagagatgagaagagcaatgagctatgtatcaataaaataattgatgacctggcagcttagcttaattagtgcagctggaactgataggcgcgcgattgatagcttataaatcgaaggagggggaaggcctcatctccgtgcatctcgctacctaacctagctaacctcctctcttcttcttcttcttcttcttcttcttcttcttcttcttcttcttcttcttcttcttcttctaggctagcactgcacgtgcccaactaacacatacattcatcatatatacacctcctcctccttcttcctctaagttgtgtgtgcatatataatctactagtagagagcagggctaggctagcaattgcaatggcgcctccctatgaaaccaggtcagtcagatcagaattatatatatttatgtactaattcatgacctgctagcaactagatagtaaaagagttataatctatatatatgaagaaattgaaatctcggtatatatgtatctgccttaatgcatgcagcgccgccggctctgaatcgccggtgccggtggtaacggtggatgtggcggcggcgagcgaccttatcacctcggccggccaccgttacgtcgacgtcaggtactactacctatctgtctgtctgtctttgcatcctcccctagctatatctatcgatatcatgtaggagtatatgaatatcaggatatatatgatccatccttaattaatttcttcatgcatgagcaacgagagcatatatatatacctcctaattaatttgttggagaaatgaaattacagcacatgcatgactatgtgtgctggtatcttcgtctgattgatagagcaattaaacatgattatgcaggacagaggaggaaatgaacaagggccatctacacaactccctcaacgtgcccttcatgttcgtcacgccgcaaggcaagtcagccagccgattaattcactttaatctgtccagatttttacaccatttttcatcgtcgtccaaataactagcgtaatcaatatatatactcttatgattcaatactagtactttaagaatttggaacaagaaattctgtctacacatatcgatctcgttctcgctcaaacatatccatccactcctatcattttcatgaatagtaatttcccactacaaaacgatatactactatatgcatgatgcttctggttgttgggttgtgtctgtacctgggcatgttgagcatctgatttatgaacgtggacgtgtgctcgtccaggtacatacggggggagtaattaacaagcatgattatatttatgagcgttattatcatccatgttgcagggagggaaaagaatcctctgtttgtggagcagttctcgtcgctggtgagcaaagaggagcatgtggttgtggtacgatacgaattaaaattaaaattccccaaaaaaatatttatttgacaagaaataatatatgtgctcgatctaattgacgaaccttgtaataaaaataaacaatccaactattaggggtgccaaagcgggaagaggtcggagctagcatgcgttgatctccttgaagcagtaagtttgatgtttttaatcaaacacgtactagttgcacttgtacttgatcgaccatcatctctctctacgtttctcattgccttgttgatggctctgtctcttgttccctgtttacttcccacacacaaaaaaaaaattacaccatatcacatagaacatttgaacacatacatacatgattaaatataggctaaaaaaacaactaattacgcagattgtgactaatttgcgagacaaatcttttaaacttaatttctccatgatttcacaatgtgggctacaataaacatttgctaatgatgggttaaataggctaaattcgtctcacggtttactgacgtattctataattagtttttttattagtgcccaaacacccatgcgataccttttataatacccgatgtgacacgccaaaactttacacatttgaatctaaacactcccttaatatacatacagtgaaacaaataaagtaaaggaagacgggacaggtcatgattcatactcctcgtctaaaaaaatgaatatataactggatgtaacatattgtagtataacgaatctgaacaacgatatattcagattcataatattaaaatgtttcacatccagttttagattgattttttatagaatagattggttttttatggaacggagggagagtacgagtgagttgtaacatgactgacatacagtatatatgtatctgcaacaggggttcaagaacgtgaagaacatgggaggaggctacgcagcgtggctcgacaatggattccccataaacactcctcctcatacaatgtattaacgctttgcagcaccgatgagatgagcgagtgataaacacggactctactgtatctactgtatctcattccaacccctcttctcatctgcctgctagccgctgcttcgtgtgccctgccatgtatatgtatgtgcgtcctgttttcctgtttgttactactggtattatggaggcagccaattgaataaaattgatcatcatgcatgcaatgcacgatgcgtctgcaaatctccgggatgacatcaatcaaccaagtagctacacatgttcaaggactttattatctctaaatcagcatattgtggccggtttgccaatccaccataacagtaggcgtgaggcagagcctctggttacaaatccaaacgaacgactcataccaaaggggcaggccaccttatgcaagaatcatcaatcaaacgtttgcttctcttgccatctgctatgtgctgcgccgttggcactaaagcattgattgatcgatcacctcaaaaattacagtctcacatctcagactgccggttgcagggcaaagtgtagagaaaccaacatccaaacaaatgaagaccacacatcacacggttagatgtgcaattagctctttctttggacgtccatcgccacagccagatggcgagctccacaggacaaacaaattgatgactacaataagtatgactcaaccacggtccgcccaaacttctgctcaacatcctttggcgtttcaatctgcaaacaaagcaacatgacaaatcatttctctacttgaaaaaaaaaaataaaggaagaaataaatattgcccaaatgttgcaatgagaagctaaatatatttcgagtaacgggcactcacggcgtttaatgctatgaagagagctttgataacattcagggggttccttgaaccaataatctgcaagtaaaagacagaaaattactactatctttcaagcacggatggagtgataactggttgcctatctagaagaagtgcacctttgacttgacgttgctgaaaccagctaaatacagtactgtttcaaccgtcctaccagcagcagacattccacttctcattggtccaggccagaggtatatcttaacatacacaagcagcaaccatgtccacataagttgcagcaaaaccacagataaataagaagagcgctaagatacacagatgtgtttttacctttgtcttctcatatttggcctgaattgcatgagcaattgtgtggtcctcatatcgctccatgtaatggaggtcctggaagcatttctcataagcctgcaaacgaaaaaaaaaatcaataaaggtattggatgccagcaagaggcataaattagctcaggtattagtctaatcagatgtccaaacccgcaattgaggatcctcgacgacaatatataagaggaagctactggtatagggccataagaaaaaaaaaactctactgcatctagtaataaatcctgcattaacaaggatataaatgaaaaaggttctgaaatgagaaaaaaggcatatgcagtgcacataggttagcaccacaatcactgcacaaacatcccaaaagaaaaggtgaacaagccaacaatgaaatggataacacatcagcgactattctttgcgcgctgaatgagaaggcaatcataaagtcgcaccgactacaagaaaaggctctaccaaacaagttgtagacgtggcactgaaacgtaagttgaataagaaagatccataccctttgaattgcaatcttggctgtcggacctctagcttttgcaaatcctacaacaccatggtagtttccagtcgctaacaatgctgtgaattttgctatttggcctccctgagacgtgaaatgcataattgggtaatgggtcagacaaaagggtattactagtaggcgtgatcatttgaattcgaactaagagaattcacctttgtgactttacacgtccgattaacatcaatgaccttgacgtcaaaaccctgtaaagtgcacaagatttgtaactaggtaataccaataacaacaagtgaaagcaatgtaaccacaggatagggtgctggccaatccaatgaaagctcggagatgaacatcacttactttcctgtacataggtctcctcttatgctccgtgagggagttgcgctcttcaacaagatccttaatttcctcctctagaactctgcccttcttaccaaacgtatgatctaactcagctaatttctcctcgatcttcttttcgatagaattcaacttctctatgagcagatcatccttctccttgtcttcattgaattcctcgtcgtcgtcgtcgtcaccagccccttggatcatctgcttctccctgtcaaagccagcattgagcacaagatcctccggagagccgacctgctggtgttggatgaccccgaaattggaggggttgctgggatcgtatgcttccctgcattccatgattctaacagctcggttaagcttctggaggagaagaaagcggtccttgccggtggcatctttgaggcggttcatcatgtcgccgatgactctgtactccagtggaagcttcaaatggcgctcctcgaatctgtcgatcttggtcatccatttgtgggcatcgtcaagggtttctggcaacagcgggaggtgtttgaagtgggcattggcgaaggaaggaaggaaggaaggaagaggggaatgggctttaccggcttcggcgaaggagcgtaggagttcggagtggcggttgcacttgcgctcgaactcgtcgacgcggcgcttgatggcgtcaggggtgtagcgctcgtcctcctcgtcactgtcggagtcggtgggctcccagaaggaatcgtccggcgcggcctcctccttggccctgcggcgctcgagcttctcgatgagcggcttgacgcccaggtagtcctcatcctcaccctcatcctcatcctcctcctggcggtcccgctggcgctctcgctggagctcggcgaagaggtcgtggatgacccgctcgctctggatctgcttgagcctagagctgccggaggaggcgttggcggagaaggcgaagtggcggcgaggggaggcgatccgcagggttagatggtgggtggaggatacgggagggctggggcgcagggagaggaggcgcgcccacgcggcggaggcggcggcgcgggaccgggcggcggcggaggaggccatgaacctcccggcggcggaggaggagaagggttttggtagccaagtgactactggaccttccggactatactgacttgtgtgtcggcctgcccccatctacatttcttagtggcccatctatctatctatctatctatctacgaataagttcatttaaggtcctttaacttgacagcgcgttcgattttatccttgaacaaaaaaaaaatcagatacaacgggtccctcaattatcaaaatcggtacaatataggtcccacgacagtatatcgggtggttttgtccgccgttgcaatctaagtcagcgtgcgcccaacatgtcagggctcccctcacccgttattctctctttctctctaccctttcccccttccttttcctagtctaatactccaataccatcaatgatgaagcagggttaaggatacctgttgggagggtgggggatgaacatcggcattggcacagcccctcttccctatctttcgtttccaacggctgtaggatagaggtagctagcggtggtagaggcgggacacgacgaggtggtagtagtgatagccgatgaggagcaaagggagaccaaggcccgcgacagtggtgtcgacatcttccttgcaactgacattgtcgtcgttggctcgtcttgtcaccatctccctccgacgcaatggtgcaaccccatattcgcatcgccgttacatcagccacacgaaggaggaggatgaagggagctcaccagcgatgaggagcagcgagaatgaggacgggcgaaggaggagctgctggaggcctggagcgaggtgacctagtaggcaagcagtggtggcagcgggcgtcgggacagggcgcaacggtccatggatgtcaattgtcgtcctcctcaccattggtcttctctagtgacgctttcaccacctccaccgatgctaaccctaacgctggtgctgccatccccacctctaccgatgaacatgccaccccctctgcccatcacatgtgagcctaccaccaccacccttgacgtcatagtcggcctcctccagctccaagtccccccaacaactggaccgtgctggccaatgagatgtgaacaaggggaggaagagagagagagaggtgaagagagccctgaatacgggtcccacactaactcacacgctgttgactcaggttaaattgtcacgtcggacaaaaccatcaattatactgtcgtgggatgtatatttgttaacagtgaaatttggtaagcccggagtaatcatcggcttagagtcagcatcgtcttcgaagtcctgagattagccgatgagagttgccaagtcgtcagttgtcgaattcttgctatattcagttaaggaaattgatctactaaaggaagcttatccagaagagaccgagttcaaagagaatacggcacgacaagttatctattaattaggaatagtttattagtttccttttatctttaggaaagtgtgtttagtgttctataaggactttatcttttccttttatctttaggaaagtttctttcttgtccgacaaggatttgtatcaatccatgggtataaatatgtacacccggggtctatgtaatttatcttcacgatcaatacaattcggcgcatcgccaccttttaccttttctactttattttatcgtccggcgggacttggcacctgacgcggggctgcatcggtgttcgatctccagagaaggggtaagtccaatgttccgtcggcccaggcaattgtctcatctacatcggcgtcgttcaaggctgcattagtacattcgacctcttggattgctctggtttggatgatatatttgcttacctatttatcatatgtctctgttaatctagtcttagcatatcaatttagctctatcggctgcttctcgttttagggtttctgccggtatcggctaaatcttcatgctagattagattagcttagacatctaccaccctgaaaattcagtcgacggcttgattgtctagatattgtgtttcttttcatacttagtgctgcatcagttaagtttgatctactaagtcgtgcttagaaccataatctctagcctgcctttgactgccaataagggtttcatcggggtttcagccgatgagttatctaggcgttgcatcgactcataaggattgcatatacatataagttggatttagccgatgacaacaaatgtttcactgtttaatctaatattgtggatttcatgacatcggacctccagccgatgtgtgctttaaccttcggatcaatgcctatttatcatatcattatttaccgattggtttatactagattatattgttattttattacatcatcatcagccgattgcctttatatcatcatctacattggacatatagccgattgcttaaaccctatctctatcggctggtataggcatcggctattatcgtctatcggctggaactactccatcggcttgtcatccgatcgactgttttgatctactatttgcatatcttgtcagttgcaggatcaaactgactggcacgcccgcatctcaccaatctttggacctgcacaagagctaagcagatctcctaggccggtgtgttcgattttttcgtcaacaatattacaccggttatgacggttgagtgatccgttatatctgtttttttttttctgttaaaggatgacatcagactcgttgtcaagttaagggacctataatgaacttatttcatctatgtatcacatatagaatatgattggggtccagcccaagagagtccgacagatagcgaggaggaggaggagattagtgtctacaaaagagaaggaaggaaggagaggcggagaggaaagagaaagaggatcgtctcggctcgtcgtcttctagctagggttcgtaagttctagggtttgcgatgatccccaactcctcctccctctagtatttcgagcgaattctccaacactttcacccaaccgcgcgcgagaggagaaggaagatagatagatagatcgctccgcacatactatggtgctcaccccatcgccgtctacaccgccgatgctccccaagaagctccgcgcgctcggtcaaggcttgaatccctttgctcccttcggcatgggtaactactattcctcctctcgctaatatatttctcctcgctcgatccatcttcccccacctccccccttctcaaacaattaatccccttcccgattcgattcgattcggttcggttcgctttcggactcggtttcaatttcgattctccctccgtcgtcgcggccctattctagccgccccctcccctccgctcgattgcctgcctccggatggtgcaattccgcagctctctcagcatgagccgggcacggacccgccacggcgatggcgacgaccgcggctggaaccagctccacgtcgcctcccgcaagggcgacctcaaccaggtaatcctcacgttgtcatctcttacgttttactaactgctctattataattatattatgcattggcttattttctccacgcagcaccaccaccatcgtaatgcttctttaaagataacgcatactcttctactacatagattataacagtactgaatgattatagaggagggttaacaacaactcataatttgaatcaaacaacaaggaatgtaaccatctctgcaaatagtaataaaggataaatactacgagtagtaaattatcattagtcgccaaataaattagccttcatgtcatcaccattgaaacaataaatttgatttttcttttttttcttcctaaggtgaggcgtctcctggatgatggcatggatgtcaatgcacctgcatgggggccaaaatcacctggcgctacccccctgcatttggctgctcagggtggacatgttaaaatcatggacgagctactggagcggggtgcaaatattgatgctcgcacaaaaggagcttgtggatgtaagctcaaatgtttcttcccagtcattgcatgcattttcatgcttctagagcttgcctattctcttttatttacgattggtctgagagcagtttctatttattattattacatataaagaaggtttcatgcccccccttgttttcagtcctctgttgagcagattacttctatattcactactgctgcttgattgcacaccccatctagtttagtggattgacttgtttttattcaatcattataggagaccatatccttgaatgaaagctactccatgtttcatatactcagaagtttctgatgtcttgctcattagatcgaaacgtacaagtaactttctcatgaatggtgtatgtcttcatttaatacctgcaatgttgtactatgcaaattgcaaataccgtaatgttctggatgaaattatttatttgctcagttttctgttcccaacttctccagtggttttaaatttattaaaacaccttgtacactcaaagaggaggtcactttacctccggaatcttacattttcctcgtttggtggaatcagggacccctctacatattgctgctaaggaaaggaacaaaagagctgtcaggtttctgattgagaatggtgcattcttgccacctgacatgaatgaccacaggttcaatcctcctctccattactgctctggattggaatgggcatatgagatgaagcgcatgcaagacgaaagtgattcgaccggtgaaacttctctgggctcggagagctagaggaaagcaatctcctcagtctggcaaagaggtcaatcttggatcaacagagtttgtaaacatcaagggtcacgtttactttgtgaaattggaacgaattaccatgtgaatcttacatgcgacatggtactagcatgcattgcgatgttgttgtggggttacttgtgttttcgataattgcattgtgttcttactacactggtagcatgtattctactacacattcttaatatcagaatcaatatccggtttgcgtcctatgacagtatgcaatgtgtttcttttttgatgttgttgctcttactaagaaataggatgtgttgacgcttatcaccggaggttctactactttggctgcaaggtcgatggagccacatacgatacgaatttacgctcatcgtcaattcatcatcattaaaaagaaaaaaaatcagcaatagcacagtagcagcaatattcattcatatcaacgggcagcagggtacagtggattaataacgaaacaagtcaagagtcactagtctacatacatgaaaacgctgccccacctatgaaaacttgagccgagctactaaagttcgctgcaatacatcatgcttacgagttaacaccaccggcatgcatccatccattctgcacacaggcaaactaaactggatggaggtacataagcttagctcacatgcactctggctgctgaaccaacgttttggatgatgaacacaaagactccctggacttcctccatatcataacagcatacaatgagctgcccgtaaatctaccgcctcacaggaggtgcaccaccccgtccaactggaccaccaccacgaccagcagcagcctgcatcaattggaggtcaaaagattaaatgttgcgacaaacagagcacacatcaaaaaacagccttgaaggccagttagtacatgtgcataaccttacgctaaatacttaaaggtttgtgtaatttaaatatagatgcttcaaggtgatagatgaagggaaagtattaacagagagaagattaactttgtacttgttaacagttgacataatatttgtcagcttaatttcagaatcacggcataacgcaatttatattgtctttagtaggtttgaaactcaatgcatgaaatcaatggatttgcaagcactgattatataatagtagtagttaagattcaccagcctatatcatttcagaatcactgcacgatgggatactgtccttgttccttaatggagttaaaacagagtgcataaagttaatggtccttgagttgatagcaatatgatggaccatcacatggttgtaaacacattcacaattaaatattctgcattatatgttgggcaaatgttactgaaagaatgaaaagcagagtatggttataggaaaaggtaaatggattcattcagtcatggagtcacccatctagtaggttatatggtctaactgggcactggacagccaaccacgtgagcaaacaggcaattcaccaaaatatagggacacccacttcatgtatatgaggcaagcatgatatagtagaaccattttttggaacactgagacatgagcaattttgaatatggcactagggaattgtggcaaaataagaaaagtaaccacataataccaagcatactaatgactggatagaaacttcctttccttaaaggtaacatgactcctgcctacaatggttatttcttagagcagctgcagattgtcatgcaaaaagatgaggcaaagactccattgatgaattgataggtgtggctcagtttcggtttgcattatggtgctagggcaagatttagttgcacaaacactagctcataactctcctatctgaagatttatctgtctatgtcatggttagccatcagccggcaacgtgattttgaaaaaaaaaagaaaaagaaaaaaaagagagagatgtttttcatcagaacaacaaacaaggaccataacagttttaaatgcaaaggcttaaaattatttgcatgtactacactgaccagcatgagctccctgaaaatagaaatccagtgctatttgctttctctaatcgaattttggccaagcaatactgatgaatcaagcagtaggaggttagatgtgaaatcttcatgttgaaagcaagcagttgattacccaatggttatttctaagaggacctgctgattgtcatgcaaaaagatgaggtaaagaccccattgacaaattgatatgcgtggctcagtttcaatttgccttatggtgctagtgcaagattagttgcacgaaaactaggtccaaactgtcctatctgaagatttatctgtctatgacatggtcagacggcaatatgatgattttgaaaaaggatgattttcatcagaacaaaggatcaggaccattatcaatttttgcatgaactccctgaaaatgccagtgctatttgttttctctaatcgaatttagagcaagcagtagtaatgaatcgaacgctagaaggttagaagtgaaactatcatggagaaagcaagcagagcagatgattacccgagcacgcatagcaacggcacggccacggccaacaccaatagctgagcctttaccctgcaggaggcgagaggcatgtcacaatccaattccaagaggaggaggagaaaagagagtgggtgaaaagaaataccctaatcctagcctcgaggcgcttgaacatgggggcgttcttgagcatgtcgggtatgatcatgaacctgaccctgcttcctctgatgaagacgtgctccagctgggagaccttgccgtcctatacatatatatatgtgcacagaaagaatcaagaatctaagaagaagaggcgcatgattcgaaggaaggaaggaagggtaccttggcggtgaaggtgatgttgtcgagctggcagttccagttgtcctcgcactcgaccatggagccgcggtacacctcgccggtcttgagctccacggtcaccacgtgccccgccgcctcgtgcagcagcttcactgggataccaaggctgcggctcatcttcctcctagggttgggtagagaagggaaaccctagctaggcagacgcgacgacgagttgttgttggtggtggtggtggtctggtggaggaggaagatggcggcggcggcggcggaggggagtcgagtcgagtcgaggagggcagatgagagagatggaggcgagggggcgacttcgatgggcccaagcccaataccatcaatatgaaaggcccaaacttgtctctgccaaaccttcagaatttgggcctaaacacaacagagcttctccacgtttcaataaaaaaaatcgtatttaacgttgtaatatggcttatttatgccttttgttaacaatgtagaatgtattaaataacatacaagattaaacccccttgttaaaaggaatagaaatgacaaatctccgagacttcgtatcttaaagtgtcatataagatatacaagcaaacaagcctagttaactccaaaagcatgtgaaagagtatcggtcaccatatttgttcctcatatatatatactgttgagattatgggcatataatgatttaatttattccataaataagtcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccgggtctacgagcgacggcgcagtacagagtaggaggcaaaccctagattgattttcgcatatattgcgtgaagacggcgggtcggtttatatagagaaaggtcgcttgatcagggcgcccgcacgatctctactgcgcgtaaccgaaccggataagtcgcgcgtaacttatccggactccacgccgtttgcacgcatcggatttttcggaacgtttccaaaacaaaaacgaatccgaatttgcagcaaaacaaaactgcaaaaagaggctgcatctgcgcaagggtgaggagccaatttttcggaccattcgacgcgtacgtcgtgcacgcgcgccgcctgccctgccctgccctgcccaggccaggccaggccaggcgaggcgaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaagacccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatggactgcgaccaacagtcaagctcacaaaggtgagttccttcaagaatgctctgcaggacaacatctttgctaattaaagccaacagaactcattaaggcatagccaacctgccttgcagctcacgagagtatatgcatcttcacttagagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgctataactccggagtttcttaatttcctgacagacttcaatggtcttttcacatgtctagacgatttcatattatccttagaactattcactttgacaattaccgtttgattgtcacagttcataaggatagccggcaccggtttttcaacaacaggcagatccattaatagatcacgcaaccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaagaagatatcaggcctagttgcactagccaggtacatcaacgagccaatgatttgggagtattccagttgattcctagcaattctcttgttcttgcgaagcgacaagctaggatcataaggtgttggagaaggcttactatcaatgtagccaaagcgattcaaaatcttctccacataatgagactgcaagagtgtaatcccattctcacctctaattagcttaatgtttaaaataacatcagctactcccaaatctttcatatcaaaattttgagacaagaatgatttaacctcatttatcacctcaatgtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaattgcacactttgccttcttgaccttcaagtacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctctctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacctctgccttataaattttaaaatagtctagagcctcgtctttcgttttcaacaagtacacatagcaaaatctagtagcatcatcaatcaatgtcatgaaatatcgttttccacccttcgtcaacaccc

SEQ ID NO: 44254 - DNA, 5924 bp, Oryza sativa
tcctgcagcccgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataatgatttaatttattccataaataagtcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaaaggtcgcttgatcagggcgcccgcacgatctctactgcgcgtaaccgaaccggataagtcgcgcgtaacttatccggactccacgccgtttgcacgcatcggatttttcggaacgtttccaaaacaaaaacgaatccgaatttgcagcaaaacaaaactgcaaaaagaggctgcatctgcgcaagggtgaggagccaatttttcggaccattcgacgcgtacgtcgtgcacgcgcgccgcctgccctgccctgcccaggccaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaagacccattcattaattccaacatatacaacaataaactgtgaacaagcctgtcacttgcactctaaagtaggtactgccgatatgataattgataacccgacaactgtaacttcacaattcttcgtcgagaacttctcgaaccaagaagccacccataacgaaatagaaaaagcaaaagactctagacaaatctaactccttaattgttatggaaagacaaaaccctatacaacaatctaaacttctaaagacttttttagaaaagccctttaaatacctaatgtaaaccaatgagaaacgggtcccctttctgctcacctctggtgaatacagtagagatagaggaggaggactgtacattgtaagggcttcgcgaaaagaacgagtggcttatttacactctagacttgtttggctaatgggatggtaaaatgatttcccacccaccaaaagacattttaaatcctaaccattcattctctctttcatttaatcataatccttcatctatttctcaatcccaatcccacccccattttccattatccaaacacacactctggagatgatgcataattttttttcttataatttaacatataaaatggactatgctcatttctttctaatatcaaatccaaataaaaaaaaatgtcttggttcatagttcatataagctgagcagcaaatatctatactttgggaatgttttctctaaagtttgacttttgtcatgtccagaagataaaactacaaagtcgaaatttccttaaaaaaatgccttctttctaatctccactccagataaaaaatatatattggtttgtagttcacatatgtaaaaacaatggagtattgtttatttggacaaataagttttgtacaatttgagaatttcacaaatgttgaaaataaggcgagatgaaaaatacaacctcaaaataaaaaaaaagacacaacaactagagaatagtactgtgttaacttttctgaaaaggctacgagtaaaaaaaatacttcttccatccacaaaagttagacatatttcacatttgagtttttccaaataagttgtttctatttgtagtctttatgcatttaagacttaaataaatagataaattaaatatttgattagaacccaaagagtcatctaataaatactcattggttgcatgcttatattcactccttaattttgtagcatctaagataatttaatttctccttagtcttggtgacaaaagtaatattggtaacttttatgtatagagtgagtgtttgcaaaactagatttataacttccatatagttagactgaatgaattagtgtcgtttctgtctttcatgtaagtataataataaaaaaggaatgtttttcctttcataattaattgcgtgggaaattatttatttagcaaatagagcaaaaggaacaatataatgaaggaaattaagaagagaaggggaaaaagaaattaagagttaaatatataatgaatagtttgtaggtgtggcaattaagcgtgagtttcggtccgccaaccgcgcgctcttggtcgaccacaacgcatgctactctcagcctcagccaaccaattctgcaaaatgcattgatcgatcgatgttctctcctccctagctgcggacggacttggatccatccatctcccattcattcattcattcattcatgtggccatccatccaccatcttgcatgctagctagctaccctgcaggcccataacgacattattcaattcgaattaattccatcatcatataataatatatatgatgctgagctcgtcggcgtcgaggcgggaggtcggcggcggcggcgccgcctccagcaccaagagcggcgagctgtccctgtccaaggtggccagcgtggccatacgggagtcgtcgggctcgggctcgggcgggatttccaagagcagcgaattgctgtcgagggcaggaaccatggcggcggcgagggaggcggcggcggcggcggtacaccacgaaggatggatggtgcgctacggccggaggaagatcggcaggtccttcttccacacccgctacttcgtcctcgacagcaggctcctcgcctactacaagaagaaacccaaagacaacatggtacccgccctaactccatcatcattcattaatcaatcaattattactactcgtactaatttcaaacactcttactatcactgccttgttttaattttccttcccctggcacacgcttgtctggccaattacattgtgtaacaaaaaaactcttttcattctaatatattgatgcgttcgcgaaaaaaaaacactcttactattacacatttgcactactactcatagtaaattcaaacacacacacacacactatatatatatatatatatatatatatatatatatatatatatatttggcaccaaaaattaaatatgcattaattcagtcacatcatctagaatatagtagcctttggatccttcttatgctttgatctcaaccatccatttacatatgcatttacaacccactaaatacatagttattagtataaaattcaatgtgcattaaaccataacatctacaaaactaatagtcattggatctctctctcatatttgatactccctccatccctaaatatttgacgccgttgacttttctttttatacatatctgaccgttcgtcttattcaaaatcttttgtgaaatatgtaaaactctatatatacataaaagtatatttaacaataaattaaatgataggaaaagaattaataattacttaatttttttaaataagacgaacgatcaaacatatttaaaaaagtcaacattgtcaaatatttagatatggagggagtatataactatcccagctgtcatgtaaaattgaaatttataatcaactactattgagcaaatattctctatttacatattataagtacttgatttacatattgctttcttttaattttctataaagtatttttaaatttcctgctgcaatgcgcgggatatgcactagttatatgtaataatgttgtacatgcatatatccatgcaggtgccactaaaatcgctgctgatagacgggaattgcagggtggaggatagaggactcaaaacacatcatggacaagtatccattatttcttctaatttatctcctttccgtaccatccttcttctcatgatatactgtatcaaccagctggcttttacacctgacattgcccccgtccttctcaattgacgatgtatcataatgatccttaattttcagatggtctatgtcctgtgcgtttataataagaaagaaaaggagcatcagatcacggtttgttctaactaaacctgactgcatgttctcgatctctttcattcagcgttatatcagtatatatatgactagatttaattcgcagatgggcgcgtatgatattgaggatgctctggcctggaaaaagaatatagaactcattatcgatcaggtgcagtaatttttcttcatcttacagttttgactttgcatatgtaaacacaacaagtaattttggagtactggataattctcaaatttcaatgaaaatccattttca

SEQ ID NO: 44255 - DNA, 7487 bp, Oryza sativa
aatggactttgatacggaactaggagggcagtttatattctcagaccatgacagcgcgtaagtgacatcccatcttctctcttagattatcttacaaacgacaaccaaacaagatctgaaataagctgaaatataatttcactacgaatatatgcagagctgaagatgaagaggaacgacctatgttgattcgcaggacaactatagggaatggtaacaagttatctgcaagttttgttcttaatttccgtttgtggatcgatatgctacagaaattcaccacctcatttctggtgtgctaggtccccctgaatcaatacatgactggaccaaagagcatgatatcggtccacccaatcagattgaccccattcaagttagctccaagaagaattggcgcctacttagatgccaaaatggcaagcacacaagactcctcctcctcctccttaggttatcagtcaatacttgtctacttgttgcttacttccttgtcattcgcaggactacgcatctttgaagaacttctggaattcgattatcttgtatgtccagtctactcactctcgactactgctagacagttaattgattagatactatgcatcttctgaaattcttgatgatttttcacttgtcctgtgtaggcaagaagctgtagcagagctatgcgagctgttggtgttgtggaagccacatgcgaagccatttttgggctggtgatgagcatggatgtaacaagatatgagtaagcatatttactactatcacctatatatattcctactacagttacatattaatcttgagattacgtactgatgtttaattattgatcatcacgtataggtgggactgcagctttcgctatggtagtttagttgaagaggttgacggccacaccgctatactgtatcataagttgcagttgcactggtgcccaatgtaactagtcttctttcttgtccgtagcattttcaaacatcctcctcctcttcttcttcttcttttttttggagaaatttcctcttatttttgagtgcacaactaaatggtagtactaatatttcggattatctatcagattgaaacttacacattcttccattctacatgaacatgcaggttagtatggcctcgagacctatgttatgttcgctattggcggcgtaatgacgatggaagttacggtaaaaatattcaaatcttttccatggaatttgctgttttgtagagcaattaatttctgattgtttgtttggacgcagttgtgctgtttcgatctacagagcatccaaactgtggacgtcaaaaaggatatgtgagggcttttattgaaagtaagcttctctctgagcatctgaaatcctgcattaatttacctgctgagatcgatcaggacaggaggaggagagacagtatactagttccatagaaaacagacagaaataaatgtcaaatgaagttccttttcttttctgaaattcctactagttcaggtggaggtttcaagatttctcctctcaagtgtcgcaacggaagaccccgcactcaagttcaacacctaatgcagattgatctcaggggatggctcctcaactactctccttcctttcagtatcattctttgctgcagatacaaaactgtgtagccggtactaactactgccactgctcgaaacttagtttgctcaaatgaattagtgccatcatcttactacttcactgttatcctaattaactctacttacttcaaggcctacgagaatacttctcccaaacagacgaaacacatataactccaaggattcctgtgatggaaaacatggttgacacatctgcagtacagaaagatgacaagaagagtaccgaagaagtagactccaagactaaaacaccagatcgaggacaagcggacagtaaaaacatgggaatcattgatgaagaaacagacgaggatgaggactatcaggttcctgaagctaacatagaggtgcttcatggccaatatataacattacatatgaacagtgaatgagttttttgtgtttcctcattctaactaaactgtgatcaaaattaattaatgtgcaggaagatcctaacaaagatgctaagcgtgcaggtatgattcctttttttttctgcaatttattttggtattaatctggtaagttccataggcaatcatatattcttcccctgtaacaatgacacggtttgccttgtgattatggcagacgaaccaccagaaaagattgatctatcatgcttttcgggcattcttcgttgcgatgcggatgagaaaagccgaaactgttggacagtacctgacagcaagctgtttaaagtccgtagcaagaacttcccgcatgataaatcaaaggtccaagcttttattgcttaatttgtttctttggaattgaatccagtgagtgagattatatgaagaagctgagcacactgctcacattgaaattacagatacctgcagcgagttacctgatggagcttgcggccattgactggtttaaggacagcaagcgtatggataacgtaggcaggcagaaaggctgtgtagcccaggtaaacataataaatcttgtgatcgatgatggcttatcctatctgaagttatcaagtagtatcatcacagaacttggcggcttggtcgatgtttgttttgtaggtagctgctgagaaagggatgcatacatttgttgccaacatacaggtaagtatgtttgcagattcagagctagctagctagctaggaggaaacattggcaatcaaagttatagttatgggtgtgtatatatatattgtgttgtagatccctggatcaactcattacagcttggtgatgtacttcgtgacaaagtcgctgaagaagggatcactgctgcagcgattcttcgatggggatgatgagttccgcaatagcaggctgaagctgataccctctgtacccaaggtaggtagtccagctgttggtctcaggtagtgaactgaactgaactgttggtctcaggtggtggggtggggtgtgcccgcagggatcatggatagtgcggcagagtgtagggagcacgccgtgcttgctggggaaggcggtggattgcagctacgtgcgtggagccggatacctggaggtggacgtcgacattgggtcgtcggcggtggccaacggggtgctgggtttggtgtttggtgtggtgacgacgctggtggtggacatggcgttcctaatacaggccaacacctacgaggagctccccgagcaggtcatcggcgccgcccgtctcgctcacgtcgaacccgccgccgctatcgtcccccaggaccttactccccctcctcctgcccttgccgacgacgacaacgccgctgcttcttcctccgaggatgatcatttgtccaagaaaaccaactaagctagcacctctctcaacgcacgcactgcaacttatcaatcatttatcttcttgtaatttctaattatttccgaggctcatagcaagctttgttttttttcttttcatctttttttttatctcgttaagttgtttgcaaagtacagctggttttcttctacgtaggaacaaagataaatctagctagtgacagtatttcgttggaacctaatattatagactgagatattttgtttaggcttagatttgctgtctttggctttaagtcagacttttaattaacttacactccctccatttttttaattgacgacgccattgacttttgaacacatgtttgaccattcgctttatttaaaaattttatacaaactatagaaaagcccgtgcgttgcaatgggtgataactattttaatcttattattgttatatggtttagttacgatgaaattcactgtgagaattcgcttggatttatatctctactgttttaaaattctgtagtggtgacggtgactccaaccctgacagacacgcgacttattaaccgtgggattggcagatcggacggtgctgaggatcccatcgcacgcgctcgctatccaaccgtcgacgccgctcccctcatccttcgccgcgcccccaccacgccttcaccgaccgccactcctgctcgcccgaatcgacgccgccgccgtcgcgggtcgacatcgccgctcctcctatcgcgctcctccccgccggcactgcctccatccatccgccgcgtctcgccgccggtcgcaccaccgatccattcctcctccgccgcctgctctcccggtccctcccgccccatcgccccaacacccccccccccccccggcaccgcctccatccatccgccgcgtctcgccgccggccgcacccccgcttccatccatccactgcagatcgccatcgcacgcctccgcctctcaaggtcgcacgctcatcgccgccgctcgtcgcccgacaccccgccgattggggaccggacgctgaccctgcatcgacgccacaacagccgacagatgggagatgttgaagacctcactccaacgacggctgcgcgcggtgacactaccaggcgttgagggagagaatgcagtgcgaggtgcgacggggttgttcgtccttgcccagatcaacgccgccgccgatccctcactcgcccctcgcccaggtcggtgccaagggcgaggttcgccaatctgcttcccagccgcctcgcccgctccatgggagaggtgacacctgtgcccgcctccagcgctccatgcccccggataccatccgagcacgatccctccggcagaacttctgccggagaagggacgcatggttaattggttcgttctctttacgttgcaatccattcatttgtcaagaatcatcattgtgagtgccgagggttattacagattacaggatcactaatgctcttttttgcccaaaaggtgttcaacgaaatgctgcttagccaatgtattaccagaaattgatttctctgtaagtgagaatgtcatattgccatgtcccctatgttgttatttatactaatgattgcaggattctctctgttgttatttatgctaatgtaatgaaatatccaattactatgtatagactctagagctatgaactgctgggaagttgagagtgttgctaccaagcagaaagattcaaattatatgttggagcaaactaatttggatcttgcagtctcaaaactaatctggtccttgattgtttcagagcggacgaaaataaaaaatggaacgatgcagtgaagattatgtaagcaatgttcgtgatatatcgatcctgaaattctcatagatggccattgcacaaatacaaaaatttgcaggttattaatagtgaactacatctctgtaaatctgcataacatatgttaaagctagcccaagaattaatatgttgtaaatctgctctacagttgacactgcttacattttctactattaataaccctcagttgtgatagatctgataccttcttaaaaatttgaactgagttttcatacctagcagtaggactaacattttatggttgtattgttcagctcaagatgaacaaccacaccaaccccaagatcaccaactaagcctatcctgcttcatgattgttgttgcaaactccaacatgcttgctgctggtgcaatctgagccggctggtggcagatgggagcctgccctatgttgttagcagcttttttcactccaagtcatgcttgctgcctgtggtcttggtagtttcttttttgtgttgtcaatttaattattaggatttcccatgtgctcggctattggtgttcttgtatctgttttgtttcagggtgtcattactatggagtagatcataatttttttcttatttttttccaatgccttgtaaaataaccaactagcagggatgttcataaatttcccccttttgtttggtttttttcagacatatatataatgaaggcatatatacacaaaaggaggagctgtttgagggtctaaaggacaatagctcaattgactgggaagttgttgtcatatgtcgagagcaatctgctaaatgttaaagaggtgcatctaacttttgtacccagtgaactgcaaatctgcaccttctcttttgattaatagtttctttggattcagatcaaaatagctcaacatgggaatttttctagcagaggatgggcaattcttggaaaatactatatatttcttgtcgttgaatgtgatcatgtcccattattctggcacttgctgccttgattttgttgcctgtgccagccctttagctagctctctatcacacacgaatgcgtgacccttgatggttgtatgcagttgggatattttggtgagttcatcccccttccccaccccaccctctctctctctctctctaaaccatcatttatcttcactattgacttacaatttcacttctagctgatgatgatcaatcaaagctagctcatacgtattagtgagtttatgaaaaaaaaaaggatcagatattcaataacagagttagctccttcagaacgatggcaaaatggtacctttataattttacttctcaacacgcacacatttttttatgacgagtttgaacttttgttctccttgtcagattttatctgaagcaagtatcatatacttctgtattagaatatggacgcaatcatatatctcctaaggtttagtacatactctcatatttggaagtgaataccaaacgtgtctgaaatagtgcatgcgatttaatctattctctcttaggcatttattcgcaaatgcaaagatttctgtaatttggtcgtagcttagattatggcaaccttggctttgtggtttgccatgtcatgtactgatatatgaatgtgatgctttaattaacgttgaaaagccatgaattatgtattcgaacaaattgattggatgtgtcctgaaatcggttcagactttcgttctttggttactggcgtgagacgtgggagaaagacgctgaagacatcaagcataacatggagttgataaaacatcgtcgactgaatcatggaccttgtcctggatgtagtttctttggctgctggtttattacactatagtaaaactaaggaccttgtaataggctctttgtgctggtctgacgtgaagtgaaaaccttcttaatgtaacttcgctaaaattagcgttttgtctgtttaagcagtatttatggtataaagaattgcatattgcattatattgtgacaaagagtattttctgaaattttgacaatttgaccattttgaaatttttatttgaagaatagatcgtgctaaaatcttattgcaaaaatggaccgaaacttattgcaataagtttagcgtggtctattctttaaaagaattgcgtattatattatattttgacaaagagcttctgtactcagctcattaaacctgcctgcttgaactatctgatacttaagttttaattaatgtcttgaatctata

SEQ ID NO: 44256 - DNA, 1092 bp, Oryza sativa
agagagagaataacttattgatgagcactgatgaggactcaaatttgacactctcaccctttcatacaaaactaatttcacatttgacgaaaactaaccctcacctcattaccaggatccttcgtcccaaaacaaactaatgtaatacgggatgtgacacattctagattcgtaatattagaatatgtcacgtcacgtactaagtagatttatttattttaggatgaaggaaatgcgtgtttataagtttttgatgggcctatatctaacaaaaagaatatcaagagattcagcgactctgccagatttgtgttcgagccctcgtcccctttcttcttcattcgtttttttatctcctgggaggaggatacacagcactacgttcactttcttatgttttaggcctattaattaaaatattaagattaaattgcaccttggacgagctattattatcaagttttatcctaaaccaatctacacttaatgtttccttttttttaccatgattctattgcttactgggctacccttctcttcacccatctgttgaccaaaactcaccacacacacgaaggcctgagatgtctgcttagatttagtgcaagtcctatcaaatcgggtttaggacatgctagttaatttgatcctataactaataagatagaaaaaaaaaagattagatcgtggggccaattgaccatagggccaatatattatcgtaagcccaaccgatgccgatggaatttcggatcgatcgctataacaacattgaccgaaacttagatataatatatttgtaaatcatctaactttattatagccaatcttaatagaccggaccaaaccgacacaatataagattgaaagtaacaaaattgaatctaaaaaatatatatatcttcgagatgcatgccgatgtgccaataatcaattaagacttatcattgctctatctgaagaaaataaactaacatcggatatgacaacttaaaatataatcaccaacaatttagggttattaaccaaaatctagatagatcgtacccaactgtgacaatataagattgaagataataaaacatcagctag

SEQ ID NO: 44257 - DNA, 937 bp, Oryza sativa
ggtccaaaaactgcaaagtgctttgtgttcattggagcgcttccctgttgtgctcagccagtccagcagaataggtattggaggctcccgtttgacttcaggtttgagtgctctagctcagcccttcaagttgcgcctttgtcgaggtcagggtgaaaaatcacttcgggattattcgtcaaatattgtgcttattgatccctttgcgagtctagcagctgttgaagagtttctttggcccagagttcagcgtagtgaggctgcttcgaagcctacagttccatcaggaaataattctgaatctggcatacctggcaccgcagctggtgcgtcatccacagctgcaccagctccatctggcaggcgtccaacaacaagatcaaaatcatctgctgcaagtagtggtgcatctaagaaggattctcaggaggaaagcacaaacactgccaagggaaaggggaaggctgttgcaaaaccaaactcagaagaaccaaaaggacctaatacacggaatgctactcgcagaaaagctgcttcagagaaagatctggaaatgaagcgagcacatggtgacagcagctctgaggtatttctttcatttctctgaatgaacatgaaaaattctaatagagattacgaatgcagttgtcagttttatttagctctatacaagattctagtgcatgttaattctatgttgagaggcatatagacataataattgtccaacaagtattaaattaaagataatgtacaatctcctttttgtataccaagatttgacctcagcgccttataaactacttcctccgtttcacaatgtaagactttctagcattgcccacattcatatagatgttaataaatctagacatatctatatgaatgtgaacaatgctagaaagtcttacaatatgaaacggagggagtacatttt

SEQ ID NO: 44258 - DNA, 1950 bp, Oryza sativa
ttctctccttgatagcatcttacaggcagaactcccatgtgatctagagagaacaaactcaacttacaacattttagcactattgcgtgtattagaggggctcaatcagttgtcccctcgtttaagagtacatgctgcttctgatgattttgctgagggaaaaatcaccacactggatgagctatatagaactggagccaaggtaccgtcagaagagtttgttaatagtaagttgacaccaaagcttgctcggcaaatgcaggatgttcttgccctctgtagtggcagtttaccttcttggtgttaccagatgaccaaagcctgccctttcttgtttccctttgaaacaaggagacagtacttttactccacagcatttgggttgtcccgtgctttgaatcgacttcagcaacaacggggtgacaaccaaaatgctggtggcgaaagggagatccgatttggaaggctacaacgtcaaaaagttcgtgtttcccgtaaccgtattctggattctgctgctaaagttatggagatgttctccagtcagagagctgttcttgaggtagaatactttggtgaagttggaacagggcttgggcccactttggagttctatactctcttaagccatgaactccagagtgttcgccttggattatggagatctagttctccatctgatacgggaatgcaaattgataggagcgcaagtcccgacgatgacttggcagccaaagaactcagctcagatttacctgacaatggcagccacttgatacaagctccctttggattgtttcctcggccttggccacttaccgttgatgcttcagaaggcagtagattttctaaggtcatcgaacatttccgcttggttgggcgagtgatggcaaaagttttgcaagatggaagacttttagatttgcctctatcaacagcactttataagcttatacttggacaagtaagtgatatactcttactggattaatatcagtttttccttttgttacatttgttttattgaagttagtctgaacaaatgaactgtatgtgccaggagctggacttatttgacataatctcatttgatgctgaattcggaaagacattgcaagaactgcaaattcttgttgaacggaagaggttccttgaatccacttatggcatgaatcagctagaagtcacggacttgcgtttccgtggcactcctatcgaagatttgtgtttagattttactcttccaggttatcctgattatattcttaaagaaggcgaggaaaacacaattgtaagtgatgaaacccatcttagttttgtgtttgtcccagtgactagtgtctgcatttgctcctttttgtggtaataaatagtattactctgttttgcaggtaaatatttacaacttggaagagtatgttactttggtagtggatgctacagttaaatcagggataatgaggcaagtcgaagcatttagatcaggatttaaccaggtgcaacgtcattttctctctcttgtaatcattttattagctgtttttttttgtttactgtaattgttcatgtttacctttctgttttaggtctttgacatctcatccctgaaaatattttcacctgaagagcttgactatctaatatgtggtcgccgagaaatttgggaggtaatgctctctctctctctctcacacacacacacacacacacgcacacagttttagtttgttacatttcactgaataaacctgtgctgcagcctgattcattggtggataatataaaatttgatcatgggtatactgctaaaagtcctgcaattgtaaatgtaagtgcgctatatgcatttcaatatctgaattggccttctgtaagtttagttacttaattgctctacatgtttgtagctactcgagatcatggctgaattcaccccagagcaacaacatg

SEQ ID NO: 44259 - DNA, 13018 bp, Oryza sativa
gtaaaacctcatggaaactttcctttaaatctttctctcttctgtaattcttgtatttttttatacggtcgaaacaaacggtcgttcctatgtttcgtaatcctacgatttaaagaggtcctaaaaagaaagttatctaaaaaaaaggttaaaaagcaagtcatgttggtgtgtgtgagagagagagagaagccaaccaaatgtaagcccaccatccagatagagggaagaccaaccaaagagaataataataaataaataaatagtctcggtccaccgtcgtcgtcgtctagggtttcctcctccttcccagcggagatcaagaatcagaagcaacagctatggcggcggcggcggagggtgaaaagaagatgataacgctgaagagctcggatggagaggaattcgaggtggaggcggtgggcatggagtctcagaccatccggcacatgatcgaggataaatgcgccgacaatgggatccccctccccaacgtgaattccaagatcctctccaaggttatcgagtactgcaacaagcacgttcacgcctccgccgacgactcaacctcctccgctgacctcaagaactggacgccgacttcgtcaaggtcgaccaggccaccctcttcgacctcatcttggtaacccattccctctccactccccgctctcctctcctctcctctccgattattttttttatttacatacagcgcagagttcgtccagatctatctaggttgcactcttctccctaccctaggtcttggctttaccaatatactccagtagtagtatatttctatattggtactactccactacgtcttaaataagtaactactccctccgtcccaaaataagtgcagccatggttttccgcgccgaactttgactgttcgtcttatttgatttttttttaaaaaaattaaaaacataagtcacgagtaaagtactattcatgttttatcatctcatagcaataaaaatgctaattataaaaaaaatttaaataaaacggacgaccaaagttgggcgtggaaactcatgactgtgcttattttgggacggaggtagtagatgatttattatgcctatgtgaatctggttgcgtgttgttagcacagcttatctgatgattattgcgtgtccttgttttatctcccaaatcaaacccattgtgtacaactctaggggctgccatgctttttatttccatttatttcaactagtgctcttcttttcttgtgcttggggacaatgttgatgggtggtgggtttattactcttctaccagtaacgctgtcagtttgtgtcaattgatactgtcttcacttttaacatccataaatgcattggcttgctaagccttaggttgtgtttagttccttccaaagttggaagtttaggttaaaattggtacgatgtgactgaaaagttgtgtgtatgacaggttgatgtgatgaaaaaagttggaagttcggatctactgtctttgtggctcaaatctattgtatgcttccttgtctccccccctcccaaaatggacccttctaggttttcctaatgcattatatgtttttgttactgttgcaacatacttggcagtacaattgatgctcggacttatatttattgtgctagcctttaaatttataatcatggtaccctttttaaacatgtggatatattgatgttcaattcatttaggcaatgtggttaagtgatccttctgtcattaattgtctacttgtctgttgtgacagcttagtgcttttttagaaaccaacaattaactgtgactagtgggctaacgttacctaataattggttccatacttgttactttcctcttacctcctaattacctgtattttctctagggatagtgcacatgtatccatgtttaattggaggatttgctgctctttaaaaggacaatagatgtttgatagtatttaactaccaagtcccttgacatgttagtggcttcctgtattagtctgtctcaatggattttccacatatatacataataaatagtggaaaaatatgttgcccttgaagaagcaaagagctgtttggtatgtaattgtgaagcatgtgttgataaaatgtttagttttattgttgttaacctgagatatatagatctgacttgtgaagtacttgcctaacacacggatgaattggtccacctgatttgctctttggaaacataatgtatgcctgcttacctgcctttgttattctgttccagttttaactcaagtgtgcctagatgtgttgattattttctgtatgtagaaaggaagaaagaaattgattgtccacctcttgcaggctgcaaactatctcaacatcaagggatgggattgctggatctgagttgcgcagaccgttgcagacatgatcaagggcaagactccggaggaaatccgcaagaccttcaacatcaagaaggacttggcccctgaggaggaagaggagatccgcagggagaaccagtgggcgtttgagtagagatgcagcagctgctacatgtggccggtcggttgcaatggttgtaattattttggagtgagaatgaatggtggggtggggggggggggtgtggttagtgaaggaaggatgaaatgaaatgggggttaggttaactagctggtttatgaagtatgggtatggaagggaaaacaaaaactgaagattgttactataaggatgttatgtgcggctgcctagactgcagttgatatcgtctggtggatggatgatttattactgggattataaagtcatctgattgtcgtccattgtctcagtgtctgtctgtctatctatctaatctgtgccgcagtagtgttggaggaagtgccaggtggtgaggcagcagcgagtccaggccaagccttggcctggaggaaagaaagaaagaaagatgataaggcggctgggtgtgtctggtctctcctggtgttggttgccacacgtatatttgggccccttatccatccatgattttgttttgttttgcgaataattttggcgcctcaagttagccgataaagttgggagtagtacactagtagtatactagtagtagagtgagctcaagacaagaagcagtagcgagtccaaggcaaggcaaggcaggcgaaagcaaaacaagaaatggcgaagccgatatcgatcgaggtgtggaatccgagcggaaagtatcgcgtggtgagcaccaagtccatgcccggcacccgctggatccgcctcctcgccgacaacgactgccgcctcgaggtaatcctttcctttccttcttaggcagcgattacttattgcattacaattacactagtagtggagagtcaattcattccttgcttcagatctgcacggagacgaagaccatcctctctgtcgacgacatcctcgccctcattggcgatcgctgcgatggtgtcatcggccaggcaagcaaagcaattgcaatccaataattttgattgatttcttcttgttgataacaaattaagtgcagctgacggaggagtggggagaggtgctgttctcggcgctgaagcgcgccggcggaacagccttcagcaacatggccgtcgggtacaacaacgtcgacgtggaggccgccaataggaacggcatcgccgtcggcaacacgcctgtcagttctgccgccctctgcttcttgatttctagactatcttactggatggtaatttacttacatacgtacacatgtacagggcgttctgacggagacgacggcggagctggccgcgtctctgtcgctggcggcggcgcggaggatcgtggaggcagatcagttcatgagggctggcctctacgacggatggctcccgcacctgtctctctctctctctctctctctttacttttactactgctgctagttgatagatactcatatatgtatatatgtatatatgtgcatgcaggttcgtggggaacttgctcaagggtcagactgtgggagtcatcggagctggtcgaatcggctcagcttacgcaagaatgatggttagttcagttggtaccttactagctaggactattattattatagtaggagtaattatttgttcaatttcgcaattgcaccacaaaattactcatgtaaacatttccttttaccacagatcgagggcttcaagatgaacttgatctactacgacctgtatcagtccacgcgccttgagaaattcgtcacaggtatgcatccaattttatagtactggctagttaatttgtactccctccgttctaaattgatctacatatttcataggtacaccaagatcaataaaaactaataactctctcatactatatttactctagcaacaaattcaatgcatgcaccatccctaatattttctagccaatagcaaatcaaaatattgcatgtgggttataaatacttgtgtgcatggatgcatgcatcaatgtccatttactccaatgcacaaataacgaatagactctaataaatgaacacaaatgtgtagatcatttagaaataatctaaaaaactatatgtagatcaatttggaatggagggagtacgacattaagatagatagattagattagattaattaatgacctgcacattgatttgaatgcatatgcatgtagcttacgggcagttcctgaaagcaaacggagagcagcctgtgacatggaagagagccgccaccatggaggatgtcctcagggaggccgacgtggtcagccatctctctcatcgtctcttctttctttcttcattctaattattaagatgttgattaattatgcaaataaatgcttgtgcatatatatatatatgtatgtggcagattagtctgcaccctgtgttggacaagaccacttaccatctgataaacccggaaaggctggccatcatgaagaaggtgcctgcctctctgcctctgttaatttcttctctcggtcctcttgatactgtagtactatgcagtgggtaattaacagagcatgtatacaaataatctaaatataaaaatacaggaagcggttcttgtgaatgcaagtcgaggaccggtgattgatgaggtagcactggtggagcacctcaaggccaaccccatgttccgcgtcggtcttgatgtgtttgaggatgagccttacatgaagcccggcctcgctgacatgaagaatgccgtcgtcgtacctcacatcgcatctgcctccaaggtccactacctgcctgctgcatctgcttatatatatatatatgcctagctagcttgttttattttctttctttctttctttcttcccataaaaatatccatccatctttacgtactactactcctacaactactagtaatatgaatcaaaaaggtactgactaatatagtatataatttgcatcattctccaattctccagtggacgcgcgaaggaatggcaacacttgctgctctaaacgttcttgtaagtactccttccatatgcatgcttaattagcctcagcccaaatattatactattgatgatgaatggaacacacactgtgtgagtgggtctgtctgtctgtgcatgtttgtatttgcactagatcgattatataaacctgctgatacggtaataataataataatgcagggcaagatcaagggttatccggtttgggggaacccgaatctagtggagccatttctcaaggaggatgcaacgccgccagctgcttgccccagcattgttaatgccaaacaactcggtcggtactactacgtaccgttagttaattcctattcattgcctagttaaaattaactttaactgcatgcgaatatatatgcgatgcaggcctgccatcgtcaaagctctaagaactggagctcggtccatcatattatatctgtcggttcaagatcatactccactacatgaagtctagatcgaggtgcatatgcttgctgttctagcggagcgggcaacaagctgtcagccagacttttgatatctaatttcacacacacacacacacacacacacacacatatatatatatatatataatatactagctagcttcaattccttgttattataccactagtacgactgtaattttgtgagtcttaaaacatgcgagctacatgtatgttattacacccgtactagctactactgtagattaattactgttacgaaatgaagataccctagctgcctgtttgggaaacgtacgattaatcatcaatgacaaagatttacagggctctagctagctagcactagcagcctgcggagagagagaggaattaattgatattagtaataactagcacatacatatgcatccttgcgtatagtaagtggagtaagtttataagggaagaaataattaagggaaaacctggcttagctgaagaagagcaagcaatactattatattatataatccaataaaagttgaaacaaaaaagagggagcaaattaaagcaaaagctagatatatataatataataatgatggacagagatatatagttagtcgaggaggagtttcttgacgtaattatcgtagacgaagtcggtgaggatgctgtaagctttctcggtggggtggtagctgtcccagaagagatagtcggagacgggggtgcagacggaggaggtgagggcgttgcagaggacggaaacctccaggaggccagtgccgcagcaacccatggtggagtcgctgaagccgtacgcccgtggacgcatcatcatgtccatcaggaagccgtagatgtccatgaaaacaagcttggtcttggtgctcttcttcttggcctgcatctcctccatcctcctcttcatcccggcgttgtacgccaccgcgatctggttgtgcccctccgagcagcgcctctccatgccccccgacatggtcctctgcgacggcacgcacccgatgggcggcatcccgatgatggccaccttcctcgccccggccttcaccagctcgtccacgaacgccgccgcgtggtgcaccagcagcgccgcgtacgaggcgtggtcgtagccgggcctcgcccgcatggtgaagtaggtgttggccacgtcgtcgctgccggcgcagatggcgaagatgcccctggtcatcatgtccgccacccgcgcgtccccggcggcgccgcgcacccgctccttgtactgctggaacagcagcagctggtcgggcatggagatgacggaggccaggcgaggcgtcagcgggtcgaagccggtgccccccgacgcgaagctgacgccggtgaggagctcctcagtcgacagctccggcgacaggtacggcgggagaagctccttcagaccaagacgggaagctgcatatgcattccgatcgatccgttgttagttgttgttgtgcatgcatgtactcctatgagaaatgagaattgacaagagaaagaaaagcatgttgctagttaccgatgaagtcggttggtatgcgtccgttgcagaatctgccggtgggggtgtggttgtggaagtcatggccgtagggagggaagttggccttgatgatggtgttgatgccgttgttgttccccgggtccacgatcgagtccccaaacacgatcagcgccggcgatgacgctgcctgcaccaccaccaccggcaccgccgcccacaacaccatcaccaccaatgccgccgccgcgctactgcctcctcccattctcattctatctctacacgctctacgtactgccagcgaattgaatctaagcacagcaccgcgcactctcagtaaaattaaagtagcaccaggcagctagctatgtttgtctagtatttatagacgaccaaattcaagcatgatttatcgttggcgtgcactgcacttaacaccgccgctcgcaacatatattttcaatttgcatcaacctagctactattattacgtaccccgtactagatagagttggcaacctacgtacgtactgtaccagtacaacccatactagatactccatccgtttcaaaatatttgacaccgttaactttttagcacatgtttgaccgttcgtcttattcaaaaaatttgtgaaatatgtaaaactatatatgtacatgaaagtatattttacaatgaatcaaatgatataaaaagaataaataattacttaaatttttttaataagacgaatggtcaaatacgtactaaaaagttaacggcgtcaaacattttgaaacgaagagagtatatagtactatgatcactaggagttgttttcttgcacatcatctaaatagttattattttttatatacacgacttcagatataattgtaaacgtgcgttgactagtttcagttgaccattcgttggcaccgcaacattacgcactgactttctagccttggaatcgaacacggcttgcatatatagataccggccggtgattagctcaaaccaaccaggcaacagaaagtcaatatttaggaaaacatataatataacactatacgagattatgtttaaaacgtcaataattttaaactggagggaggattactgacagaatatcacaaattgctactacgattaacgagctaattagtggatacttagtacccctggtatctagattcgacaacacatagtagcggatagggaatgaattctaatgagaatgttctgttatgtatttttttaaaaaaaactcaataataatacaaatagttgttaaaagttccaaaaaaataatgtagagtacggtgacatctatcagtaaaaaaaaaattagtccaatctacacatctctactattataaaaattgaagatgtttttttgccgatactttggtacgtcacctatgtatgagtcggttttttacgttcgttcacttttggaaatacaaatctgtatgtgagtcggtttttaaattcgttcgcttttggaaatatagaagaaatcgtataagaaataatgatcgggctcctaattgcagcttataattttctaacaatatatatattcaagtgaatttcaccttaactaacccatataacaataataaataaaatagctttcaccagttgcaactcacgggtatttataaaaattgaagatgtttttgccggtagtttggtacgtcatccatgtatgagtcagtttttaagttcgttcgcttttggaaatacaaaatgaattgtatatgaaatctgtttaaaaaaattggcatgctcacttgagacgatcggactcctaattatagctcatgattttctaataaaatatatatccgagcaaatttaacagtgaatttcatcttaaataaaccatataacaataataagattaaaatagccttcacccgttgcaacacacgggcattttttctagttgaaataaaaattcagatacgaacaatacgctattattcatacatttcgatgtgtgagttgactttggatctaagattttataatgtggtatacgtgtgtatgtcatggagtgttatcaagtgttatgagattttttttccataactatttaaataaattttaaacaaacaaggagacatcctctcctggataaaaatagttgccctagtacatactacttgatggatagaaacctgcaaataaacagtgcacatgggcgagtaaatggctgcctgtctgcctttgatccagtaccgcattcaattcaatcgtctgctctcctcttctcccattggcattcaattcatcttcactagtgggtgggtatgtgtgtgttgggggcagtacaatttcttttggaccaggccagcatgagcatgcagcatcgaagagcaagtttaaatagtatagctaactatgcgctccaattcttctatagccaatttaatagctcatttatacaataagaatactatactactaatatatggtcctacctttcatacacacacaatgtattagagtctgtgctacagctgactataaatctgtagctcgctttacttctctcttcttttctctcctccacatgtgtatacagctgacttgtagcctgctactgtactcgctctaaagtaaactgtgactgagccagtatgccattgatagatctgccatagatttgcatgcatatttgagcaaatactcgtagaaatcactgggtctgggtgactgggcctgtgggctcccacaccagctatccaagcattccaagtactagtgttactgtactactcctacatactacgccagcgtccggacggacagtatagctgtgtttagatggaggaaaaggtgaaaaattaggagaaagttaatagtttagagaaaaagttgttagtttatatgtgtagaaaagttttcgatgtgatgtgatatgataaaaagttgagaatacgtaccaactcgatcgatcaatcgatagacgtgtattaagtactacgaacaatacgtacctccaacacagggtgggtctgcataaagtactacgtacctctccatcacattttagtgtaactttggatttctgtgttcaatatttgaccatttatcttatttaaaaattaataatttttttaaaataataatcacacataaaatagtattcatgtttttatcatctaataataaaaaaatagtaatcatagaacttttttaaataagacgaacgattaaatatttgacataaacaatgtaaaaccatgatgtttctgctacggagatagtagtactacggtatgcattgacacacagaccccatcgaccaccacgaatggtattgatagtagatgcaccaatgtagcaaacacggcagctaattcaccttgggatactgtcctggtgattggagtagtcgttggtttgacccatcgttgctgcatatgcctgcgtaattgggtccacaacaactgctcgcttctacgtacttctacgtactccctctgtcaaaaaaaaaaaatttaaagggttttagatagatgtgatatatcatatactcccttcgtctcataaaaagtcaacctaatatttgatgagatgttttttagtccaatgaatattctgaatatgagtctgtctagattcgttagactagaaaacatcacatccaatactaggttggctttttatgggatggagggagtacgtttatcgaaatttattgtactaagatatgtcacatccacctaaaatctcttatatcataggacggagggagtagtagggcctgctgctgtgatattcagcttagtggccgagggatctagttggtagagaagatgaacaggagagacagaaaaaaaggaagaaggataatttggtgtaaaaattctagaaattatattgaagaggtaagtagtggcatatttcaaataacagtaaaattgtaatggtattacttcagataaatgaatagtaatgatatattttaaaaccgtaaaagttacactgacatactccctccgtaaaaaaaaagccaatcctaacatcccaagacaaaaataatggagatgaagaatgactaaaatgtcaggtaaatggtattgaagtgataaaatttaaactctagaagttaaagtttttggatggagggaggagatctaattaagcctataatatactggtcattgttgttaatcttccgaccataataacaatataaaaggtcgttccagctagctagccagccagcgatcagtcagatcgactccagagcagagccattggacgatatcgatggacctgacctgcaggctgcagcatctgcgtgcatgtgttgcatctatctacatctgcacgcatcacataaattgatcataaattccatctatggaccttaattgctttcaccctcaccaagcttctgtatgatatgactactgagctatactccctccgtaagggcatctccaactggatggccaaatagctattcaagtcaaaatttagctaacttagaaaaaaaaaatgctccaacagacttactaattggatggctaagttatttggctggctaaattcctcaccacacttgccaaagttggccagccagagggcttgccatcggtgtgggtcccacaccctctctcctttctctctccctctttccccatcccgtctgctgctccctccctgctcgcggcgccatccgcccggtgccgccgtcgccgtccacccggcgccgcagtcgtcgtcctcccggcgccgccgccgtcatcctccggcgctgccgtcgtccatggagccgagtgagaggcggcgcagggagaagatgcccgtggggtcgagctgcacggtttggtggaccatgatgtagcgcagctcctcatcgagaagcaccatggcgagctgcacggcgaccccggtggaggaggaggactccgcgccgccgccgccgccgccgccgccgctgccgcgcgcgaggagctcgacggccggtgctttctctgagctaagccatggcaagaaaggcacgagaggaagaggaagaagaagaagaagaggaaggagaagagcagtcagggcacggggatcagtggcaagccaatgggggcagcttcttcttcgatgcagcatctgttcttgctctgccgcctcctcggcttctgctttgcgttcacggcgagccagcagcagcagtcggactcgtgtagcagcgccggcgtcgcggtcgcgcatctcgccttctgctgcctgaccgtctggaagcaggaggacttcgtcctgcgggtgtgtatgctactgaattttgcagtcctaccagttattggaattttactgcgtaccaatttcatctcggtgatttttttttattttggatgtcattgccaatgcacgcctgcagagtgcaaattaacaggcttggtagttaaattgattagagttgagtaattaacaggctcgcgcgaggtaccgcgccgtcgactcgcgcgggagaaagaggaagtaggggagaggaggaagaagaagaagcaattgacgtgtggggaccagcgccatagaatta

SEQ ID NO: 44260 - DNA, 8406 bp, Oryza sativa
agagcgagtaactagtttgactagtcaaattagatgaagaattggttatataggtgtttgagttggctatatagttgtttggagagtccgatttagataggctgttggtgatgctctaaaaaaagaaaaaaccaatctaaagaaagatgtgacccttccttacaacgaatctgaacagattccttctagtacagcgtgttcatatttgttttagtaggagaggtcacatcctctcttagattgattttttttaacgaagggagtactccgcattagtattaacccaagtgaagtgtagctaacaaaagaaaaaagtacattaaattaatcagaaaagctgttgaaagttgtcattatgtactactgtcgaacgattttttttctgagattacccagcaaacacacatccacacaccactatacacgtaacaccaatcactgttaatgaaaagacacgacgacttgagagatctgcttagctccagtgcagatccaaaatactgacaagatacacacattctagttagtttaatcttgtaactgacaagatgtacaaattagagatcaatgagtcgattgtccaataagccgatatagcatgctagctgatgcttataccaggcgatgtcaatagagttttgaacaatcggctatatttccaatgtaaattctgacacttgagtaaataatctatcgatgaaacaatttaactgacaccaataaaaccctagaaaagatctagtcgatacatgtaaattgagacttcgacttagattaactaagatatatgataaataggtgtttacatcaacaatattagagtgtcgaggccctagcccttccgatacaaatagctataacaagccttacccctcgttggagatcgaagccgatgcagcccaactcgaaacaagacctcgtcgagaaagacgaaaataaaaaggatggcgatgcgccgaagttgtattgaccgatagatagattacaaggatctcgggtgtacatatttatacccatgagtggatactaatcctgagcggatactaaacaaacttttctaaagataaaagaaaaaacataaaatcctcatcggacatgaatcatactttcctaaatacaaaacttgcttaactaatagataaactaaactgctatgacgtggtttccatggttccttcttaaactcgaactcttttagataagctttccataggctcattgtgctctttccttaaccgaatccattaaaaaatcttaccaaattttggcgttaacacacacttacacccccgcgaatgcgcccctaacaccaattgcatattcctgatctcactaaagtcatgttgaaatttcatttgcttgtgcataatatttataggcaccaggatttgaacccagtaaagtcatgcacccacaacttcaccatcacaccacttgtatttccagaacgagcgatttggtatcacagcacagcgataatattttgtgtgcgagtgtgtgtactccctccgtgaaaaaaaaagctcaaccttggtgaggatgagataacctaagacaacaaatcttgatagttctctgtccagattcgttgtactaggtgatgtccaaccttaatatcatccttacttaaagttggacggagggagtaagatccatcgggctggtctgttgtcttacgtggcgttggcgatcaatcatggccatggaatgaaatggcacagatggcgtctcgagctcgtgccgtaggcgtagggtatacacctacaagatatatatcactatcatattttatcacacataaagtactattcatattttatcatctaataacaataaaaatactaattacaaaaatatttaaataatacgaacggttaaacgttggatacaatcaatgcaaaactacccttattttaagatggatagaaagttatgtatatgggactgcctatatatcatctgacagattttttagcatcttatcatacagatttcttactctttggatgaacatctaacagatgatgacagattttttagcctcttatcatacagatttcttactctttggatgaacatctaacagatgacattaatatacacaaacaaaatataaaacaacaaacaaacaggccacatggacaatctgaagctcacgtggactcaaatgggctcaagttgatttcagacttacatcataaatacactaaaattacatatgtaattttcagacttacatcgtaaatacactaaaattacatatgtaattaatatataattacagtgtaagtacggtgtaattagtacgtgtgggatcataaacaaattagcattagaaaacatagctcaaatcgataatgatggagtcggcaaaaatgcaccacgaatcttgacaccatccaacgcacataaatctgcaagatatgtgactcaaaaatctgtcaccaaacagatagcaattccgtatatcggaattcctgagtcagaactgtatatgatgatgatgatcagtcagcggtcatatatcatatttctattattcatatatacatattattaatcatgtatatattattatatttaaagacggcgtcgttgaattattatgggttaatttgatctataccactacaaattttgctattcagaaaaataatattacaattcgtttattcgtaaccataccactgccgttaggtttccatccattttcttccttctccatcttcttccttctctcttccgtcttcttcccggtgatggtggcggcgaggccttgtcccggtggcgagccgtctcccacgcgggagagacggtgcggcggcgcccgcgcgccacgaggtgaagcaacacggcagtgctcgcgcgagtctgtcgtggcggcatggtggttctggcgcggaggcggcgaggcggctgctcccaaatgagacagatcgtgagcgcattataacaaagaccaagcgtccatgctgcatcctactgtactgtatcactccctccattttgattgaatgggacctattatattaccaatctaaggaggtgtttattagggggtgtaaaattttagtgtgtcacatcaggtattatatagggtgttgtatggagtgtttatgcactaataaaaaaaataagtatccgacagtaaatatgagacgaatttattaagccaaattaatatgtcattagctcatgtttactgtagcaccacattgccaaatcatggagcaattagacttaaaagattcgtctcgcaaagtagtcacaatctgtgcaattagtatttttttaagcatatatttaatacttcatgcatgtgctcaaacgttccatgtgacatggtgtaacatttttaggtgggatctaaacaggccctaaacaaaaaaaaactaggatacattgtatttaaccaaaatctattatattttaaaacggaagatatagaggctagccaaaataaatcttactagcgtccaaattttgataaactgacaatattatcgtttatcaaaatttttataagatttcttatctatttacctcaatttgacgagaaactaaatacatacacatctttgataattttagtaaaaagtaatatggtttaaattttaaaataatatcaatctgaatagcccatagtattcactgttgagggtacgagctgaattgaatggctccatagtactagtactgaaacgactgatccagtagtcattgtagcaacagtactgtagaaggtaggactgacggactgtggtggaagtgtggatggatatacggccggccatcatccattcattcgtcgtttcctgtatccaaatattccataaaaacgaatctacgatcggatgtgacatattctaatacgataaatacgaatctacaatcgaatgtgacatattctaatacgataaatctgaatagatgtatatccagatttgtagtactatgatgtatcacatccggtactaggttgttttttatgggacggagggagtacacctttaccttttgtcctaaaataaatttatttttcacaaatcctacatatatcaataaaaagttttaaaaaatatttctacaatatcaaatcctaatgtaactatttctcattttatctactctcaatattatttttttcacttttataaactttaatgtaataattactttaaaaataaaataagaattcattttgagacaataaaaatggctaaaaataaatttattatggaacaaaggaagtcctttgacaatgcatatgcgctaaaaatctgggactattaggccatccccaataaaaaaactatcaaactatcaattagctttcatacatgttattcatgtagatactgtataaaaactatatattcaatggatgatgtcgtcaaattaaattctcatccaatcatctctcttctctctttttatccacctatttcctatttttcattatttgttcttgcgtagagatggttttttgcgagagaaatgatttcttcatttttttacctccgtcattaactctattaactctcttgtcacatcagattttttattatgtgacaaatatttaatgctacctagctgcacccgggctgccttcaatccgttctgtaaccccaaccccagatgcgttgtgcaatgcattctgacacactcaggtggtgtttggatccagagacttaactttagtttctatatttagacactaatttagagtattaaatatagactacttacaaaactaattatataaatgaaagctaatttgagagacaaattttttaagcctaattaatctataattagagaatgtttactgtagcatcacatagactaatcatggattaattatgctcaatagaatcgtcttgcgaattagtccaagattatggatgtgttttattaatagtctacgtttaatatttataattagtatctaaacatctgatgtgataagagcttaaaagttttagttccatctaaataaggtatcaggtgtcgttgtttccaatttttaagtttataggagtaataattaaaacttaattaatcatatattgataatacttctattttatgtgtccttgcttctttatcggatgaaaagaacacctcctgtataacttatccgtttaattgcttcttgcatgagcacaatttatacacagcaccaagctggtgcatgggcccatcaatcaatggttcgactcacaaccagggttgatgttaccaccgtaaccagggcttaccgcggagtatggtaatataaataccgcggtaacctccttaaattcaaataaatttaaaaaataatttgaatttttgataaattttgcacggtttttcatggttaccgcggcgccggggtgcggtaaccccggccccggcggtttgagaaaccctactcacaacacataggcctcacgtacatcacgtgacatatgcctccatcataacagcctcagacgccgcagccacctttcgtagtccttttggctgccctggggcgtcattgtttttctttatgttttagctctttaaaaatttattttacaaatatacctttataaaaaacttacttagaaataaactatttttctcgacgtcaagattattagaaccgagtttcaatgtcttgacgtcaatcacactggcaccaatagcctcaatcagacccgttgatgcccaagagccaaatagacgaccgcatagggtctatgattttttttgggcccatgtgaagatgaaggactatagtctattgcccacaactatagcatgcaaggcaaatcgccaagcccaggtggccacgcgtacgacactgcaacatcatcgcatcgatcctaattctgtgattgcgtgcgttgtggctgctacgagaatgagacgagattgtcgatcccaattccatgccgcggtgaccagcgaggcgacgatacaacttgcgactctgagtggcagcgcgatggccgtagattctagtctccgagcagctctgcagtgtgcagctgcctcctgggctcctggctcctgccttccttacctcttcgctcttttagtatgattatcataatatattttaaaatagtgtacattatagcacatattgcatctacataattgagcgaaaatatgttttgtttatattagacatgctttttttaaaaaaattatagggcctcaatttgtatttcaacctggtgccccaaagtactggagacggccctggcctcaataggtgaagggagtctatagttgaagtaggaatgagggttccattccatcagctgctcagagcactgtagggaccacgatagtcaaagaacggaccgagaaagagacttgagtactaccaccattgaccagaagagactaagcctgtgttctttagcgttggttggaaactaatcctccacgcaccgaaaataaagcggtaaattagcatgtgattaattaagtattagcttaaaaaaacttaataaataggattacctaaaccccaatatgattttttaaaaaacaattttcgtacattctttttttattaaaaaaacactgtttagcaatttaggaagcatgcacatgagaaataaggttgtgttcttaactcaaggttcctaacctccactccctcgtttcccacgcgcactcctccgaactattaaaggtgtgtgtttttgaaaaaaaaatctacagaaaaattgctttaaaaatcatattaatttatttttcaattttttaagctaatacctagtaattaataatgttaatccatcgttttgttttgcatgaagagtggaggggtttccaaccccaccaaatgaacacagcttaagagtggagaggtgaaaagagaaagaagaggatggagagtgataagtgggtcccattgtattttctatttttctttccaaatgtaataccattgaagagccacatcagatgaaaactaggttaacttgccacgtaggataaatctatatatcatccaaaccgtttgaagagaaaaaaagagtgttttttttatagttgggggataaaataagacttaggtactagctcagctcatttaaactcgttatcttagagagccagcttgtctcgactcgtaatcttattgagtttaaaaggtcaaggtcgattttgcttacgaccgagctcgctctatctcgtctatatcacctttataattttaagtttgatattttattgatatatattaacataataataacatgtactaaactcgctagtttggatatagttaaaagaataagcattagtatcagttaagaagtagtagagctgaagccacgaggttatctccggccgctatccacgaggcatcatcgccgggggaggtggagctccggccagctagcggtgcggggagtcaaagtgtcaccgccgatgccgatcgagatcaccaccaattaattaagctcgctgtcgctgctaccgaccgaccgtgactgagaacaatgcaaggccgcctcgctctagctagctgtgtttagttcatactaacattaaaagtttggttaaaattaaaacgatgtgacggaaaagttaaaagtttacgtatgtagaaaagttttgatgtgatgaaaaagttaaaagtttgaagaaatattttgtaactaaacacggctgctcatgctcggcacctgtgctggagtggagctgctcaccgtttctattcacagcccaaaaggtcaatttcatccgttcacattgagaaaagaacaaaattaagcaagtcaattagaaactgaccaagtgccatttaggcaccatttgatgatgagccaaccccatttacggaatcacattttggccattttagcatgacaccatcacatatatttctcctaaattacaaaccaaaacaatcatctaacaactatattactctattcttcttcttatcattgtttattttggaactgtaaaatataggagcaaatctatattacctcatgagtttgtttaaaatggagtacttccccgttttaaaatataaagtgtattttgttatattggaataaggttttgatcaacaattgatctattaagatcaagtttattaggcggtatggcgagctaaggcgctgcacacccgcctcaacactattgcggtatggcggtaagacggacggtcaaacgttaggcacggatatccacggctgcacttattttgggatggatgtagtaaaaaatgctatcacaatcaaatggatccgaccactcatgacattatttttcactattcgatcaacctgacaagtaaaagggctattctagtctaaacaggtgtgattcttccaatcaaatgataacaatacaagtggacccaaaagctacttaacaaataggagtagggctgcaggaatt

SEQ ID NO: 44261 - DNA, 6895 bp, Oryza sativa
tccacctacggtagctgcgtatcttgagctcgagctcggggggaggggcgcctcggccttcccctccctactctcgagtcggtcacggcctgcgcttgctcattccccgccgcccaccgccaagaggagatgtggagagatatgggaagagaggagagaagcatgttagaggaagaaggcaagagcctgacatgtgggtcccatgttgactgcagttaattcatcacgtcagtgaaaccggccatctatagtttcatactgccatgagacctaatttaaccaggttttgtaagttggggatcaagattttccgtattgcagttcataaatatgatttaaatccgtcagaaagatgcgtaaagtggacttattccccattaaacgtagctggtcgtatgcctatattgggcttcggactggtggaacaattctaggccgcgatggtgaggtagacatgcacggtgacatgaattcacctgacatccaagtgaataattgatattctcttcattctaaaattggtaatttataatattagaatatgtcatatttaattatagatggttatatttaggacaaaagtagtaactaatagttctgatgtgcctacgcatggtgcctcttgatggcctgaagcttgacgccatacttgaagtcacagatgatcgcgaactagaactcgagaggggactccatgctaggcgagtgccggaacacgtaatggcggtagaggtggatcattgacagtttgatctcctggatggagaacttctggccgatgcacacccttggtcctatcccgaacgggatgaacgcgtacgggtgcctcctcctctcctcctcgccattggggtcgaaccgttccggccggaatatttctggctccgggaagttcttaggatccttcgctagcactcctggtgccaaccacacccacgttccctgaaaaacaaatgcatttgtaatccattatattcctacatagactttgctctttaatgaatgaatcccactacagtgctatctactggtagtagaaaataatttgaatcattaattttatttgatcgaatggcttatatctatttatattaccacccaattaacaacagtataaacatggaggggtattattataaaaaaaataggtgagaaggggcataattgtcatttagcagtgattaaacctttttttttctttttttagcttttatcgatggaatataaacaatgccagtgcaattgatgaccatagatcaatctagtcaagcataaataacaaagttacctccaatcattatattagtaaatcattactaatttactattaataacgaaccgttgaaatcatttctacagatagtataatattattagtaggaagcaccggagcatctccttgatgtacttatatatagatcgttggatctagtacctttgggaggacatatcctccaatttcgacttgttcaagtgtttccctggctagcaatggcgacataatgtagaatctcatcgattccttcacaacctgcattcataaccaggtgaaaagtgcagtggttagaaaaaaaaaaattggtctcacgaacccatgaacacacaagaaaatatacgcaacacatacctgatcaaggtacgggaacttggtctgcagatcgtcggccatcggcacgcagtagcgggggccgaacgcgtcaatctccttgagcaacttctcctccacctccgggtgcttcgcgacgaggtagagcaccgtggagagggtgaacgccgtcgtggtcgacccggcgaggaggtgctcgtaggtgagcgcgctgatgtagtccggcgtgagcagctccctcgatgacttgttagactccctcgccgtgagcacgacggacaggaagtccttgcgctgctgcgacgccgcaagatcgtgctccattgccgcctccctctcggcgacgatgctgtccatatgtgttttcagcgcgcggttgacccggtcgatcttgtagtcccccatgccgggaatcctcttgagcacttgccggaacggctcttggaggaacggtaggagcataccgacgagtatggagagcgatccggacaggtccatcttgagagatgtggtcgcgtgcatgtgcatcttgatgaactccgacgatgccttagcctccacgctggtatcagcggcgatcttgtctatgttgctgtcgtcaggtgtgactggcagctttgacaggccgaagtccgtgccgaacgccgcgaggccgatcacgtcggtggcgaggctgagagagagatcggagaaggtgatctccttctggccgtcgaggttcttggacgcacgctgaatgcacgactccatggtggggatcaggctggccaggtgcgacggctggtagatggagatgatcatatttctcatcgacgtccacctcggtcccctgcggtgcagcagccatgatgttgtttcctttaatttaacccaaatcaattttttcgacacaactagcataatattcaatgaaattcggccaaattttatgggaaatagctagtctctgctgctagccagctagttgatacttgatattacctgggaaactctaaactatggaggagacaatcctttattgtttacatgttatctaaataattatgaaaaacttagaaaaaaatcaataagatagattaatatgtgataaatcactttacaaacatgcaagatcacatttaacttatacaagatgtaatgaaaaaataaatttaactgcgaatatacgttaactagaaagtttaatttgctttttctgctgcaactcgtagaaattgaattttaacttgcatgtgttgtgcaatgatctatcttcttaaatcttttcaattttttcataactatttggatgacatgtaaaccacggagtaatgtcccctcttagagtttagaatccactctcgatgctaccttatgaagaacaaccctttcttatggataggagaattggcaatgggggagggcatgcttcgatttggaatgctcttgaatttcttcacgcccacttccttgcacagctccgcatccgccacaatgatcagtggttgccttcccatgtgaaatctgcaagtaaattgaataattgtgctatgtgtatgaactttgatctaggttcacactgggtgtgttgttttaatctagggttgcacagactagataagtttttcaccgaagagtactttgcaatttattacacatatttgcatccacatcataaatttatgcatcatgaatgtagtttactctaaattgaattccagttaactggttggtactgttatcctaagctatgctctccacgcaaaacaaattagaagaactgaatctgcgagcagaggaggcagtcacctgaagacaggaccgtgcttcctagcgagaacggagaacacatccggcccgtgcatggcgagcaggtggaggtggccgatgagcggcagaggcacgggacccggcacgtgccaaaccttccggtacggctcgtacaagtaggccaccaccaggagacccacagccatggccaccaaggtgaccgcccactccgccgttgcgcccagcacctcgctgatgtccatctcagcgatctcactctcaccctgccttgcctccctcttgccttgctatcatttatcgcactgttgacgttctgtgacaactgcgaagcatggttggttaagtaggcttgtgaaacggtccgttcccgcaggattcgatggagaggcatcgttttggttggattagtttgtcctgcttggctgatgtatttgttgttagtcactggttccgaccaaccaattttatttgagcgagatttctgagtctacgtgtgatgatggacgtgccggtcgaggaagaagtttgctaaaaacatgcttaattaaatatcgctgggccggaaaatgcataatcaaatgacgtgcagccagtgagtgcagtgtgacaaaaaaaataaataaataaggaaggtagctgccaaacgtgttgatgccttagatattactcttccatttcagattataagtttggtcaaagtcaaacaactttaaatttaattaagtttataaataaatatagtaatatttataatattaaattattttcattaaatcaataattgaatatattttcataataaatttgtaggttaaaaatgttaatatttttttctacaaacttagttaaatttgaagcagtttgacttgattgaccaaagttaaaacgtcttataacttgaaaaggaggtagtatttttttaaaaaaaataaactttatatgctaatggtggagcaggcgagattctactcagtaggtttcttgtcctcgtgtatataataaggtgtactaatcgacaatcaatatgatcgatgtaatactcttaacggatgtgccgctagctgattggtggatttattccgcaccaaattactgacacttgtccctttttctatttggtatgcagtaccatgcgactatgcgagtatgactatgagacgatacttggctaggctccgtgaagttcttatgggcctcaagaaaacaatcttagctgtttttcttaacccgttttaaaaatggtatgttaagtaaactaagatacataatgacacaatcctatataggcttacaattattgtatttcacgaagaaaaagtactgttgaaaaaaacaatttatgtatgtgaagatatatacagtgattaatatgaaacatggcgaaaaataatttaatagtgttacttccacatagtaaaggatgtcaatatcgcacataataattgttcacgtaagattaacaaatctataaaatataaagaaagaaacaaatcaatttaagggtaaaactttccatatctctaataagttcaaaagaccaccaaggctaaaaaaaatttaagaagaaagaacacaaaattaactttaatattttattaaaattaaattttgtttgtggcttataaaacaataaataggctatgatggtactaacaagttttcaacttccttagtccttaccaaagtcttgaatcctacaagttacttcaaggtatactgtcacaagtcgaattcctttgatcgtcgacgcgctcttcgccaagtacaccgagctcgtcaccgcgtccagattggggtcgtcctcaccatgttgtgaaacaaaccacaaagctgtgacgactgtccagagtgatttgtaccagtttatagtttgacccctgtttctgaattctaatgtgtggcgatgtggtgtttagttgttgtatcgagtaactgataatattaacaaattccatgtgtacttaactggtaggatggagagaaattaatggaaactggattaacaagtgcgttgaaatgccataaatcatccgctacttcctttcatcaccagtaattctgtatccagcaatactactgatttgtggtttatagctccacactcctacgaacgctaataaatgtttgcgatttttttttttggtttcataaaaaaacattttttctcaattttcttgaacgcctttatactttcccttcaaaatcaatgttcacaaatatgaaaacaactgaacaagaggccttgtaatgggctggcaagagcaaacaagggcaacctttcggccatcgtggaatgagatgggctgaaagaggccttagggcttgttcggcctgttgctaaaatcaaccataccaaattttagccaaattttgataagacaataaactaaatgacactttaccgtcacaaccttgtcaatccgtaccaacgtctggtaatctagaaacttctactcatagaattataccaaaaattagtaaggtgttagactaaacaccatcttcacatcttgatcttgctaaaattttagcattaccaaattttggttaaatggtaaggcttttttttggcaatgaacaagccctttgttccattttatatccgtcatcttttcgttgagtttaaattgtatgcttaatactgaaaatcttaacccctaacttacaaaaccaggttaaattaggtcccataatagtattgagaactgatttcactagcgtgacatactatttagcaaaaagaaaaaacatatagtgcccacatgtaagtgagcttgcacctctccccacctaccctctcttctcatccctccacctctcccctctctttttccccaagagctcaccaatgagaagaggggtgttgggcggcggctggtaggagaggagcaagatggtggcgactcatatcctcaccgacgagccctacatgggaggttgaaggaggagaccacgtggtggagaggggatggagcgagccggtgaccatcattaggggtagagctcggggagccaccgtcggtgtggagagggtcactatggtcagaatatgacggacgctatccttgcttgcatccgctgtcaaggccgatggtggctgtgaacccgtggtcgccaaagcaagagccaatgtccagattgtggcagtaggaggagcacaatcagtggactctacagttttgccatgggctgcggtgattgggaggcttcgggtggcctcggtctctggctcgatcggattggtgagtgatgcttcggcctcctgtttgggtggctcggccaccgcgcctctctcattgccatcgccgccgagatggatcaaagtaggggaatgtgtttgcgttgaggtgcacacgatgaggcgcaatgagagctgtgatccacaatgagtaactgctccgtgtgttgagacagttgctcacgctttaccaggaggatgacaggtgggtcccacatgtcagtgggtctcacaatacttttttttttgaatgacataagggtcccacatatttttttatt

SEQ ID NO: 44262 - DNA, 4663 bp, Oryza sativa
ggagcacaatcagtggactctacagttttgccatgggctgcggtgattgggaggcttcgggtggcctcggtctctggctcgatcggattggtgagtgatgcttcggcctcctgtttgggtggctcggccaccgcgcctctctcattgccatcgccgccgagatggatcaaagtaggggaatgtgtttgcgttgaggtgcacacgatgaggcgcaatgagagctgtgatccacaatgagtaactgctccgtgtgttgagacagttgctcacgctttaccaggaggatgacaggtgggtcccacatgtcagtgggtctcacaatacttttttttttgaatgacataagggtcccacatatttttttatttttgtttttattctaataccacgtaagcgtcacgtaggataaaaacttggtcaataccgccacgtcagccaaaaccaccttcaaaaccatcgagggacattgtttgcaccggtattgatagttggaggagtcgatatacccggttttgtggttggaggatatgaatcatactcaggcgatagttatgggagccaaagtatactttttccaaattttttacaagagaccccattaaacgtagctgggctatgtgcctgtgttggacttcggactggtagaacaatactagtaggagtaccattttagcagtggcgaagtgaaccgttgacagttcttttgttttgacacagtattaaatgcagacgcttagctcgaactgataaatatacagttctgctgatgatgtgcctatgcagtgtgcctcttgatgacccgaagcttgacgccgtacttgaagttgcaaacgatcgagtactgaaactcgagaggtgactccatgctgggcgagtgccgaaacacgtagttacggtacagatggatcactgacagtttgatctcctggatggagaacttctggccgatgcacgcccttggcccgatcccaaacggaatgaacgcgtatgggtgcctcctcttctcctcctcgccgttggggtcgaaccgctccggccggaatacctctggctccgggaagttcttgggatccttcgctaggactcctggtgccagccacacccatgttccctgaaaaaaacaagggtatactagtacggaaacaacgaagcagagtctgtctggaactctggattattggccggatctagtacctttggaagggcatatcctccaatttcaacctgttcgcacgtttcccttgctatcaatggcgataaaaagtagaatctcatcgattccttcacgacctgcatagtacgcacatgataagtgcaatgctcggtcagaaattcaggtcttactattcacgactccacaatcgaagaccataaatacgaccaatgtcgaagaagggcatgcatgcctgatcaaggtaggggaacttggtctgcaaatcctcggccgtcggcgcatggtcgtgtggtccgaacccgtcaatctccctgagcaacttctcctccacctccgggtgcttggagacgaggtagagcaccgtggagagagtgaacgccgtcgtggccgacccggcgaggaggtgctcgtaagtgagcgcgctgatgtagtccggcgtaagaagctcccgccaggatttgttcgactctctcgccgcgaggacgacggacaggaagtccttgcgctgctgcgcatgcggcgctgcctggtcgcgctccattgccgccgctctctcggcaacgattttgtccatctgtcccccgagcgcgaggttcacatggtcgatctcgtggtccgccgtccagggaatcctcttgagcacctgccggaacggctcttggaggaatggcaggagttggccgatgatgatggacagtgagccggacaggtccatcttgagagacgtggtcgcgtgcacgtgcatcctgatgaactccgatgatgccttggcctccgcgctggtatcagtggcgatcttgtcgatgtcgtcgtcattcgaagatgctgatatttttgacaggccaaagtccgttccgaacgccgcctggccgatgacatcggtggcgaagccgagagcgagatcggagaatgttatgtcctcttggccatcaaggttcttggacacgcactcaatgcacgactgcatggtggggatcaggctagccaggtgagacggctggtagatggagatgatcatgtttcgcaacgccgtccacctcgaacccctgcatgtgcagcactacagccatttttctacgtttgcaacggaaaaaagaaagtacaccaaatattaaataactttaaaatgacaatttttttcataacctagtgtaatatatgttttctttccgtgtagaagaactatatatatgctttttccacatatttataaattattttattacagtaataaaggaatatttgttcacatgtgtggcttagaaatcaacacattaattgaaacaaaaatatacaccgttgattatagtagatctagaaaaagttttgatacatgtttaaatataatgatgtagatttatcaaatatatgctctatctttataattagatttaatccaaatcatgatcccataccggctaacaaaacaaattgttttctttctaccaacacacatgggataaagctaggtctgggaacacgaacacaaaataaacgaaagattatttcagcaattatttaattagaaaatggaatcaaaatcctcacttttaggtttgggccgaatatgaaaaagtccagattctttcccttttgtctcttttttgtttctagcctgtttccctgtttcctttctccgttaaagtccagtttgcgttctcctagatcgcctaggaaaataagtctaattaatttaacttcctgtcgctacattagcttcttcaagctccagccgagccaccccaatcccgcatccgattcaactaaacccgtggagataatcttaaattagttgaaggcttttgatctatatctcatactctatcttttccctcaagaaattgaaggaaatcccatggaaaatcgctcccgtatcaagctcgaacttgagtttatcgaaccctagtttttatctttctggtgaactcgagtccgattcaaccaaattagcacattgacgggcaaaaatgcagacaaaaaagagatgatgaacggaaagttaacaatttgtaattagttaaaatatttatgaactgtaaaaaacggtcagcaaattttcatattgatgaatttaaatatttagtgccaactccaatgtggcactgacagaaattagaaaagtaaattttagaatcgataaatttattattattattattattattattattattattattattattattattattattattattattattattattattattattattattattattattattatatgttagctttgcaaaaaatgtatcagtatggatgggaaatttccataccattttcacccgtagctcgctctgtcccaaaatatagcaaccaggattggatgtgactcatgctactgatacaaatctggacagaggtaatataccgtgtcccatccaatcttggcttggtatattttgggacgagtgacttataatatgaaaaaagagagtatcagatagcaaatgtgagttcaaatactaggaatgataccaagttataaaccatatatgccaggctgtggagattgttcgatctggttaacgaaactagaggattttcctgtgcaatttgcacggagctagatttaaaaattgagttgaatttgtatacaactttgattctgtttctatacgggtcgatttatgctaccatatttaacattgtactttgtatacaattatatcaataaatctccaccgatgtattctagaccaacacaatttaacggttaacatatttctccttttgtccgattaaatgtggtaatttttaggcctccagagtaaacgcggtgaaactcattttagagctatcttaataataatatgctccccctgtctcaacatataactattttgagttccgaatctacataagtgcatgtcgagatctatagttaaaagttaatatattttaggacggatgtagtaatatataaatacatttatatttatgcaagaaagtaagagttatatatcaaatataattatacttttttatttaggtttgctgcaaagcagcagagaaaaaacactacttatattattaagcaaggatgaaaaggaagtatggaactatcatgtttctctctcgaggcctaaatagtaccatgttatttgaagaaaaatagaatcatatgcaccatcttgaaaaaggaaaagcacccgatgtgtagtgatggagttgtgaaaatttatggacatgcatgacatagaaataagggttgtatattatatatacttttacttttacttcatagaaaaatgcacgtgcattgcaactggtgaatgttattttaatcttattattgttatacggtttagctagggtaaaattcactgtaggaattcgcttgtttttctttagaaaatcatgagttgcaattagtagtccgacttttatctcaagttagcatacagagttttttaaaagagactttttatacgactctttatttctaaaagcaaacgagcttaaaatcca

SEQ ID NO: 44263 - DNA, 6999 bp, Oryza sativa
  unsure (1)..(6999): unsure at all n locations
tattagcaacttataaaacttttatacttgtatccttaatgattaaaaaaatattgtaataataaattacgatgaaaaaactatgtaaatacttaagtatttttgttaaataaacgatacacaattttgttaaatagtggttttgttaattttgtgaaataaactacaatgaaaaaactatgtaagttttagaaggagttattaattaaaataaatatttatgtagtgttacatatgtgatatccttatcttcatatttgaatataattctatatgatattaatatcataggagtaatattaatggtcaaaattatctattgaagactgtcaaaaacttgcgtcttatatattttttttggttgaagatatataaattgcagaaaaaaaaactccactctttacaggaaccaatctgagttgctacctaccttgtgaagcacaggcctttctgattaataagagaattggcaatggctgagggcatgcttcggttaggaatgctcttgaatttctttacgcccacttccttgcacagctcggcatccgccaccatgaccaatggttgtcttcccatgtgaaatctacgagcaaattaaactagatccagttaaccgggtagtagaccctggtattcccagttctgagctctgcgttcgagacagagaagcaccagtaagcagaggtgccagtcacctgaagacaggaccgtacttccttgcgagcacggtgaacacgtccggcccgtgcatggcgagcaggtggaggtggccgatgaacggcaggggcacggggcccggcacgtgccgcactttccagtatggctcgtacaagtagcccaacagcaggagccccacagccatggccaccaaggtgaccgcgtactccgccgttgagcccagcactgtgctgatgatctccatctcacccttgcgtctctgccttcccctctttgcctcactgtcgcagttcgtggtgtgccaagcgttgctggttaaataggcttgcgattttgtgaacagtccaacggagcagatggagaatcaatgaggcatccttgagagaggcatatggttttggctgtattagtttctccttaatgaagtaataaaacaagcataattaaatcgcgtgcaaccaattagtacatcgtgacaaattttttgttttcttcgggagggtagctgtcagatgctaatggtggttgtcctgacgtgttacgtgtatgcaccagatgaccagaaaccccatcgttgcatgagttcatcgccgtcagatggtgaaatgagtgcctgtgtcttcgttggcactcgtaaaatattgagccaacgacttcagagaatagaacggcgatggcccaccatcccacgaaaggtaccaaaaggtgctggactgcaaattcgaaattaacaattttcttaaacaaatgcataacgtagtacgatatttcgtattgagagagcataaaaattataaatgtacagttctaagagaatatagcgaaaaaaaaaacaccccataacagtggctaggggtggacgttcggtcagacagaaaaatttggtctcggtttttggtttttcggtcatttcggtctttgcaaactcaggatcgaatttcatccaaaaaatctcaggaccggcaaactcggtctcggtttcggtctgaccgaattatgcactagattcgaatcagaggagtagatcaaacaataagcataatacttacagtacatcgcaagaagccaaaatccacagatgtagccgctcgctgccttcccgtcgtccccgatggagacgaatgcggccggtaagattgaagccgaggcggctcctgcaatggatgctganggctgatgcggcgcggatgctatcacgcggtaccacggaggcggcgcgatggatgcccacggcggcggtggcgccggcgcgattgaagccgagggaggaggcggtgccggtgaacttgaagccgaaagtgggggtggcaccggcgcaatgcaagcggaggcggagtcgtgaccggctgacggcgtgatgcggcgaggattggataaaattggaggcggcgcgggcgtgactcccttcctgatgccctctaaggttttgtttttaccgggcttattgggcctcgtaggtctattgggccacaatttggttaaccgaaagccaataaccgaattgcccggaaaaagtcggtcttttgatggctgagactgaattactaaaagtcggtctcggtcttttcgatttggttcttcggttcggtcttattctgcccacccctaacagtgacgtagctaggatttaaagtaaaggtggtccatcctattaactaacacatctctatctctactacttaaaaggttgaatatgtttccgtcgttcgtccgtgataaaataaagggcgaaaaaaaattgaatccgattatatgcgatgcaggaaaaaaaacgtccatcgacaatccaatttggttagcaaaatgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaataaatagaggacttatttaccttaacttaggttgcagctcaggcagcccgagaatacaaccgacgacacggacgaggcgaacaccaacaacaacagcggcagcagaaccaacggtctaacacccaacaccacaggcgacggctgggaaccaggacgaaaccctaatcttcacttcactttgtcttctcttcacggcggaggaactatatatatatatttatatagagcaagggtgagtactttcgtactcagcaagtcacgggaacttaggtgtttaatgcaagcttggaagagaggcaaggttgttttgcaaatcttttatttgaagacattttgaaatcactaagtgatttatttctttctaagtttggggcgaaaagagacttgcgtctcgattcgactttaagagatgtttttcaacagctcatttagtaatgtaccgacctcccgggtcagatcattacttctcggctcccagagccatttcacttgattaatcggctcccagagtccagctgcccagcagcacaacaatccgcttccactcgggaagcctagtctatgatgcccgcagacatcccgaatcacacagattcgtttctgaccactcagttcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacccagggatacctcatgccacatagaaggatcaaatcctcacataaacataggccattttaggcgttcaccaatcaaactccaaccacctcgatcggtaattcagcaagcttctcgttcttgcattaccaggaacccggtttggctccaaccgaccccgccccggcgttcccaactattagcatgcgaggtttccctgaacagactagctacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacctatttcccaagttttcgacaaacaacggtgtatgtgggatatttggtatacgcgctcagagagcacaaataccgaggtaccacgagggtggagcgacaaggaatcagggtagtacgacctacggaaattagtgcgactactgggtaggtccgtcgatttggcacgcaaaccgaggccaagcaagttaagtgtgtgattctaataatgcaagttgcaaacaaaataataatgacttttcaattataggggcaatttgatcaaagggtgacttgccttgctcaaggtcttcacgaagcttcacgaatcttcgagaaaacccgcgatcgacgaaaatccgataaccgcaactatacgcaaaaaatcgaaaacctaaacaaaggaccaaaagaaggatcctatttagactaattagtagtgccattaaatagatctcaattttacggaattactggaagtataacggagtcaatcggagttacggatcgggagatatgaatttgaagtttatttggaatttctggaataagaggaatggtttatggaatttatagaaataatattctcaagaatattattgacagtcacagacacgcgggaccaaaggaaatgatttgtggaattttgggaataaggaattgatttatgaaaaagggaaaaggatttattaatcctttggataagaaaaggaaggagggatgggatttagacttctttgggcggctcgggtacggcccaagggataagcacggcgcggccgagccaatgggccgggcgcgggcgcaaggaggcggcccatggccgggcaaggcgcggcccaagcgggcggggcgcgcgggaggagaaagggggatgggtccgggtggaccggatccatcgtgctgggtctcgggacaggcccacgagttagcgactcggcgcatgggggaagggttcatgcggcgcagggcgctagggttttgcggacgcggctcacggcgcggcgcgcgggtggaccaagaggtggagggcccacgcgcagccagttggcgcaccgtggaccgcgcgcgcgagggtgggggagggagaaggcggctgaccggctcggcgcggtcaaagccgaggtggcgccgacgtggtgccttcgtggctgccacgctggctggcggagggaagaagaaggaggccggccgagaggaggaagaagggggcgcggccgaatggacggcggacggcggccgagttcaccggagcaagcgtgacggatttggtcttcggggagcacaccggagtgacgagggcatcgagaaggagcgagccaacggctcggattcgccggaggaagttcgacggcggtggaattcgacagcggctgccggcggcgagagaaaggggaaatcaccgaggggcgacgaggactcaattaaaggcggcgggagcatctccggtgttcaaggaactcatttccggggtcggatgggtctgagcggcgccgtggaggtccggcgacgagaggcggcctccgggggtgggcggcaatggcggtggggccatgccgggtggcggcggtccttggggcggcgtctacgcgcgttcggcagggttaccgagctaccacgcaagctagaggggacgagggtgagcagggaaggggaactggagggaggcactaccgagccgggacggcgcggtgacgagcagccaacggcgcggaagcgagttctccgtcgtcgggccggggaaggggaagaagatgggcgcccagagtcccgcgtcacgcgtccacgcacgcaccggctcccccggtgctcggcgacggacgacggtggcgcgagcagggcggaggcgacattggcgcggtggcggcgagagcgaaaacgagagagattgggagatggggcgcctcgggttttatagaggtgggggatgtcggttttgggagggaggaaaccgacctcgtgggcggtcaaggaggggcggtcaaggaggacctggcggcagggcgcccgtggtccaggcagtggcaggcggtgacgccgatggtggtcgggcaaaaggaaaaaggaggggggagaaagggagctctgctccttgctgtttcgggaaaagttgaaggagggagagggagtgagagagaggctgcctctctcggctttggaagctagcggcgtggagcggcagcgcacgacgcaggcgacgctagggcttgacgtggcggcaaccgggcggctgcgcggcgcaggcgcggcagggttgacggcggcaatgaccggccggtcggccacgcgcgagcgcgggaaagagcgaagacggtggcgggttttgggcggcgacggcgggaatggtgccggtcggggaaaaagcaaaaggggagggaggaaaagggggccctgcccatgccatcagggagaaaggaggagggacagagggctctgcctcgggagttggacgcacgcggcttggagtggccgggcacgcgtcgcagggggggtgtcggaacccgaacggcgcaagncggcgcaggcgcggcaggccggcatggcggcctgcgtggcgcagcctgccagggctgacgcgggggcgaccaggcagtcggccacgcacgggcgagtgcgcgcgcgacgcagggagtgcggctggatttcgaaggcggcggcgagagttttggcgtcggggggagttcgtcgggagagagagagaaacagagagggagagagggagaagaaaggtgctgcctctctctcccggcgcatgcagcgcgcgtgcggggaggaggaggaccgcccgagagaagagaaccgggctgagaggagatgggccgaaggagggaatcggcccacaaaaatccgagggacgcaaaatagactttgacagagagattgaatttggagagaattggggcttggaaatggaatttggatatctttgaagtcgggcgaatatttggcaaggttttgagatttggaatttgaatttcgaatttgattacttggactcagggaaacagggaggagtcaccaacgggattcaaaaagggaatttgataattctaggacggggacaattatttggcggggattnnnnnnnnnnnnnnnnnnnnnnnnnnnnnnnnngag

SEQ ID NO: 44264 - DNA, 22854 bp, Oryza sativa
ctcacgatatggatttatctccctgactaacgttgattataaattcgtataaatttcatttatgttcatgtttcttaattatttacgtcaacaatgatgtaatttaggaattatttctgtttaactatgtaaataattgagacaacgcaaattaattattcatgttcatccataggtttcatgaacatatagtattactcgttcatcgacactataaatttggtcgagtagaactgattagatcagacgttgtatttcaattaattagtatgtaatatgctttaattcaattttctcctttttttcttcccgtagcaacgcacgggcacttttgctagtatacaatagttttaatcttgatcaaatttttaggtggtccatggcccacagtgccacctagctagctatgcgtctgccgcataaagcatctaaaaccaaaacccgctactcaagatcaaagcagagcacatcatctctaaagaaaacgatattctaaatgacacctctagaaaggatgcggcaccaggagtaactccgccgcccgccctgaggcgctaggacatgatttaaacctaaaaattcatgcaaataatgccccaagggaaaagcagcgtccgtagatgtcgctattgcttgtctgaagggctaggcttctgcccgtaagctttctaccctcccgtgtcgaggttgcctgcaaaaagggtaccagcaccacctgcacaccttcgacggatggccaccgcgccaacaccttgccattggtcgacctttgagtaggagctcaacatcggacgcgctccaaatcgatccacgcatttgggttggagagggagagggaaagagaagaatggatcccctctcccttgcactagcccgcctaacgtggccattttgtgacagcaaggcgccaccacaagaggactatcatttagattggagcccccctcaagcttgtaacgcaacctcacaacaccaccatcgtcaacacatcgaccaaacagcccgcatcaccgccacctcaggccgctctttcgcatcgcggtcgcctcgccccgttgcctcagctcccgccgccattggacccgctggagcactgtcagcggtagtcttgccttgtgcccgtgctgcggaagctttgcctgccaccggccatggcctcccacaccaggtcagtacaggcacacccatcgccagcagagccgtcgtcgtcgcaccattgcaaaccaccgcccagactaccaccaagccactgcggctcacaccggagtggccagatctggactaggggttctactttgtagctatagatgtcccgtcaatcaccaccaccctactcctttatggtcagcatgttgcccctcctatttactatctttgggatttttaaagtcgaacctgattgttgttgggtttttctttttatagcttttagaagtagccacaattgttctatccaaatatatgaggtatagcggatccacgtaaattgtatacttgtcgatgttttagatcacgattacggtatttgcatggtatggggatcgttggtaccagggtatatgcgaaattgaggtaaaagaggcagagataaggatttttatacaggttcaggccccttattcatcgaaatcaggtaatagccctactcctgttggccgaaaccggtgctgctcttattcatcagaatcacacaggtacaatatttgggataacctatctagccattgtcgacttggtggcatggaacaccatcatgtagtcgacgacagggcagtcttcctcctcgaatatagacttggtgagatcagagatagcgctagatccctcttgttagcctctgatggtaccagattgggtctgtctaggtttatctctgatatcgatatctggcggcatgcattggtgtctattctgattgagcgtgctggtctgtgctggcttgtcttggtttgtccctctctcctccttggggtcttgtatttatatccatagatgtccctttgtccaagtataattagggagacaaatatggatataatctgatcagtcctcatagttttcatgtagaactcttcttcttgtcattccttatccagaactccatctatatacgaggtatgattccgtataaaacttagtatatggtaggccctgccgagcttagtcgattacttttagatatgtgttattcataaccttgacactacttcaactctattttttcttttctctgattaatgtgagaattttagagcagagcaaacttatttacacgtatggtctattttttggcccttagactttgcttggagttcatttctcacctgaattacaaaactggttattttttcaacaataacttttaaaatcatgcatataattttatgatggttctttttatagacgacatgatatagtggtttaattttcgctagcatgaattttagtcaggcaaacttcatgcttatagacctaattatgtgttatttaattttcatcaacaaagtatgcataataagagtataaactacggaaaccatctccatttgaagcaaaacaactactaaatactccatccatattaaaaaaaaaacttctgtctacgaatctagaaaggcttgtgtccaaattcaaattcagaagttgattttttttcttccaagacagagagattatatccgaaagtgtttaccttttcagttttgaatttgaaagtgagaatgaaaaatagactttgtagttcacgatgaaatatacgctttgagcaaagttaaaggttaaaataggcttaaccatctaataataacaacagtagattggatcaataaaccctgtgaatggaaaactgctgacaatgtattgtaaaatagtggcgaccactgggtttgttatctttcccttctatgtttttttagaagcgtgagaagatactaaacacccgtggccatttcacctcaaaatatcacagaaactaaacagcgaacataataactgtctttattagatctattttcatcgtacaacatgatatgtcccacggcctgctcctctacctatagaggtctttatgagaagaaaaatcttatattcggatatttactcataagaaactttatgcctcggagatttgctagctgtggttcatatatattacgagtacaacacggactgcccggcgaaaacaagtacagtacaacataaactgaaaacgagtacttaataatatgcgcaatacccaaaatccaaacgaatagttctcctgatgatgtgattaagcattatatatgcctcttgatgacctgaagcttggcgccgttcttgaaattggagacgatcgagtacacaaactcaggaggagactccatgctgggcgagggccgaaatacgtaatgacggtagaagtggatcgctgacaatttcatctcctgtatggcgaacttctggccgatgcacgccctcggccctatcccgaacgggaagagcgcgtacgggtgcctcctcttctcttcctcgccgtttgggtcgaagcgctccggccggaacacctctggctctgggaaatttttgggatcctttcctaggacaccaggtgccatccacacccatgttccctgaaaaaacgaatgaaatgtatactgaagtagtacataagaggaaacatgaaagcaagcctgtcatgtcctataaaaatgtgaatattaaggaaagacctaatatcaaataattagaagggtgaggcttcgaacccagatcgtctagcccaccaccttgtgaagctagacggaagtcccctagaaatttctccctgtcatgtcctatatggacttgtatataaagatcgtcggatgtacctttggaaggggatatcctccaatttcgagctgttggtttagttcccttgctatcaatggcgatgaggggtaatatctcatcgcttccttcaggacctgcatgcgtgcacgatgcgcggtcagaaattcatgtctgacgatataaacacgtcgaggaagggtttggcgtgcctgatcaaggtaggggaatttggtctgcagatcctcggccgtcggcacgcggtcgcggggtccgaacccgtcgatctctctgagcagcttctcctccacctccgggtgcttggcgacgaggtagagcgccgtggtgagagtgaacgccgtcgtggccgacccggcgaggaggtgctcgtaagtgagcgcgctgatgtagtccggcgtgagcagctccctcgaggatttgttcgactctctcgccgtgagcatgacggacaggaagtccttgcgctgctgcagcgccgccgggtctcgcttcattgcagccgtccgctcggcgacgatcctgtcaagctgtctcccgagcgtgaggttcacgcggtcgatctcgtggtccgccgtccagcgaagcctcttgagaacctgccggaacggttcatggaggaacggcaggagctggccgacgatgatggagagcgagccggacatgtccatttttagagacgtggtcgcgtgcacgtgcatcttgatgaactccgatgatgccttggcctccgcgcaggtatcggccgcgatcttgcgggtgtcctcgtcgtcgtccgacgaggccaactttttcgacaggccaaagtccgttccgaacgctgcctgcccgaggacgtcagtggtgaagctgagagagagcttggagaagttgatctcctcttggccctcgagattctcggccgcgcgttcaatacacgactccatgctggggatcagggtggccaggtgcgacggctggtagatggagaggatcatgtttcgcatagtcgtccacctcgaaccactgtcgacaaagagtactgatgttttatttgaatgttcgtgaatttataaagttccaacgggggaaactgttttaacggctccagtggacgtccacccatttattgcatgtcatctaaatggttatgaaaaaaatttaaaaaatatgaacaagatagatcaatatgtaatatattaatccacaaatatgcaaattaaaattcaacttcaataaattgtaacaaaaataacaaacaaaactcaaattactatatgtatatttacaattaaatttgttattttgttacaatttgtagaagttaaatttgaacgtgcatgcttgtggagtgatatattacatattgatctattttatcattttttttgaaaatttttcgtaaccatctagttgacatacaataaacgggtagacgtccattcgagctattagaatccatctatgttccaacagtaattaactactaaccaaggatggaagctggcccggtacggtgtgcatgcacgaacacttttacttcttcgagtgatcatttgagttttatcttatgccaaatatcattaagttcgaccatattataaaatgcccctataaaaatatacagtaacatccatcattcaatatatttttatagtatatttatttttaacataaaatgttaaaaatattatattttttaaaaaataattaaacttaaaaatatgacataggaaaacttataatataaaacggagagagagagagtactatttaaatatttaaacattgatggaccttttacccttgctagatctttacatcagaactcttcagtgcctacctgacacaaacaatagtgtaataaaaccattttacatttttgcgagggtaataaaacctttttatggctctactatatggcatatgtacctccattgcatattgctatgaaaaaatagaatggtttctaagacatatgttcttgaatgtattctaagacatattctctcttttcttgtaaaaaaattataggcctaataatttgtaaaagttcaatggaacattatgcatttcaaataagggacaattactaatttgactctatttcgaagtctaactatcagtgactcttatttatttggccctgtttttaaaaattgggattaccgtttgaccatgttagaaaaaacaaaaaaaaaatgcatttatgtgctggacttacaaatatccctaagaacacaataatcctatccccaatttcttctcatccattcatcttcggagactagcatggatgacggtatcagtgcggagagagcaaggctggcattgtgaggagggagcagggatggcagtgacggcggcgcgcagagagagaaggggtggcggcacgcgtgagatgggagcatgggtggtggtggcacgaggagggagcagtggcaacaacatcgtgaggtggcggcggcgacaatgacagcatgaagaggtggaggtggcggcacgtggtaagagcggtggtgtgtggaggtagcggtggcggcgcgcggagggagaagctatagcatcgcgcagagagagcaggagcgacgacacgcagtggaagcgccggagtggaggtcacgacggcttgcggagagagcgatggcggtggcgatcgtggcgacacgcggggagcaggggttacgatggtggtgcacggaagaggggcgatagtggcatggttatctgtattttgctttatctgtgtttttttttcaatttgggatggaaaaaacaatatgatgtgaaaatcttgtaaaatttcattcatagttatgtgagattttgttaattttatttttgccaaattgacgtcaaatttgtcagtttgaagccaaatctgtcaaagcaatgctaatttattacaagtttgtcaaaggtttgaataaaaaaagcttttatgcagttatggtcaaatgagcaagggcaaaaagaacaatttatctcttagctaacacttttatcttgttttcacggaatagggtaagtcttaatcttcgattttgaaaaagggttaaatgtacaaacttgaaaaagtggggtcaaattattaattgggctttagaacagagtcaaatagaaaattgcccctccatataactaatgggttatggccgatcacgctcaaaggaatcaaacaaaaatactacaggctctttaaatttatttttctaaattttaataatttcgaatttacagttaataaatttattttgtcaattcaattccgaaattcaaatttaaaatagcattttataactggagctgacttttataaatctaactaaacagacagaattcaaaaatataaccaatatatttattttaatatttataacattaagaatactagcatgtgcaacatacaactagtaaaatttaattctacttttaatttagctccaagaaaagttatggataaagttctctggtctttattataagagagtatatatgaagaaaatccaacaagttcgctccagacatataaaaaggtatcatgttatccttagaaaaagagaactacaaatatcacttaatcgagttgggtcaaattataataactgtgtaaattggtaaatatagttttatacaaaatatactcgcaaatggggaggcccgagaggtattgtggtggatcatgtgtgtatgggtccgtacactaggatttaaataccagtgtctataaacatgtgggtaagattttagtagaaatttagtgaaataaatatgtactatacgtacttaaggatgcgcattcatagtatatgtgtatctttcatgcaataaaaacatgtatacatatatatttttcttttggatgtagaagtgagggatgtatatcaaatctatttaaatttagcttcaggtaaaattgcgcgaaataaagaaagtaaagcaatcaactgctagttgctactaccttgtgaagaataggcccttctgatgaacaggagaattggtaatgggtgagggcatacttcggttagggaagttcttgaatttcttcacgcccacttccttgcacaactcagcatccgccaccatgaccaacggttgccttcccatgtgaaacctacaagcaaagtaaactagatccagttagcaatagaccctggtatcctcgtcatctctgagctctgcattaaagaaacagaagaagcagcaagcagagaagccagttacctgaagatggggccgtacttcctcgtgagcactgagaacacgtccggcccgtgcatggcgagcaggtggaggtggccgatgagcggcaggggcacgggacctggcacgtgccgcactttccagtatggctcgtacaagtagcctaccaccaggaaacccacagccatggccaccaaggtgaccgcgtactctgccaatattgcgcccagcactgtgctgatctccatctcaacccttccgttccctgacttcctctttgcctcactctcgcagttgatcgtagtgtgccaagcgttgctggttaaataggcttgtgaaccgtccaacagtgtagatggagataagcattgaggtatcgttcagaggcatctttgagaggcgtatggttttggctgtattagtttctccttaatgatgttctaaaacaaccataattaatcgcgtgcagccaatgagtacatcgtgacaaattgatctttgttttcttcagtggggtatctgtcagatgctaatggtggtgggttcatgtccggagtcctgacgtgtatgcacgagagaacccattgtcgcgtacttacacgtaactattctaaacgctcgaggggatgccatctcattgtttatatgtcattaatataagaaaatctgaagtaatttaaaaaatttatcaacatgtgatatatatcactcccaaacataaaagttaaaattcaacttctacgtgtcacaactaaaaaaccaaatttgactgtgaatatacgttaactagccgtagtttaatttatttttttcgttgcgatatgtataagttaaatttaaacttacatgattgtgaagtgacatataacatattaatacatctttctcaatttttttcataactatttgagtaacatgcaaataacagtttaaaatccaccctccgtgcttgcatgagttcgtcgatgcatgatgaaataggtcccgtgtatttgttggcactcataaattctcgcgcaaaaaagtaaaaaaaaatccaaaaatagcagaatttgttagttcctacttagttacgaatatgaaaaatatgtaaagaactggcacttaaaaaatggagataggaagagatataaatatgcaagtcttgtgtgtgacaatgggtgtcaaattcaattgaaataaggtatcaatttcattgagaggacatcttgaaaatcgtcaaggaaggtaatcggataatctaaaacttgttaattaaatcggtatgattgaataacttgccttatctttgtgcatctagactaagtttcatttctttctaattagcctagtttacaaaatgttgtaccgaaatgcttgttcaatcaataagcgagtattagtcacaaaatggtgtctatgggaatcaaagtactcggagaccttattctagctatgtgaattttgtcttagtgttggtatatatttcttaacgtcacaaatagaatccacaagcgcacggaagatatcaatacagcacttcactctagagtattccaaggcatcgattttcacagggaatgtgtatgtcagcacggaagataccgatgaacatgtatgtcagctcttctccaggtttatccaaggacacaaagctaagataggctaagagaggatttactagcgagagacagtgtctacagaaagcttaatttaatcctaacatggtacttcaggcgctggccagcccgctgctcccagatatggctctacagcgtaaccgggtagggaggactttagtgtacttagggttgtgttgatgtaaaaacacgaggcctgagagatctgcttaactccagtgcaggtcaaatttggttgttaacaggttgccaccacctcttcacctacctcaaacctactatgggatacgaaggaaattaactacccaaacaccatgtctacaccgttaataactactttaatgtttataactcactaaagcaatcactatattttaatggactataatgaacaatgatcccatacgttgattaggaactaactaagaggtaactctcatagaataaatcttaattcctcagaatgatatttgattaaagtagagtaattgccagagtaaaataaataagaagaggattatcgacaactctggaattcctccgacttcctctactccacctctccctaatctagtatacaataaagtagaataaagcctcttgtaattaagctcaagcttcaagtgtgttgtgaatgagggaggagagaggtatttatagtgtggaggtaacttgagagagtggagatcctccaagcatccaaagagcatcttctctcttgtgttgccaagtgtccatgcttatgacagtttctactagtgaaaacggccattttccaaagagcattgggaagcggttttctactgaacgcaacctgggcttgggccagtggcctctgtcaaggttcggcagaactcagagttcggtcgatccctagccggctccgttggccccaattttcggcttggacactcattttgggcccctcattctattggtatggatgtttggcccatttggaggtgtttaattgggtttttgggtccaaaactccataagttcggatgcgagtttgattctcatcctccttcatgtatatttcttctcaacttagatagtttgtcacctacatatgaatatacaccaacactcgtggaaattattagaaataaatcctaccactatgttggatgttttatatttatggtttaatgcagctattgatggcgaaaatttggtacttaacagccatcaacacttagcaaaatctttgggattcatgtatactaaatccgtttgcgatatgctttgtgaaaatttgtgtgagttgttctttttaaaactcttgaatctcactcaagtttgtgaagaagtggtttggcatgttcaaatctcgatgatcccccatcattatatatcatatgctcttcttgccatgcttaaatgccaaagtgggagaggagaactaagggggagggatacattaaatgaagaaaataagaatgtccttgacatgcaaaggggagactttttgttctatgatttaaaccctttggatgtgagctttttatgtgcaaaatttgtatctcaatgcttattgatttacttgtgatctttgtgtcaatttgatgttcattacctaatcacaagtgatgaaatataaaattgagaggaaaatactcgatgattcctcatcaattatccctttgctttcctttccttacttatgccttagtttttagatgtcaaagggggagaagtatattaaagggtataaagaattattataaagggtgagataattgtgagaaattatcaaaatgcatgctttgaaagatgccaaagggtaaatgagaaagggagagagaatatttgaaaatgtttatcaattagcgtgcgcatggtgtgatggattcaatgcgtattatttgatcaccatgccacatgcaaatgaaattatatatttatacttgaaattgattatgaaatttggttattcgtgctttataaattggtaccggaatcaattggcatagaatcaagtttttgcaatcagcgaatgaaatttgaaaatatagtgttcattcaattttttcttagaaatattccatatgcaatatttttagtagaaatataccaccgaatcattgaatcattgcgcgagaatgacgtggacatgacgacgcgggaagtctcgcgcgacaacggcgcgagaccgtgcagtgaagttgcgagaccgcttggtctcgcataaccaacaagcgagaccacaacagcaggtcaattcaaattgattaattagtgattaattatctaattagcgattaattaattttttctaataagataattaatcattaattactattaattaatcaatgttttggccgcggtcgttgtcgctatgttggccgcattgtcgctgtgtatccgcgcgagactgctcggtctcgcgtcttccccgtgcacgttattctcgtgcaatggttcagcgtatcaacattataattctatcaaaaaaaatactttctggatatttctgagaaaaaaatgaacaatatgttttcaaacttttgcctgcaatcaacatcaagaatttcatttgatacattttgaatcgataccaagaatttgaattgtaagtttttttacttttggtatctcttgtcacacacaacacaccccactaacgccaagagttagagggagctctcacattctaaaatatatatgcatatgagttcacttcatatatttgtatgcacaaattgaggggagctctttggattcaaaatcatttattatcaatctttgtaagctttaatcatgttgtcatcaatcaccaaaatgggggagattgaaagagcatctatgcccctagtgggttttggttaattgatgacaaacgattaggggaatagtgtgcttattgagtgtataagcaaaggattagtctggtgaagaactgataaagatgataaagaatatgcaatacaatgagttttcattgcaatccaaggccacaagtgacggaagatggctagatgtggtgaagggttggtaagacttggctacgtagtggactgatggaccatgcataggagaagggcaagcggagacttggcgccaaaggacctgacgtagtggtgaaggagcaagtgcttggccgaataccgttgaaccgatcgaggccataggatgtcacaagttgctgacgatcaatccttgttgaagaagaagtgcaagatgaaatgtcgaaagatcaagaggatatgattcgttgatgatcaagtcaaattttgtattagcattgttcaaggcaaagaaacaagaagacataaatgtattcgtattggtatagcttttcaatttgttcttgatttggtaggaaagccatactattaagaggaacgtggccttgatgtctagtgatgagtttggagctcaaaatctttgttgaagtggttctcactcttgggtttgtgtactggagttttctaaatttgatttaggaagttcccgaattggtttttgccttcgaaaaatggtaatggtctttgttagaagttctcaaaagtcattttggaaattcccgaactacttcgagtttacaaaaacggtactggtgtttttcggaatttttgaaaattgcttcagaaattctcgaaatgcagtgttggcgcaaaatcagtacgggtgttttcagatttttttccgaaatgcttttttgcccagttttctgctgtgctcgtgctggaattttgtactgttcggaaaattccaaagttattgtagcaagttttgaaagttgtttttgctctctggtgattttcgaatatttcaaaaatcacttcagaaatttctaaaaaatggaatatttgctcccatcggacaaatctgaggccgtggctacaaatagccccctccaccccccaagttaaggtggctggttccattccaaatcttttgcccttttgagccttgagatccacttttgagccttgcctttctcacttcttcctctccaccaatctacaagcttagatttcgtgagtgtacatgtgtgtgtgagtggttgattttagtttgtttgagtgcttgttgttaactttgtaaatatttgttgagatttatccccaagaaatcttttttgcatttgttactcttggtggtggaggacacctatagacggctagagtcaacctcgagacaccgatttgtttgtagtgtgccgagggagtttgtgaaggtcggatcgcacctccgaaaggaaagagatacccttagtggaaggcgaagtgcatttgtgcaacctcatgaggatagaactggaaaagacctggctcattgtgggctcctcaacggagagtagaacccccctcagggatttgaacttcgggaacacaacatcttataagaaccccggtgatatctctctctcgctcatctagctttgttatttggtgcctctagtagtttagttgttgtttgtgcaatccctttcctaattgtgccactatccccttttgcttgccttgctagtttgcttgtaaatatgagattttcaaaaaaaaaatcggaaaatatttggaaatatccaaaaatatttagaaatatccgaaaagcctagctttcgaacttacttaaaagttttaaacgcctattcaccctctctaggtgacataaggtccttttagaagtaaatgggggcatatgtgtgtgcatgcatgcatgcaaccatttgcatgccatgtgagctgcttcagattctctaggcttatatatactccatccatctatttcatttactcttccattgaagcgacaacgcaccttcaccgatgcacagtaaatggaatataggtctttagaatgatttttgtttccttggtcttgatgcacttctcttatatggtgatcaaaagtgaatgaagggagtactaacaggtgcatgcacatcgtgtagtggtatctagggttacaatactccgttctaaaataattgtttctgggttatttagcatatattaaggtttagaaaaaaaatataggactcctattaaatgttgtatggttgggactgtgagtggttgtaatacccctccctctagaaccgtgcagtttagcccatccgatggatgggcccatttatacataccacccacttacattttcgctctaacttcatgtgaaagggtcaacacgggagtgttacagttagagtaagaagaccttataagttttttgcactcttgctaaactagctatgtggtattaaaaatgagcacatagctatcatgggtcacacatgggccatccaaattaatccggatgtcacattcacccctttcccctaaaaggatccaacgttctcgttggtctaacttcatgtgaaaggatcaacacgggagtgttacggttagagcgagaaaaccttataagcttttgctctcttgctaaactagctatgtggtattaaaaatgagcatgtagctatcatgggtcacacatgggccatccaaattagttcggatgtcacattcacccatttcccctcaaacgatccgacgttctcatcggtttaacttcatgtgaaaggatcaacacgggagttttacggtaagagcgagaagaccttataagttttttacactcttgctaaactagctatgtggtactaaaaatgagcacgtagctatcatgggtcacacatggaccatcgaaattagtccggatgtcacattcacccctttcccctcaaaggatccgacgttctcgtcggtctaacttatccatgtagccacataggcaaataggcaaatatctaggaacacgtctccttttagtgtgcgtccatacgtccagtgccgatgctacatgtctcacatagagcccacgtgtgccattctcccgcgcactgtcccatacacgcgcacaactgcgagggtcggttctaataccatttgtaacagcccattctccaaaactggcagctcagctcattagatgaatgggcccacttaaatattccaccccacttacaattccgttcccgtttcatgtaaaagggtgaacccatgagtggtatggtttgaaggacaataccttataagttgattccactaggggtgaaaacggatcttattctgatggatagtagttatatcatatcctatatcatatttttttaaatggattcggaggtgatttggataatgtgcggatgcggagcggattgtttcagatgtcgaaaatggtgtggagctagtgcggactcggttcggaaatggatgaaaataatcggatgtggcatatatatacaatcgatacaatatttattcatctatacaatgagcaacaatacggtaccaatatcacaattcacatggttcatgaaagcacacatcacatcacaatataatgttaagttgttaacgattaacttgtcatctgtccaaatgcattcaattgacgcatgtagtaccaacatcaagatatatctcattcagataacagatatagaagttccacaaattaaaaatacagtaccaacatcaaagtatcacatgacataggtatcacatacataggtgatagaacattggaggcgtcgccggcaccgagacggagacaaccagccacaggcggcggccctgtggtggaatggagatggcaggtggtgacagcggggtggagatggtaggccgcagagccggggtggaggaggcggcggtgtggtaggacaggaagaagagtcgaagaaaaaattgcaatgggtgatggcagcgtactctactatgacggactgaaggttttatgacctagctagattgatcgatggataggttggatctggatgggctagatttttacacgactaaaatgctcatgccaaatgggccaaattgagtggttatatgggctacgaaattcggattatccgccaaaacgttcatcggataatccgcttaaaatagcggataatccgtatccaccggatattatcgataccatatcctcatccgcacgtcactatccacatccgcatccatattcgtcggatagctaaaaacccttaccatatccgtcggataactaaaaacccataccatatcctcacttcgaacggatttggagcggatcggattggataatatccgatccgttttgtcacgtcctgataaattcatcccgaaataaaaatcattccctaaaaggaataatagaattaattaaaattcgaaaagaaattggcaagcactaaaatacgtacaagaaaaattcgaatgtggcccggagaatttttgttaaattctccttggtctaaaaggagctctcaaattttacttgaattttcagagcaccggaaatatttattaagcaacaaaaacaattatcaaagtttattaaaaagaaaacctagaaataaccctctctttccctttgggccaagtctggcccaaagtcctctctctctctctcggcccgcggccaaagtcctctcttcctccctctctttctctccctctccttctctccctcctcttgggccttccctccccctcccggcccagcttccttcccttccctctctctcccgggcctcctcgccctcctctccttctgggccgcctctcggcccaagccttcccgccccctcccacctgggccgccttcgggcccaactcgagcggcgcccttccgcccgtgccgtgcacgtgcgcgcgcgtgcgcgccgttgccgcgcgctgacgcgcgccgcgcgtgggtcctaccgcccggtcgtcgttctcctcccgcccagctctctctctttcccgtgaaccctagtttctttctttctcaaatcgcgcaaaatcaattcccttatttccaaattaagtgggggcttttaatcccctttccatcctctttgatttcccccattttcccccttgattcgtgccctctaacgcccggaacggccgcgccattccggccgcccttccatggccgccggccgtcttttccgccgccgttccgccctctcccgtggccggctcccatcccgcgcttataaaatggaaccacctctttgcgttctatcgttttagcctcctcccgcgtcatccagtggccgcaccacttctccccgctttccctttttttttctccgaccgccgcccgcctcaagccgcttttcccgcttggcccgcgcgccgtccggttgtgccgtcgcttccctcggttttgcaacaccgtccctttcaccggcttcaccgtttcttcgccggaaactcgccggaacggtgcccccgccggcaaccagtggcattggtgccactgtactccctcaagccggctactgttcctcgtcctcgtcggtgcggcagccgtcgtcgtcgccatcctcctcgacgtcaccgcgtcgccctccaccccggcctgccctctatttcccgcgaagacctccggaagtgcatccccgccggcaacagtggcgttgccgccgctgttccgcctccggccgcctctgccgcgtcccctgtgcgccggccgacgtcgccaccacctctccctgcaccggaacgccatcctcttccccggccaagccacggcgtcgcccgtatttcgtcggaacgccgtcgtgcgcgccgcctctccctcggtctcgtcggcacccactccggcagcccctttcgctgtgccagtgcgccggccgacgtcgccatctcctccggcatcgcagcggcaaggtcgccctcggcctcgcctccccttcgaccgaaccccgccggtgttcgtcgtcgtcgtgatcgttcctcctcgccggctcgtcgtctcgcggcgccgcctccgtcatcggattcgcagtggcgtgttccacgccatcctcgtctccgtgcaaccactgccggctgccctcgtcgcctcctcgccggccccggtcgtcgtcgtcgtcgtcctctcgtcgttcccggtcgtcgtggcgttcgtccctccgtcgagccctcctcgtccgtcctcggtgtttcgtcaaggtcgctgcagcccccgtcgtcgtcttcgtcctcggctccgcgtcgtcaagcctcgtgccggccgcgtctcgccttcgtccaaggatcgccaccgaagtcgtcccctcgccgttcgtctccgtcgttccgggctgtctccgccgcgcccgttcgtcgttgtcgttccctcgcctcgtcgcgtggtggtaaggatccctccttcgctgccccgtcctcgtcctttcggtgtcgcccgtgcccgttgtgcggttgtcggccccggtatccgtgtatcggtatcggtagtcgttcgcttgtccgtgtagtgtccgtgttagtgtgcccgcttggtagccgcgttgtttccacgtgtgcaacccatgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaacagcgcagccttcctgtcttttcccggctagcgcttccacatgttttatagtcgcaaagcctaattataataatccgcaaatctccatataacagcattaaacttcggatgatcatatcttggtcatacgaactctgaatcgacccgttcaagtctcctaatgtttgttataacctaaagaaccgtgtggtttctttttatgtattgttattgcttctttataggcttgtggctttgcttgtgtgcttcgcgtagcttctgtcgttccggaggttctcgaagcgtggttcgcggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttatgaccttattattgttgttattgttattattaccttgttcaccctaggataaacaaaaccccaactagtgggtactctgttcatggttctactattatgaatttaggtagatgcttcgctgattaattaggcaacattaggtggttttataactttagactttgggaattctcatatcatttggacagtatggaatggttggcttattgtggaattggacacacacctccccctctattcaaaactcccaaaatggttttaggctgggctcgaggtgcgtggttgggttttgttagtcgtacctcgggtactataaggattaagctcgggcctctgttgcaaagcactaccatacttccacatgtctagtgggtaaggcttagtttgtagctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctgggggctcagtcctgcctacctgtcccgggggttccggccgtaggtgtggttgggtcggtactcttgtttatggctaggatgggttgggaactatgtcacgtcttccgtccgtataccgtggtggtatgtggcacgtggatacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcataggccttgggttaaggcaggttcgtgcgggttcacgaccttgattaataatactgtgtagctctaggatcgtctttttaaaatggctttgggcaactaagtgacttttaaatgctgtttactgcaaacacttaacccctattattaaccccttgtacccccttgcattaatcatgcatctgccggtgtgacttgctgagtactgtggttgtactcattcttgctcaatctttcccccccttcagtaagagaagcttcggagaagatgtcttaggtggagtcctggcttataccccagttgagcgcctgtgaagataaagccgtaggcccgctagtccgctgctgtttatttttgattgtcaggccttaagtgcctttgtaataatgtaaatattatcgatataataaaaatgtgtcttttatatcatgtttgtgtggtgtaccccggcttttcctgggacggggattaatacactagcgttcgggaaaaggcaattttctcggtcgcgacacgttttcacccctagatcccacccatactaaactagctatgtggtactaaatatgagcacacaactcttataaaccatacaagggaatatggcatgtcgcagtggtggttgcgggtagaatgtgaaaattttaaacagaaggtgattgtgtgatatttattttggaacaaatttaaataaaaacaagtattttaagacgaaatgagtatgtagcacacgtcgatacacgggttgatgcatagtttctcaaagaaaaaagtacgaacatttgacaccccaaactcttaaaaccggataaattaccaccctaactcgattggaagcggttttcagcctacgtagacacatacgtggcgatacaatcagcaaaaacaaataaaaactggtggggcccacctgtcagcgccttttttctctccttctctgcccatctctctctctctctctctccaggtgaatagaggagacggccggtgggcacggaggaggctgcgggcggcgggcgaggagccgaggccggcggcaggcagatgcgaaggaagctgcgggcggcgggcgaggagccgagaccgacggcgggttgagtaggctgcgccgatctccatcccgtgaactaagcaggggggcgccgccgtcgtctgtcttgctacttccaccgcagtcccggtgagcacccatccgccacgcacaccctcctcgtctcgtgccgccgcctcctcgtctcgtgacgacaacgccagaaaactccagctctcccccagagttcgtcgctcccacctccgtttaccgcaccggctgtcacgccctgaagttttcccccttttgcttgctttaaaaattggttaaataaatcgtccgaagaaattatcttaattaacctagagctaattccctagttaataaatgcgattaataattgaattcggcgtggtggaatttttcttgagttccccatgctccaatgcattaacaagatttttagtggaattttcagagccttgggaataattttaaccaattaaaaatcaccaaagtgcaatttttaatcccaggaaaaatcctttcttccttttctttttcttttccttcttttttctctattgggccgtcggcccactccctcccgcgctcggcctcctttctttgggccggcccgttccccttcccctctctccgggacgctgacaggtggggcccacctgtcaggtcgtccccttcctccagccgaccgcgctcggccggcaaccgccgctcccacgtcgccgtccgcgtttcccgcgcccactccaccccaccccgcgcgctgcgcccacgtcgccgcctctcccccgcgtctcccgccctcgcgcgccccgcaaatgggcgggattcgaatttgaatcccacccctctctctctccccccaccttcccacgtcgccggcgcaatagggtgggttcccggccacgtccgcctccccctccgcctataaatcgttccccgcgtccttctatcgctttttcctcttttcaccgcactctcccgtgccgtctaccgccctcgcgccgcgcacccgagctccgccgcccaccgcccatctccggccgcgcgccgccgccgctagagtcaccgccgcgccgcgtagtcgccaccgtcacgctcaccgagcccgcctgcacctcggccaccattcggttgccgccaatcgtcgccgaagcgccgtttctctcgcacgccggtgagctctccatttccacccaactccggccggccgctctagccgccgtggtcgctctccctacccctaacccctctctgttttctcctagcgtgccgccgccgcccgtccgcacctcagcatcgccggtcgtcgccgccgtttccttccttcgcgccgaccgtcg

SEQ ID NO: 44265 - DNA, 7318 bp, Oryza sativa
  unsure (1)..(7318): unsure at all n locations
nnnnnnnnnnnnnnnnnnnnnnnnnnnnnnnnnnnnnnaaggacttttctttattagtaaaaacacagtttatcttctaaaattcataagtaattcatccgagctccgtttaagtccattcaagtctcagtaaatcaagaaaaatgcaaagaatccattaaaaatacttttgtttcctgtttcagtagtcttatagcatgttttgcttgtgtgctttgtttgtcgcgtagatttcggccgtttcgtcgatccgcggtttctcgaagacgttgctgaggtctcgtcagtgtgagagcaaggcaagtcatgcaatacgtttgatcatattgtacccaatttacaaatatcccgcatttctattaaatgttgcattcttttacaatatcatgtgggatgggtcctactactcagccatttattgtttaccatatgccattgataacctgggtatcaaaatgactagatgttggtttaggaaatgcttagccatgcttagttcaactagcacacaaatggggatcaccttattacatagactttgtctattggcatagcgttagattggtgccaccgcaatggtattagttaattaaaatacactgaatggtgggctgtgggtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttatgaggggtgggggtgaaaccttagcgtggtgtggatggttaggggaaggttatgtggagggtcttgtcacgatttccccttttgcagtatcatggtgatacttcggggtatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgcaatgtggtgtagcgttggacagtgattggttaatattgattaattactacagctgttttactgctttcaactactgctttgaaatgcctgctttatgcaaaagaacccctagcttcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgctcgctgctgaagtcaagctttccggtttagctcgcttttatcttttccgctgcatttgtaatcttttccatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaacctaagagccttctgaaccccttttcatatgcatatgccctttttcacttggatttgtttcgggaaaatttggagttttgcctctttggtttgcgggaaaaatcttggtcgttctttcggatcggattttttttaaaaaaaaaaattagctcagtctagggctttagaaaaattttagttggagtttattcgacagtcagtcgggaatttattgggggttatacattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcatgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgctttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatcccctcagatggagacaaggaatggttcacgcgactcgaacaacgccagtggcagcgaaaagccgatcaatggagcacgtgccaacagtgcatctgacaacagtccgtccccaccgcccgagaacccaacaattgctcaggtgttggacaatcagactcagatgatgacaatgatgatgcaacagatgcagcaacagtaccatcaggtgttgcagcaggtgcagcagcaagcacagctgcagcagcagaacctgcagtttggtcctccacctcctcagtccaaactgttagaatttcttcgtgtcaagccgcccaccttctcaagcaccaccaacccaatcgaggcccacgactggcttcatgccattgagaagaagctgaatcttttgcaatgcaacgagcaggagaaggttgcttttgctacacaccagctacaaggtcccgcttctatttggtgggacaactacatggtgacccgtccagctggggcagaggttacttggacagagtttcgtcatagtttcaataaagcacaggttcccgagggaattgtggcacaaaagaagagagagttccgttccctgcaacaaggaaccagaacagttatagagtatttgcatgagttcaaccgcctcgcgcgctacgcccctgaggacgtgcgtaccgatgccgagaagcagcagaagtttctgtctggtcttgatgatgaattgactacccagttgatctctagagattatgaggactttgagaagctggtggataaggctatccgtcaggaggagcactgtaacaaaataaaccgtaagaggaaggcagctcagttcaggactccccaggggaagagtcagaagcctcgtttcacgatgggacatcagggtggaccttccaccatgattatccggcagtaccgtccctaccacccgggtagcttcaacaagaaccaccatagtggcagtcacaacaacagtgagcagcacagtctcaaccctactccgagttcactaaagattccagctcaatcagttcagccagctctgccagaacagcccaagaggttgggagaaaaacccgaactctgcttcaattgtaacaaacccagacacatggttggaaagtgctcgaagccaagacgtgctggacccaagttcgttcaggcccgggtcaatcatgcatctgcggaggaggcgcagtcagcaccagaggttatattgggcacatttcctgtcaactcgacaccggcaaaaatattgtttgattctggtgcaacccattccttcatttccaagcgttttgctggtgcacatgggttatctttagtgaagcttaagataccaatgcgagtgcatactcctggaggtggcatgaccacaactcactactgcccatctgtgacagttgaaattcaagggtcgatttttccagccaacctcattcttctcgaatccaaggacctagacgtcatacttggaatggattggttgacaaggcacagaggagtgattgattgcgccagccgcaccatcaagttgaccaatgcaaaaggagaggtggtaatcttccagtctccagtgccgcggaagccagggattagtttaaaccaggctgctggtgaagaacaagaggtagcagtggagaaaaccactaagaagctggaggatattcccatagtcagagagtatccagtggtttttccggatgatctgacaacaatgccaccaaaaagggatatcgagttccggattgacttggtacctggaactgcaccgatccacaagaggccttacagaatgggagccaacgagttggcggaagtcaagaaacaagttgatgaacagttacagaagggatacatccgcctgagcacgtcgccttggggtgctccggttatctttgtggagaagaaagacaaaaccaaaaggatgtgcgttgactaccgcgcactcaatgaggtcaccatcaagaacaagtatcctttgccaaggattgatgatctgtttgatcagttgaaaggagctactgtgttctctaagatagacctacgatcaggctatcaccagttgaggatccgcgaagaggatattccaaagacagcattcatcactcggtacgggttgttcgaatgcacagttatgtctttcggactcactaatgcacctgccttcttcatgaatttgatgaataaggtgtttatggaatttctagataagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctatggatccagcaaatgtggagtcagttaccaaatggaccccaccaaggacagtcactcaggttcggagtttcttaggacttgcgggttattaccgccggttcattgagaacttctctaaaattgctaagccaatgacacagctattgaagaaggaagaaaattttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattggccgcagttgttcatgctttaaagatttggcggcactatctcatcggtaaccgttgtgaggtatatacggatcacaaaagtctaaagtacatcttcactcaacctgatttgaatctcagacagcggagatggttggagctgatcaaggattatgatatgggaatacattatcatcccggcaaggctaatgtggttgcagatgccttgagcaggaagagtcactgcaacgtcgcatgggtagaggaactatgctgtgaggttcaacgtgatttggaacatttgaaccttggtatagttgagcacggattcgtggctgccctagaggcacagcccacactggtggagcaggttcgcatagctcaagcaagtgatcctgaaatagcagagctcaaaaagaacatgagggtcggaaaagcccgaggttttgttgaggacgaacaaggaacaatctggatgggagaaagattgtgtgtacccgaaaacaaggaattaaaagacttgatactaaccgaggctcatcaaactcaatattccattcatcccggcagtaccaaaatgtaccaagacctcaaagaaaagttctggtgggtcagcatgagaagggaaatagctgaattcgtagcactatgtgacgtccgtcaacgagtaaaggcagaaccccaaaggccagcaggtttgctacagccacttcagattccagaatggaagtgggaagaaatcggaatggatttcatcaccggtttgcccaggacatcatcggggcatgattctatttgggtagtcgttgaccgactcaccaaagtggctcacttcattccggtgcacactacctactcagggaagaaattagcagaactctatctagcaagaatcatgtgtttacatggtgtacctaagaagatcgtgtctgatcgaggaagccaattcacttcaaagttctggcagaaattacaagaagaattgggaacccgtctaaacttcagcactgcttaccatccacaaacagatggccagaccaagcgagtcaatcaaatactagaggatatgttgagagcctgtgcgcttgactttggtggagcatgggacaaaagcttgccgtatgctgagttctcttacaacaacagttaccaagctagtctgcagatggcaccgtttgaagcactgtatggacgaaggtgtcgtactccgctcttctgggatcagacaggggaacgccaattgtttggtacagaagttttaaatgaggcagaagagaaagtcagagctgttagggaaagattgagaatcgcacagtctcggcagaaaagctatgcagacaaccgccgaagggagctcgctttcgaaacaggggattatgtgtatctccgtgtcactccgctcaggggagtacatcgcttccaaaccaaaggaaagttggcaccacgctttgtgggaccatacaggatcttggaacgtagaggtgaagttgcttaccagctcgagcttccctccaacatgcttggcatccacaacatgttccacgtctctcagttgaagaaatgtttgagagttcctgaggaacaggcaagtccggatcacatcgaaattcaggaagatctgacgtatgtggagaagccgactcgtatcctcgaaaccagcgagagaaggaccagaaacaaagtaatcagattctgcaaggttcagtggagtcatcacacagaagaagaggccacttgggaaagagaagatgagttgaaggccacccacccgcacctcttcgccagctcttccgaatctcggggtcgagattccgtttaaggggggtaggtttgtcacgccctgaagttttcccccttttgcttgctttaaaaattggttaaataaatcgtccgaagaaattatcttaattaacctagagctaattccctagttaataaatgcgattaataattgaattcggcgtggtggaatttttcttgagttccccatgctccaatgcattaacaagatttttagtggaattttcagagccttgggaataattttaaccaattaaaaatcaccaaagtgcaatttttaatccaaggaaaaatcctttcttccttttctttttcttttccttcttttttctctatt

SEQ ID NO: 44266 - DNA, 10034 bp, Oryza sativa
aatgcacattcagcttagaaattcgggttcgagaatttctgggcgtgacaccggcgccgaccgaccgaccgcctccgtttcccgtgctgttgcttgccaccgcacgacctgtgcccatgcccgagagagagggagtctcatcgtgctctgcattccgccccagctcagcctccgcggcgtgcagtcgctgcccggcggcgccctccaccgccgaaagcaccgcccgcaggtgccagcgccgcccctccatcagcccaccgcccgtccccacgccgccacccacctccccgcccctgtgcgctgccccgtgagagagagaatagagaggagagggaggaagaggggaagaggagtatgacaggtgagacccacatttttttagtatataaaatgttgactggattgtcacgtatacgccacgtaggacaaaactgctctggattgagccgaggtggggtaattcgtccggtattgaaagttctgggtgagtaatgtctggttttcggattcagaggggtaatttggtcgaccacgatagtttaggagggtaattcgtactttttcctttctcaaaatccttgcgccaccatctccactttcttctctggaagcaaccttggaatatattagcatattcgtgattgtttaagtaagaaaatcgctagttagcatttagcaagatgggtgcatgcgtactaaaacatagagcagtaaccaacatgatcatcaaatatgttggaaatttctgtacctaatcctaaaacactcgctctcactgaactctgaatgttggtttctaaagtttttcagactgctacaattaactgacggaaatcgaaaaaaaacagagtatcgaacgcaaaaacagagttttggtgctgcgtaatatttcagcaacttttctcggttctctttcattatttatattccaaactccaagagtttgttacaaacggaaaacaacaacaaaatcgtgacttgaccgtgttaggaaaccaatgtcctatgaagacccagcccaattacccactattgagcacatcactaaatgaactttggtttgaaagtctgaaagtgtgaaattctgaacatgcagtagctaatatagatcggtcggtcgaggcgtggtaattatattgaaatttccaatcaattctaatttggttgcataataaattccgatttgactccctctcgatcggacgcccgaccgggagtcgcgtccaaaaaaattctagagtccatatagaaataaaatttataaataaccgaaatttagaattaaaaaaaggaatattaggggaaaaaagtctgaagcccatataggaatacaatttacaaatgataaaaattaaaaattaaaaataagaaaaatcagatgaaattctcatggcctagatattttcatattaattagaagaaagaaaaaaatagaatccacataaaaataaaacctaaaaatagttgtaattcagaattaaaaataagcaatattgaaagaagagactaaagtccatactacaagcatataatttagaactaatgaaaattcagaattaaaaaaataagaaacatcaaaagtagagtttagagcccatatagaaatacaatttagaaataactaaaactagaaattagaaaaaaaaggaagagtgggagaagagtttacagtctatataggaatacgatttataaataattgaaattcggaattaaaatgaatgaatattaaaaaaaattctagagtcgatatagaaatataatttacaactaactagaattaggaattagaaaaaaagaatattgaaagaaaagtttagattccatatataaatacatttacaaataactaaaattaaaaattaaaaaaaatgttagaagagatgtctagagtccatatagaaataaaattcataaataatggaaattataaataactaaaattcgaaattaaaatgaataaatattagaaaaagagtctatagttcatatgaaaatgcaatttagaaacaactgaaatttaaatagggaatattgaaagagagttagagtccacataaagtacaatttataaaataactaaaattaaaaattaaaaaaggagtgttgaaagaggtgtctagagcccatacaggaataaagttcaaaaataatagaaattcgaaataaaaaactgaggaatattatgagaggaacttagagtccatatatatatagtatataggctctgttcggcaacactactctactgttgtaaccggctgtgctgtacagcctatttatatattttctttaccatacactgtagcggctgctgttgtgcagctgcagtttagctacacccaatagacccataaatacaatctacaaataactatcacatatatacaatacaatataaatatcacacattggttaataataaaatgtaaaactatatatgctattttaagaaaaaaatataacgatactagccgcgcaatctgcgcgggccaccatactagttaaaataaaataaaatttaagccattagatcgtgatggtatcaaattataataggttttgattgacagcaataaatattttcactttcgctgggacttttgggttacttatacataataaagatttagtatgagccagtacaaacctatctctctaagagtaatatacacaaaaaaaaaatgacatatgggcccacccgcatatgaagccttagcggtttcacaacaaacatcacgtgctagcggtggcggatctaccataggggctatgggatctcgagccttcactactgacgttgaaaccatgagagccctcgtaaagcccccactaaaattttctgtcatacatccattagaagagggggctatagctttgtatagtttgttttatctctcctattagttatttctggatccgcccctgcgtgctagtacaccatcaccttataaaatttgttgcactggcctggatctgcttaagctgaattatttaaggtaaggtgacctcacgaataataaagttcaggcttagacaacctaggtgtcggtattgccaccagcggtgtggccttcttcatcacgatcccaaacttctcggacaggtcaagctgcacgccctgcggcagcttccagtcgaacgcctgcagcagcatggcaaccgagtacaccatcaccttctcccccatggccatcccggcgcacatcctccggccggacccgaacgggaggtagtccagctggctaccggtgaagtcccccttgtggccgccgtccctggcgaacctatccgggttgaaatcgagtggcttgttccagaccagtgggttccgctggatcgcccagacgttgatgagcacgcggcagccctcggggacgtggtatccgccgaccgtcgcggcggcgctcgggctgtgcggcaccaagaggggcaccggcgggtgcagccggagcgtctccttgatcaccatgcggaggtagtggagctgcgggaggtgggactcctccacgacggcgtcccggcccacgatgctgtcgagttcttgctgcaccttgttcagaacctgagggttctgcagcaactccgccataatccattccacactgttcgacgtggtgtccgtcccgccgaccaccatctcctgttcacgcatatatataacatatagagattaaccgatttctgattattgaaattttgagaccatttcggaacctgcgggatgaaatgctaatgtggagaaatgaaatcgagttgcaattaattaattaattaccaagaggaagccctttacgttgtccatggtaaaggttgttttgccgtcgctaccttccttttccatcttgagcaagcactccaagaagtccgttgtcatctcgcccccgtcttgctgggatctcatccgctgctgtatgatcttggtgaacaacaggtcgaaccgcgacctgagccgctccatcttcctccggataccctgcaggtcgaacggcttcagcaccggaaacaagtccgagacgttgggcgttccgaggagctcggtgacctctgcgacgagacccctgaactcgctccccaccgccgacctctcgctctcgcttccgatcgttcccccccacatggtgcccgtgatcacattcatggtgttcaggaacatctgcgcgccgacgtccaccggctcgccgggcttggagtggaggtaccggagggtggacctgaactcgcgccgacggaggccgtgcacgctggcgagccccgcggggctcatcatctcctggacgcagacgcggcggagcaggcgccacataggcccgagcgggttgcccacgatattctgtgcgccgccgaaggagacggcgtcgccggcatccagcatgacccggttggcgaagacggagtcctggtcgcggagcacctcgcgggccagctgggcggaattgacgacgatgtccaccttggaaccgaggcggatggagaggatgggcccgtgcttcgcggccaggctagcgaagtaggtgtgcaagtttgggtcgatgaatgggaggctgccaacgagaggaagccccaccggtcctggtggcaagcggcggctgcgccgccgggtgacggcgaggtacagcaccgttggcacaagcaatgcagcgtagagaagatttgctgttgccatgggctgcatgactatggagatgcatcactgtgagaagtagtagcagtatcttatcaaataccacgctctacccaagcgatctataaatgccactgtcagctagcttcaggccgaatttgaaaggtatcagtcgatgagaacaattgagattcttgttttgtcgacaacgtactatccaatcattctcacccttccattcctcaatctattatagatgtggatttttatccctacagggaacctcccctcattgtttacatgtcatctgaatagttattaaaaaaattaaaaaaaattaacaatatagattaataagaaatatatcactccataaatatgtatgaccaaatttaacttctacaagttgcaataaaaatagtacattaaactaaaaatagttatcgtacattcacaactatatttgttatttttgttacaacttgtagaagttgaatttaaatttgcatgtttgtggagtgatatatttcatattaatctatgttgccaattatttcatattttttatgactatttaggtggcatgcaccgaacaagaggatatccctcgagggataaaatcactttcccaatctattactatttgctcaaatcagtcgtgaaatattctcaatcaatattgatgatcggattgagatccaatgattctctttcttttttttgggggaggggggtgcggctagtgttgggcaaagtaggagggccaggatagaagtagacgatgcttaagggagaggaagatggtagagacaagaattttctacaactaggtgctatagcagccgttatttacatgtgatttaaatagttatagaaatgttaaaaaaaatagtaacaccaattgggatgacataaatctatatagacaaacatgcaaagactaaatttgattaacaaccactaaaacaaacataataaaatcagacaatgaatagtatttgtgcaatgcagataaaatttattattttaatttcttcatttgtagctcgaatttagacttgcatgtgtggacaagaccataattaaggagcaaaaagggtttatctcaattataaatactcatgtaaagtacgcaaggaagagatttagcacaaataagtaattatgcctaagtgaaaaaaacatttgatgtggttttgggttaaggggacatttttaatggcttcggatttataaactaaaatttagggtatacaatttagtagtttaaggtgtactttttgtaggaatatagatgtgaaatcatttcgtcaatttagtgttttgtgatgaacaatttgttgtgtgagtgtctgattaattttggatcaagtgttctggatgagagagtgtacccagctataaatttagagaaaattcaattcatagaaaaaaaaacaacccggtaaaaaaagatagcacaagaagttttcccttccatcaaaaaacacaggtcgtacatatttatcttctatatataacacttctgttacattttgaacaaacgacgttagactgaagtagagtaatctatccttagaatattttgcccttcgttttcctcggtgagcctactcgctgccagcctcctgtacccgtttagccactgccgcgcggcggcgcctgaatccacgacgcgcccgtgcctgctcgatctcgtgctgaactgcacagctgcttgatgctcgctcctgtgcctgcgccgctgcgcggcccacgccgaccgccgccttgccaagcctacttgtcggtctcccgagccgtagccactatcacgcgtcaccgccatgagtccgcaatgcgcctgcaccacccacaccaccatgcctgctcccgtgccgaaccgcctctttggcacttggctcagtgacgatgaaagcaaagagcaaatttaattagcctgaggataaatttctctactcggataaaatctaacgtcatttactcaaaatgagacggaaatgctacttatcaaaggaaaatcggtgacctgtgcttttaacttaagaggaaatttttgtgtgctaatttttttacccttttttcagatcgaattttctctcaaatttttagtcaaagctatagcacgtgccacgtggaaagaggtgatacaatattttatttttgcaggtctcatcggatgaaaaaaatagataatggtggacttaggtgatatgacttatctatagctagcagttatagatagttctatttgtacatgctctaagacaagatttgattcattttttctttttttaaaaaaagaacagagcaactaggtagcgcctcaaataagacaacagtatggtcgcagctgctcgaaaaaacagaatgcatcactctggtatattccttttaagtttgagggaatctggccagccggccatgcatatagaacccacttaggctgtgttttccctttaaacttctaacttttccatcacatcaaatgtatggacacatatatgaagcattaaatgtggatgaaaaaaaccaattacacaatttgcatgtaaattgcgagacggatcttttgagcctaattacgttatgatttgacaatgtggtgctacagtaaacatttaataacaatggattaattaggcttaatttatttgtctcgtagtttacaagcggaatctgcaatttgttttgttattagtctacgtttaatatttcaactgtgtgtctgtatacgtcaaaaaatttaccaaaacgactaaacacggccttaatattttagtgttcaatcttagtggtatcttgtattattcgtatagaacatgcagagcatctccctaaaactattcgatcaataacatgcttaatagttaagaaaatctgtaatgattgtcaggtataccaccatcagcttgtgtctaaatttctatccaggggcagttgaagctaggtatcaaaaccattgagataccaaggccacaataagacaaaccaaaggagagtaggagaccatatacttgtttaaaatttagagatatgtgcacctatcagggaattgtttttttccccttcaaaatacttatatgtacaaaagtaaagaattacttcccatctggatgtccgctggcatagttacttcgaccaccccaggcaataaaactgaactttcaatacattaaattaagccgaatctctaacacagtaagcacataaaaactagagtttgctggcgcgtagaacaagctgttgatatttgcgggtcgtactttcatactcctttcgatttttaatatttaatagtaccttttacttttaaaaatatatttgaccatttgttttataaaaaatatgtaattattatttgttttgttatgatctgttttatcattaaaggtacttccagtatgatttatatttattatatttttataaaacttttaaataaaatgaatgatcagtccaatagttacgtcaaatattaaaaaccggagacagtacaacacatgcaaagtgaatttgttcaaaaaggaattaacacctttgttttggatacttgttgccagatccatattcaaacttttatcacttgattggcaaattgattaataaagcatgtggatttcaccaaattcaaataataccacaaaatttgttagagagtgccaattaataccatgacttccatttataccacataactagataatgtgtcacttttgccccctttctaactctcttaccttcactttttactcctaaatatcatgtggtattaattggtactttccaaattttgtggtgttttatattttggccaaatctttatgctaagagttgaattctcataaaaatgtgatcctcgaatttttaatagacaacacctttgacttgaaacatatgtttgactaaccatcttatttagaaaatcttgtacaaatatgcttaaggtacaattaatgataaaccaagtaacaacaaaataaattataattatatatttttgaaaattaaatgaatggtcaaacgtatgtataaaagtcaattgcaccattaaaaatcggggagagtatagtataaccacataactttcattcattataaccttactatttaaaaactatgggtgtatttagttctttaggtgtaaagtttttaagtatacgggcgcacatttgaaatattaaacgtagactaataacaaaacatattacatattctgcatgtaaactgcgagacaaattgattaagcctaattaatccgtaattagcaaatgtttactgtagcatcatattgtcaaatcatggcgtaattagactcaaaagattcgtctcacaacttacatgcaaattgtgcaattggtttgttttccccacatttaataccctatgcatgtgtccaaatatttgatgtgacgtttttggtcaaaattttttgggatctaaacaaggcttatataaaaattgaaacggtaatagtagccaatactgataaatattttaaaatggaaaaaatcatttcgccatggtagcgcaatccactgaattccttattccgattgcgtgccttgcctataaatatcacctcaacacctttggttttttaaaaaggaaaaagctgcacgtacatactaacttttttcttactaaattcttactagcacagatgttactaaattcttactaacatcgatgtgtcatgctatgagtgcatctagattttttataatttctatttacctaaatcaaactgttgaaatatgattgttagtaaaaatttagcaagaataatttagtacgtgtaccggtgctcttaaaaaatcacctcaccacgcagtactgtgcagagtgcaggacttctcattttcttactttcttttcttttagggacagagtgcacgacttgacccaacctggagtggagatcagaaatcagatcgatcgtcctgaagtaatgtgcagtgcatgtattagaaaattttgaaggtaaatattattgttcgcctccgaaaatgtttacggtcaagtccacataaactaacccaaataattaactggattgagtttcctcagatttgccttctctctaacttatgttactgatatgtgggccttttacgcagcatgtacagcaccaattaatcgcagcacaaatgacttccttttttttttcattttgaaacagtccaagattgatcgatccagtgcgcaacattatatagcataatattgcgtgaattcttgatcagcaaactgccggcgatgtcttcttcactccagtgccccgacgacccggcgccatccatgaacgtggaggccgtcctccacatgaaggaaggtgtcggcgagaccagttacgccaagaattcacgcaatattatgctatataatgttgcgcagggtaccgagctcg

SEQ ID NO: 44267 - DNA, 3319 bp, Oryza sativa
  unsure (1)..(3319): unsure at all n locations
nnnnnnnnnnnnnnnnnnnnnnnnnnnnnnnagtggagatcagaaatcagatcgatcgtcctgaagtaatgtgcagtgcatgtattagaaaattttgaaggtaaatattattgttcgcctccgaaaatgtttacggtcaagtccacataaactaacccaaataattaactggattgagtttcctcagatttgccttctctctaacttatgttactgatatgtgggccttttacgcagcatgtacagcaccaattaatcgcagcacaaatgacttccttttttttttcattttgaaacagtccaagattgatcgatccagtgcgcaacattatatagcataatattgcgtgaattcttgatcagcaaactgccggcgatgtcttcttcactccagtgccccgacgacccggcgccatccatgaacgtggaggccgtcctccacatgaaagaaggtgtcggcgagaccagttacgccaagaactctacgcttcaggtcagcactccacatcggctcgtcaccatccatatctatatagttatctacgcatacggcatacgcccttggttaatccttggaaaaactaattggcgctatgcatgcatgcacgcccgcgcgcacccgtgttgttcctgcaaaagaagagcatggacaccgtgaagagcctcgtgacggagtccgcgagggacgtgtacgcgtcgctcaagccggaaaggttcaccctggccgacctcggctgctcgtcggggacgaacgctctcggcatggtgaaggagatcgtcaggagcgtcaccgaggtgtgccccgggtcgtcgccaccgccggagttctcggtgctcctcaacgacctccccaccaacgacttcaacaccatcttctcccgccttcccgagttcaccggcaagctcaaggccgacgccgacgccgacgccggcgacgacccgatggtgttcctgtccggcgtccccgggtccttctacgggaggctgttccccagcaagaatgtgcacttcgtctgctccttctccagcctgcactggctctctcaggtacgatgcgcgcgtcgtacgaacgtgcaatgttcgatcggttgatttttgtgatgatatccttgtcagttgtctagatcatgtcgttttaaaatgcacatttctcaggttcctcccggtcttttggatgagacgaacgggcccgtgaacaaggggaagatgttcatatcgagcacgagccctccagccgtggcagcggcgtactcgaggcagttccggagagacttcagcctgttcctcaggtcacgcgccgccgaggtcgtcgccggcggccggatggtggtctccatgctcggcagggagggcgagcgccacgcggacaggaacacgaccctgctgtgggatctcctctccgagtcgttcgccgcgctggtgtcacaggtgagccaagttttcacatagcgtcttcggccgtgcatgacacgcgcaatatgcattgacgccgcgtgtggccgtacgccgcgcagggggtggtggagcagggcaaggtggacgcgtacgacgcgccgttctacgcgccgtcgataggggagatcgaggaggaggtgcggcggcaggggtcgttcaggatggaggtcgcgcgggcgtacgaggcgagcctgagcggcagcggcgacgcgaggaaggacggaaggacggtgtcgatggcggtgagggccatccaggagtccatgctggggcaccacttcgggacggagatcgtcgacgcgctcttcgccaagtacaccgagctcgtcacggcgaccatggagagggaggaggtcaggagcgtccagattggagtggtcctcacgaggctgtgacctgtcagcttggagactcggggagccctatgtgtatgtgttgacttgtgccgttcagtgttacaaaagaaagttctcaaaacaaaccagttttgtttcttatgggacaaagggatgtatgaacctaagcaacgtatgatggtcatcgttcctaactcacctcctttatttttcacacatatatttcctaaactgttaaatagtgtttttttaacaaaatttttctataagaaaattgattaaaaaagcatattaatctattttttaaaaaaaaatagctaacacttatgaatcgtttcgttttagttccaacgtcatccaccgaacacagcctaatgttcgtgataacatcacctaattcggtcattctgaaagagtttaatggccttatcgaatgaagagccccccgtcatcaaaatttctgactttttaaagtcagtttggtcacttaattcttttggtatatatttaaaaaaattacaggagtgagtatgtacggcggaaaaaacatactcatgcattttcatataaccaaacatccagactacacatcttagacaaaaaaaaaaaaaaacctttggtcaaaataagtacaatttgactctatgcttgtcagggagtcattcctttttcacaggctcactctatgcctcaccagagatagtcaatacttttttcaggaatacgccacaggcgcattttttctattaagagaaataaaagttatttacaattaaagatcgaaaaacagcagggggccgatactggaagacagaaacaaaatggcctgggatttgtgaaagaaatgatgggattgccgagtttgccgcccgccagagcgccgcttcctccgtcattcccttcgcaacatcgacccagatagtcaatactcaatactctactaatttctcacctagaaaagagttacttaactccgacttgcttttaatatggtctgtaactaaactaagttttggcactaaataaaaattatcctatactttcgacataagcaggtatttttctccgagcaataaccaattagagagtcgaaatttcctgtcaagactcgctgtacagtgtctcaccaatttgaagcttcttccgcaatttgtagaaacctcattaaagatcatgagtgatgttcttcctcgttagaagatcctgttttcgttgatgttgtttgaggaacagtcggatggctgtacttcttgaagacccgctcttggttttcccgccaccattcttcagcctgattctctgcaaatttcttcttgctgtccgacaaatttaaggagacggaaaattttagatggaaaggatgtagcagtttaacatctagattgcagcatggatagggagatgtacctgaaccggacccgcttgaatactttgctaccatccttcagctggataagtgtgacatatacaccaggttcaaactgctcaattaattgaacttctccatg

SEQ ID NO: 44268 - DNA, 11031 bp, Oryza sativa
agtaaagaaaataaattcaatagagaagaaccctaataacatccaagatctgaaccacaatattatcaaaaggattttactatacctcgttatcaagaaatttaacaaactcgaccacagcactgcatctagtatattcttccgtggccatagagacaactgttttagttttcttatctgatatctgaagctgctcgtgttgggcctcgcacttttgttttaagctatcaacctattgaaaacacaatggtttatcagaatagctagctgtaacaaggtacagaataaacagcagtttcattcttgcctgagattgcagcttcaacatttcttgattcagcaattcgttagacttctgcaagttatctatatcagttttagggaattgcgggattgcaggtgcaggtgattttgttttctttgtgtatggagatggtgttgagagtgcaggtactgcaggtgacatagttacagctggtgacatcgccgtgggttgaagagcagagaagctaagatctttgaactgtagcaaggaagaaatttgggatgctctcatatcatttcttgcagcttttacctctgtatacttgactgattccgctggtgctgttgtcctggaaggccttatttctggcctctcaagcttctctctcccatcaatagagcgacgagtaacagcatttcttctgttagaattgttgctgccggtctctgcggctttcaattttagaaagcatgaatcacacacacgatgtggcttgcctggagttggtgctagagcagccttcaacacttttcttgaactgcaagcatgacaatgaaccagcccacagttgtagcaatcatgtctctttctagtgaaaccaaatgcttgcctgcaacccgtgcagacagattgatctgcacctgatacccacttatgtatgcaaatacatgttgtgaaatttgaaccacatgatatactcttgacatgccgatctttaagtgcttcaacaagacatggcttcttcctgtccttgagatcgccatgaccaagtcttccattggcacccattccccatgtatatacttcacttcttgaagtcaaaactgtaacatgagaagctccacatgaaatctcttcaaccaactcactagccaatctatcttgaactaagcaaggctgcttgccatcagattttggatttccaagctggccattgctggaactacccatggtaaacacacgaccagatgtagctagggcaacagtcatattatgtccacaagccagctgatgaaaattgtactctaaaagcgcttgaacacatttaggaactaacctaggctctttgtccccatggccaaggcggttcttatctccatcaccccaggtatataacttcttagacatcacatttgcacctgtctgattagtaacctccacaattgctgcagaatgccaaattccacatgcaactttgatcgttttgaatccactcaaggcttctacctcttttgggtatgctaaagtttcacggtcaccatgtccaagaacaccaaatgttccatcaccaaatgtgtaaagttttccacttgatgtggtcaaagcagaatgccatgagccacatgcaacagatagaacttgaagaccttctaaggccctgagactttctttggaagccagtagctaacttcagtgccacacccaagcagtccgacattgtaagaaccatccccccaattaaatagatcaccgaaagtagtcacagcacaagtatggaattctccacatgaaataagatcaactacggttagtgataaagactcgacaagcttggggcgactaatatcagcatcagttccgtgacctaggcgcccaccaaattcctcaccccacgtaaacacctctccttgcctggtagtaagagctacatgtctcgtaccacatgctatctgattaacatctaacacgacatcagattctaaaggtttggggatcaaaacatctacttttgagcatgaagagcttgtgtgcccatctgatggggttacatcagtccatacttcaccccagacataaacatcaccaagggattctatgtcatctgttccagaaccttgactgtaagaactaagggcactagaaatactaacccggctactgtctgcagcacttgttcttatcatatttagacgatcaaatcccacatctgattttctgaaactaaatgaattggttccacagtaaccagctgagttaaaactgcgtgaaatatttgaagcaatatctagtgttgaatcataggaatggcgatcttgataataagttacttcctggaaaaaagaaggaaggcgcactatattagaatatttgtaaagacttgctgtctcagaatatactatacatcctaattatataggggcttataattctcgaagaggagcagagttagttgatagaaagaggagaagagttggtaaccaaaatctagatagataaaagattcaaagtggatacctagctcccacatgttacagagcggagtagagtacataactaaaaactagattgatcaaagtaacattttaatgatgtatgcttttagtatgtacatatatttttttcagtaacaatcatagaattttggtggatgagttaattgttcagagcaaaacaaaaggtagggagctgaggcagtcttagcctggactcatcatcctggaaaagtttatgttccatcttgtctagagggtctgcactcctaaagtttaggtgcttttgtttcatgtacattattgtaagctagtaacccctacttttacttttgctgtataaacctataactttcattataaattgaactaaatttcttttctcgaaaaaacttacggtattatggtatttgtgcgttatatgcatatctacgatgcttgagtcattttttccttctaaaatggtaactgtatagcaaaactgaaccatgaatatagttgcgtacagaggcacagaaattcctgtaggaaggtcgagcataactcacttcagaaaatgatactctatccttgtgttcgttaatcaaagattttttgcggaatgaacttattaacccctcaagtgctgaaaaccagacttcaacttcagcttgatccttacaaacctgcagaatagaaagaagttcatactaggaatgtcctctgcagtgcatgctatcatagactcaacctatgctatgaatcgaaaaaaaataagtatttatcataagctaatgattgggacttagattgagtgaattacataattttatctttaccataccagatcaagtgagcgttgcccgtttttaaatatgagggaaaatgataaataatccttctcagggtgtaaaaacctcccaaacacagcctggtgaaaagttgattagtaggatagcaaggtaccagcttgatggaagtttatgctcttttgcaactgttgttgtttaaggatatggaggacttacagttctctgtccaggaatgatcttagtgacagaagacagtctgaggaacttttcctttttgtgagaaaaccaaattaaagatgtttcatcctgcaatacgtaaaggtcaaagggacataatcaaatttggtatcaccgacatcaagcaatcggcacatacttggggcttatcgcttacgctagaaagtctgaacgcacggatcttgggttttcctctccggctatacttgatgagtttagtacctttctttaaagtaataagggccttgagaatattaaacatggagcattagtgttagccaatagtttgacacatgcacgcacaaatacaaaaggagatcaataaagaaggcatcacaattgtgtctagaattgtacagtttcatctggtgtcatctaaacagcaacatgtcaacatcctattgtcagctttacacagtcacctgcataaaaataaacaaaagagaccaagcttgagtagcagtatctgtgtatcacaggaaccgatcaacccacccgccctccaaatcacatttgcattcagcaatcagagaaataacaagtaggctgcacagatggaaatgtctgtagtttgcacttagtttttccccctaaattcgaagacatgcaggtgctcggttgaatcagaattattactttttgaacttttgtacattctctcttttactctcttttctctctttttttcctccaccccccttcctcatgtaccttacactcatttatatcgatgaaatggctgactctaccttcttacgtaaaaaaaaaaaaatcagaagaactcacatatttgcgccggccagctagcgtccgagtctacctgcatgaacccccaatccccatgcatttcaatacagcattatcatccgcaatgacatacaaatttgcatctaacatcatgacctaattaatcacaatggaatcaaaagccagacgaaacagacatcagagtgcagggagacggctcacagattaaaaactgggggatttagactccatcgaaccaaccaaaatgctagcccaggcatccgctgcgaggggctgatctcttctaagggcggagacgagattagcggcttattgggcggaggaggaagaacacagggatggttggttaatctgcgctccgtttggtccgaacgccacgaggacgaggaggagaacggaacgggatggattccacgttacgggccaactgaaacgtgtttcgctggatgggcttgggcctaattagatctataaggcccggtacatttaccactgttttacatttgattaggtctattttccacttgtagaaatcggaattctagggtgagataaaattttgagctgtccaaaaatggtgcttaattgttttttatttgtgcgaggagatatgaatttttattttttttgtgtgaaattcaagttcaataaaacataatacaaaatgtagctcaactagttaggtttcttatgttagaaccctagattcaaatcatatatttgatatggatgctcctatttacggctaattattattttagtagtaggtggcgtacctatcggcaacgatgcgcatgtgatgacttcgtcaatatcaagatatgtcagtccaatatttcggaagtgctcgtagggataggatatgtgtgtgtatttataaggataagagtgtgtgtacattcatagccaggatggtgcaaacatgtcgtacaccttcctcacggacgaaccaaatatctcggacttgccctaggtgtcataaacattggccattgattgcagtttaccaacagcagcaaaacaaaattatcatctcaacttgtacatatatgacgtggccattgatttgttgttcacacagtttggcgagaagaatattgcagtttacaaacagcaacgaaacaaaactatcatcgcaacttatacatatgtgacatgtcataattgataacaagaagtgaggctcaatgtgcatagctgaaataattttgcacaccaagtattcaaggaaaaggagggaatcaaattaaaaaaaatccatcatttgcccccctggtgtgcaaaactttccaacatgtttgaagaatgcagtttgaagtacagcttccagtaccaacatgtgaagactgagccaaaactgtacaattcaccataaacccactctttcaagaatccaaaccatggcaaaaccagctgatcgatcaatcattcactccggttttgatcatgcgagcagcaacggtgcagatgaatcctggcctctccattttctgctgtagtaagcgtagagcgccagctgcattgctcccaggataagtccaagcccattagggaactgaaaaatcaaaatggttaaaaaaaaaagaatcaagctgtcagtacaagatccatcaagctcataaacatgcatgtcgattcaagaaatgaagtgatttaaagcgatacaagatgatgctcacataaatgaagaaatctcgcagcagcaacccatacaatgcaaaactggcgctcatcaagaacgtagagagtgacagatagaacggcatgaactccacagactctgaccgaatcacaactccctgtagacacaaggatggatggagcaagcaaaggttagtgagatccctcagttctattaaacatgccggagatgatattgatcaagagctcagcttgatcgagaggcatacgtaccatgacagctaacggagaagcgaacatggagatcagcgaagccatgctcacagctcccacaaactgctgccgaagcggttgatcaaagaaaaagacgctcgcatgtgaaactagcgcaaacccgcaaactaccagcaccaagagccctatgatcttcatctgtggaggaattggaaaacattatccatcatcttttcctttcttgatggcatattggcatcagacaaaattgaaaatgtacagtactaggctactacattagcaatctattactgcagtctacaagtacatttttctgagacaaaattggttgcaggatgggaagaattaccctcgtcttcctgctgtccgcgtagaagatgaagaggcaaatgtaggcgagctggaacaccgctccaatgccgttgacggtagcgacgagcagcctgccatcggcgacccagggaagtccataccacaggcagatgaggcaattcagcagcgagaacaggtaagggagcccgtcgaatcgctcggtcgatttggccttcaggatcctcttaaacgtcgtcctgaaacaaggaaaattcagttatgaacttcggctacgaatcaaaggatcaagaaaaaaccaaaccgaacgtgtgcttacactggcgacaggaagagagcaagcgcaaagatgttgcctgcagcgacaaaacaaaaggaggcggccagattttcagaagattagcaagcctcttttcgatccagaccattttgcgataggaacttaagaagaattgtaagtgcgagatcgaaatgaagttccgtacctgcaagaccagcagcaaagcaggagatatcatacaaggagtccatggttgttggatgcgggatgacacttgtatcttcccttttctcgtgtctgcctctttgtgctaaaattccgtggctattataaagggcagcacgagtcggtcagtgagagacacaaagcgccacagccaccagttaaatttttgagtaatcattaagagtttgctcctgagaatatccctcttctcctttcactcatatggtaatactgcaagaatgaacaatccctgtctccagtaaatctcatgatctctgtatttttcttctgaattccacggagtgattaatttcgccaaatgcaaaattacaccactcgctggcgaaaagcacgttgcgagggtttctgtcagcaaggaaattaccgtagttactgcagtccttttactacgtagaggactatcgttttccgatgatataaagaatcttcagtggcgtccgggtgaccgaaaggctggataccaggatcgtcgccatgaacacgaatcgaccatgtcgctgtacggagtactatagtacacagctcgtggctgttagagctttggatggttggatggttgccacttgctcttgcaaatcaaacaatccagcgaccagtaagcttgcacggccacaaacggctctggaaaactgatgattagggcgaaatattctggttcacacgctgtgtcatgtcacctcttaaaaacgacccgctaaaatctagtaggatggaggaatgaaaaattacggcccccgagttaattaggaccaccagactgactcagcgcagacgtgtcatgcaattttgtgctcagaatttccaaggaaacgtcgttaatttcattaaatgttactggagtaccatgtttcagacaaaaatacacgtataagaataagaaatcaccatgctactaatatattcatgctgctactacatttttgcacgtgacgttcaagccgacaaggctgtagctttcttgcaccggtaggaggtagccgctgcagagacgctatcattccggaccgtcccctttgttcaacgaacaaattgtccggttttactaaataaaattcgtatagcaaacaccatgtggagccatgaaaacaatggcacgatagatgccatgccaggattttgacaggatgacacataccgggcagggaagtgagcagaatcaatgaatgtaacccacacgtctcattattttctttttcatagtgagtagtctgatgtgcctgcgagctatcacggagcaagactacacaatggaacacctaaatagtttcaacgttactcctttcaaggtgaccgaaccatagaagggggcaaaccggatgacaccccccccccccccaaaaaaaaataagtatgaaacagaaagaacaaaatttctttgctgacgactcaactcaactcttatgctacatgaacataacctagatgataatagacaagggtgtagatttcagagtactacgcgactcgagaatattaaccacaaccaaggggatgtaactttgcacagcacggtgtagaaacatgggccagagagaaacatcagctcgatgttatccattcttcaactccattcatatgagcataaaccagactagttacaattaccatcagctttgaacaacttcgcgtctactgtcttcttggcttccaagttccaacctggtatgtgggaaaaacaagagaacttttaagacaacatagaagattagaagtacatgttattctcagtaataaatactacgaaaccaaaatagtaaataaacatcttgtcccattagagcaaagataataagatgatgtaagcgggctctacatgttgcaacatcatatttgtgcttatgtggagaagaaataagaggagatgaaaggcgggctacagattgcagctcgtgctccaagaactgagagaaatatggagtgcacaataatggtgcagtatacgtatctatagttaactattgtatgagtggtttattaagttagctatatatgatgtgttattttttagagctaatagttggctatattattaaacttgctcttagtactttctcagataaatcatctgagcccaagaaaaattccgatttagtcatttcctatacgattgtcatccaatttcactttgacattacacaaatttgagaggtttggtatccacaacctcaagcataccaagcattacagctggactgtatctcaaatggaattggccagctatgatagttatccatgttatccacaagtacaaaatagttgttattaggaacagaggtaaccattttaaagatgaggggaaaaagagcagagaaatagttcagaatacaaaaggtgcatcctcgtattttcatgtggtagacatcacaatattgctggtagcaaaatggtagggtaaactttagtctctttggatgccaagttggattgccaacagaacataattacgtgtaaaagtctaagagagatcattcagctattttggaaattaaaacttgatttaaccaaatcaacagggaaaacaaattagaacatgtaaaactccaatcatgttcatatgcatagcatgactattctccactaagatgtaaacttggggcatcatgttccatgtgcataacatatatacaacagacaaatcaaataaatcatgtgttttcaatttctcgtagttacagtgttaccattgtgcatccttccttagtttatcagcattggaacaaacactgcttatgaaatgactcgataactataccgggtatctcgtttcttaagcaactaacagattctctgcaaacaaattgactaacatatagcaagcatatccaaatattcaaaactaaaaaaatatgtccacgtggcatatcaaaattgatcgtaatcatacagctagttttatcaaaattatgttcagttagcttttactgacactgggcatctgatttcaaaaggtagttttagttttgagttcactgtcctcttggtaaggaaaagcaaacactaagaaaactctatttgatcagctagatgttgcaaccttaaacagtccaatgatttacagaagcatttacaagaaaaaatgtattgacaatcaaattaaaaaaaaaaaggcattgaaaggttaaaatagcatgaagctttgggagattagttgacaattgtataactgtattctctaatatggtctgataagccttacacaaccttaagtcatcagtcattaacattcttcagctcccttctacaggcacatcaggagactgaactggacagttttttagaaacaaggaaaagagggtgtcctgacatcattgctctgactaggttaaaaatatggtagccatttgaaaaaacaagcagcaaagcacacagaagcgcaaagtgatgcaattataaaacatatagaataatcttgctgctaataacattagtcatgaataaaaaggcataaacgcagctatagtaccaccttcattcctacaaaagaaatcaggcccggtgcttatattaacaaacatcgaaatagtcctagagcatgagcaaaggacagaaaattaaaagaaacaaacaatttagtaaaatatctgttattttaagcctccccaatgacatctaacagtaatggtaatgatatattctttccacaaagcatcatcatcataaaaaaaaaagataaaccatgatacagcgatacagaccttaatctatctctccgaaccagagaacgcatcaaataccccacagcaattccaccatgttgcccgctgccctgctgcagccacagccactgcaggtccccgggccacctgcaatcataagggaaaaaataatgaaccaaatgagacctctcgatttcaaaacatggggaccgatggcatagcactcgatcgcgaacagtaatacctctgtagtatcagctgcacccagagaccgtgacacctccaccacatccttgaccaacaccccaccgctcttcgtctccgattcctgcaccgcaggcggcgcagccgt

SEQ ID NO: 44269 - DNA, 23790 bp, Oryza sativa
ggataccgcagccgcctccacgatgagcacctcctcgccctgcggttccgggtcatgcatcggatgcaccttggccaccaactcctcgcgcttcacctccggttcctgcaccaccacaagcgcctccgccttaccctgttgctcctgcgcacctgcggcggcttcgggcggcaaggcgtccaccatgacctcctccccggcctcgaccacctccacgggcacctccgacgtggcggccttcctctcctcctcgtccgcctcggacgcggcggccctcggcgtcaccatctcctcggagctctccatggagtcctcactcacatccactgcacccacacaccacagcatcagaaacacacacgcatccatcgtaatatagcggaagaaaggaagcaatcaaaagagaaagaaaaggcgaacagctcgaaagaggaggtgggaacgtggccggagagccagcgaagagcacgggaatgccaccctcgccgcaagagggagtggggggaaaaggcgattcctctccccgctggtgcggaaagcggcgtgccgtggggggagacagatctacacgggcttaaagcgggggacggggagggaagggtagatgccatccataccatgaggaacgtttggtcgcgacggtaggtggtggttgccgtcgctggcggcgtcgcggcggcggctggagtcattgctgccgttttcggcggcgttgtttttgttgttgttgttgttgccgccgtcatcggagccggcggggtggtccccctgctgcttcttcttgagcttggcgcgcttcttggcacccttcggcatggcgggattcgacgggacggcgcggcggaggggagcgaggcggcaaggaggggaaggggaggcgaggcggaaagaaggaaggggagaaaagagatggatttgattcgatgtggagggagggggatcggctcttttttttaggtttttacaccgatgacgcatcaacctggttgtttttttcaggataaaaaaaatatcgatatatactaacagcacataggcagcccgttatatcgatttttttcgttaaaaaacgatttgttttactttttaagttcttttgttttttatctttatattttgattgtataagactataatacatcttcacaatctttgaatttcgtttttttagtttagtttatgtaatgtgcaattatagacagtttcttataaaaatataaatacaaattatagtgtagttatatttaatagcttcacatttttttaaaaaacactctataacttacctacaattacattgtaattattatataaattttaaaacttgtatggtaagtttcaatatttatatgtaattttctaatacgcaatgtataagagaattatgattaaaagtagtttcacgtggaagaggggatggaagagatggaagcatacatataaataggagagaaaacaattataggaggaaaaaagtgattgaaatcaagtgaaaagtgtagcgtcatatttttaacaaacacgttgtaaaaaaacttataatatacttcctctagtcaaatttatttgacatcagaaaaatgaagttctgccaacgtgaaatatttttaactaggaggagtatatttcttttacttcatgtgtactaagtttttacttctttattgttttattgcaaaactacatatattttaataagactatctggatggcccgcataattttgcggctagctttcctacagaattatataatttttttacacatggttttcttttaaaaaattaaaacagtcatcttgttgttttaggattttaaaaatcagataagtctccacccccttacttctgtgccacgttttatttggcctaccatgactccattttcatcctcattgagaccttttgaaaatcagatcttagtttttatagtttattgtcctatagaattcgtctttataatttttataaattccgtcaaatgctgccactgtactccttccccctccccccccccccccggctgcacactcttattgagatttttaaaatcgaatctgatcattattgttttttttttactttctagaaatcatgtcaactgtcgcaaccctatgccttcacgcttcacggtctgcccgccgccccttctcttaatcatcattcgaattttattttatagtttttatatgtctcatcaaccactaccaccctacttcattacgcctcgcccgacgccctctttcctctgtttattgttattagctattgttgtgttttagatagattgttgttttaatgtttctttttttattatgatttattattatttctaaattgtatcttttttacttgaactctcatttttttctaacattggaacttattttattttttattttgaattttaattaatatcgttttgtttcctacacatactgttttcgatatttcttatttttatttctaaatctcattcctagttgaactctccatttctttttctatgattaatgtgagaatttctagtcttcacatataataaaattatacaaataaactgatccctctttattgactactattgttattttttcacatgagattaatgtgggcctaaaattattgtgcatattttagttgacaaattgataaaatatactgcataagatggatcggcgcatgtggtcttatagtggcagctatatgtctgcatgaacttggagtgtagatgaacttgctttggactctgctttttccccttttcttgctcactctgaatcggagacatcctaggccaaacactgggactctgactctatgtacgtatgtacccgatagagtttgttttatagtatattttctattcgtactggatatagtttgtgtcatagttttttttttcttgataaatctatgccctttaatctggatctattacaatctaatggtgtagcttttttctctctttctccgattaatgtaggaatttctagcctccacggtgaacgtagtgctttcttttaaagctgtcttaataatataattttatgataaatctatgccctttaatctggatctattataatctaaggtgtagctttttttctctttttctccgattaatgtaggaatttctagcctccacagcgagcgtggtgtcttctttcaaagttgtcttaataatataatagattataaaaaaatgaagatttaaggtgttgtataatccattacagatttagcatcaaatttattataaaactatatatttaagactgagtatcataaaactataaatttagtgataaaactatcacaaaactataggttgagaaccaactaaatcacaaaattagaatgcttatagctccaacagaatataagtgctagggatttaaactctaaaatattttagttttttttctcaaataaatgtttttttagtgcctacgtgatgttctccatataaccccttgttacaatcctttagaattggaattgaacgagtagtgcagatggactagcgttctacaagtgcatgggtggagccaggtgggggcagcttaggatcgagccccacacaccgcaaaaaaattgcattagcaaagtactaattttcagttaaaattttcccaaaaaaattatattccatggttgagccctatgattgagatattcccaccttcgctcttgtacgtaagtaaagatgtcaaatgagaagaattggttagcaccttcatctatgtttcggagagtaatacaacatataggttgtttggcattgtggtggattctcataatcacactgagtccaccaacatctaacatcttttaggtggtgtaaaagtagttcataagcaatagaatatttcattcagccacctattatcattgtgcaactaatccatatagaaaaaataataaaagatacccgtatacatatggtctacccatataaaataaattatattatctatctctactcctctctcttctcctaataatatattgtatatatatacatatgatatattgtatctatatacattatggagattgctatgggtaaaaactatttatgtgggttccatctatatggatcactttaccatatacattggtgcccttacgcattttagcattggcaaattggttttattttaacatatattgtaaatgataatattgttggagtttagaagtataaagtaatcgagtaaataatcaaaagttcaataacatattttatatataatcataatttgatcagtaaaacaaagaacaacagttatagttttggttttacagaaacttaaaaaataagcaacgcgcatcatagcaccgcaagcataaattgtaccattgaaaggaatgcaggggatcaaatttgatgtttatttggggaaccattcatgatagttggattcaaccgttatacaggctgagttcgggaggtggagttgaaaactccacctaacctcacgggaaatggtattacacattaacgcataattaattaagtattaaacattgaaaaataaattaatataaacttttctatagaaagcttttataaaaaacgcacgctcagtaatttaaaaagtgtgcatgcggaaaaaaagagatatgagttgaaaaagaagggaaaataacacagccatagttcgattcttggttaataaacaattcacgccaggaatccctatgaaacaaacgaaatcaacataccaagggttagtagtacgtgattggaaagaaatatacaccagagtaaactctcacaatactatacttcctccataataaaacaaaacctaggtggggatgtaacaaccatatcgtccaaattcgttgtgctagaacaaatcacatcctcttctagattaaggggatgtttagatggagactaactttaccacaactccatttgtcataactatgacaagcacacaaagtgtgaccaacagtttgttagtcacaactatggtaaactctgcctagaaaatgagagtatgacatgtggaccaatatgctaataaagtatggtttaacttaacttgtggcactcaaccaaatactaacctaagaaattgtgccacgtctaaagtttgttgtgctaaactacagtcactagccaaacagatcctgagtttttttattttgggactgatggagttcgtaacatcgcccttgaactaaggggttgtttagttcccacaagaaaaacatcgaatgtttggacatatgcatgtagtatcaaatatagataaaaaaactaattacacagtttacgtgtaaattacgagatgaatcttttaagcctaattacgccatgatttgataatatggtgctacaataaatatttgctaatgatggattaatttggcttaaaattcatctcgtagttttctagcggaatttgtattttgttttgttattagactacgtttaatactttaaatgtgtgttcgtatatccgatgtgacacgctagggcaaaaacttttgccaactaacaaggcctaagacctggtttagttcccgaaattttttcccaaaaacgtcacatcaaaactttggacatatgcatggagcattaaatatagatataaataaaaactaattgcaaatcgcgagatgaatcttttgagcataattagtccatgattagctataagtgttacagtaaccccgtgtgctattgatggtttaattaggctcaaaagatttatctcgcggtttccagacgagttatgaaattagtttttcattcgaatccaaaaacttcttccaatatccggtcaaacattcaatgtgatacttaaaaatttacttttcgcgaactaaacagcccctaagaaagaaagaaagcagcaagcattgaaacaaagggacatctacggtctggatagcatttcgtcgagttgtgtttgaattttccattttgcggggatgcagagtggacaccaggttaccacgcctgcatgtggcacggtggcacctcaccggacttcgcctcttgtactcacaacattgtactatactacctgtactttagtactttgtttgaatggagtaggtgtggatttatctgctgtttatataaatttaggtgctgctcagctcagcgctggctgcggctgcacaaccacagcagagctctactattggctattgaattgttcagggccaaaaaagtgaaagaaaattgcttaaatgtgttctgaacccttattactttatcataaacacgtttatttcaacataatggtcgctgcaaccaactgcaacgtaagctaacgcctacattgacagtcgattaatactcgaatgacagggacgatgacatttcaacttgggacgaggcaaaacagttcttccgtgcagaagatccggtgccttgtgctactcgtattattgtgtttagatgctggctgtttcaaagagagccacacaattcagagcgctacggaaaacaccaatttgcacacatgccgacagatggatggctcagataatacgaacgtctgtttcaacgtggcccaggcatatgagacttctcacttctcagtgatgtgtgtcatccatggggtaaactggatccagagactcagctgtcagcccgtagtagcatgaaggtgtcatcttggcaggactgggtgtccaatcaaacgaagagatcagaggagcaccgttaagtattgatgccaccaccattgtttctcctttgcttcgttcaaatttgaagtgaatttgctttgtctgtcgaatgtgttctgaaaaccacttttgaacccttgaagcgccaagaagtagtcatagcatgatgactcgatgcttttgtcatcaactgtttgagcatgttcaacttgatagtctcagcgaaactggacaaaaaccaacttgccgatcaaaaagatctgagtatttgaatctggcattattttacagtatgttatcttttaaaaatatctgagtacaagattccgttgatagttctcttttaaaaatatcgattctgttcagcaccgattcaagatctggtgatctacacgagtattttagtatatatgctctagtattcaggtagtactaaacttgttcctagtaccatatggtatatgcaatgcacgtcagtatgcgttcggtacggtagtacaaattaatttccaaaacaaattgagtattacagtattcaatttcaaattaacaatgggttgtgcaaaaagaagagaagagagagagagagagagagagagagagagagagagagagagagagaggggagggagggagggaagaagaataagaagattcaagatgtccttgaagtttgaaaaggatagggaaatggtgtagtagcgtgcagcttctgctcatccgtctacgttccatgttgcacgtatcatcacagagaatggatcagatcggacctacagtaaacaataataacgaaaatgacataaaggaattcctagcaacggaaggtagcaaaatcaaacattccattaccattgttaattaggccatttgttcgcgacaaataattagctatattttctgtcaaggtcactttatcataagagcaggtttaagtttaatagtatagctcactactagctccaattcatctatagctaatctaatagctaattcatacaatagttgcttactatactattaatatatggtcccacttatcatacacacattatatcttggagatctgtagcccgctgcttttctctctcatcttttatctcattaaaatatgtttacagctggctaatagcatgctattttacctgctctaaagcaagaactaataaagcagcctagcataagcatcacggccatgatcaagacaagtagtcatactatagccttcatagattgacacacacttcgagaagtaccaggcagcagagaaatgagaagagaaacttgttctcatggaatttgtgatgatgctgttccttttcatttgtcgctgcttttaagcgatgatgtatccactgttgcattttcatcattaagaaacattttgatgatggtgcacaagatgcatttactcgtctatagttgatttgcttttagctcggcaagaactaaggtttgttcgaaacgtaggattaaacaaatataaaaatataataaaacataattttgatttcaatgtaagtgaaaaatacatgggtgcaaattaaaatagaaggaaaatgtagaagttgttatttgaatacaccaacaggaaaaacacacaaatcagatgagagagatagaaaaaaaaactttccaagaggttgaagctattactaactttccttcaaaaatctctatatgaatgtttattctatagtaatttcaaaaaaaaaaattagtacttcctccgcatctagattcattaacatcaatatgaatgtggaaaatactagaataacttaatgtggaaaatagtagaataacttatattgtgaaacggaggaagtagtgtagattatctaatctactcttttaactgtttaacttaaaaccatgaatatgctaatatgaaattatggacgactaaccgtttcctcgaagccatggatgttgatgtagcctcctaaatcaaagtggaagtagaggttgcagacgcaccttgaaccacctctcatattgtctgtgtagaagaacaattggcatcgctagcttgagtctagataaattgtcgacagtcagcggggtagcggtgtccttctgatcgtcacctgcactgctctagaagtgccacacgttctccctccagcgtcttatttatcaaggttggaacattggaatgaacatcataaaaacagtgtcccgtttcacggccggactctctttttaattttgcgctatggaagatcgagggagatccacaaaagatggaaactattggtgcttctgatcattgcatgtttagtttgaggaataatcgtgaattaatcacgttgatcacgtatggcaataggcactagcactactggagaaagtatcttcaatcacggttcgtaacccctgtagtcccagttatataatcgggaccacaaatttttagtctcggttggtgttagcaacctgaactaaagtttttttttctttttttcattgtttttaactgcttgcatattgatttcactacatccccaaatcatagatcaaatacatcataaatttttaaaaaatcatcgcaaattcaaaaaaagcatcacaaattctcaaaaacaaattcaccacaaatcctaaaaaaaacaaattctcctctggtcgagtcgctgtcacttcactgccgccgcccccgcccggccgccgccgcctccctcctgccggatctggcgaaggggagggcgaggccgccacctcccctgcccggccgatgcttcttctcccgctcagccgccgccgcttctcccgcccagccaccaccgaccccgcccagctaccacttctcttggccagcctttgctagagagagagagagagtgagtgagtgaagagaaagaggatcgagggagaactagcgaacatatagagatcgagagataaagacgtgggtctctcggtctcgagagagataaggacgtgggaaagcatcccgaggtaggatgtgagagagatatttagtcccgattggtgatatcaaccaggactaaagatcccaggcgtcctgacaacgtctgacataaatataaccaggactaaagatcatataatctcgttgcacttttaaaccgggactacaaatggtttttagtccctgtttttttgttggaccgggactattattggtccaacccacaaaagatgatttctccaaaagtgagatggtaacagcgttgcatgactctcctccagttttcatgttgaaagatcaagatacccatcaagttatttcaagtgctttcatagaaatttttgtaatactatcgaattgttctctaaggcaacgttcgccttttatgaaaaggagaagatttgtgtcattttttacgtgtccccttctcaaattgctatgcggtgtttttttttcaaaaaaatcttagaaaagttactttaaaaatcatattaatccattttaaagtttaataattaaaaattaattaataatatattaatgtctcatcttgttttatatatcttctcaatatttttatttccttttctctcaacacgccctaaattacctatgggctttcctataaatcgggcctaaattacttctccagtattactagtagcaaaaaatagggtttttcactctgttgccaaaatgaacctaccaaatttttgaccatctacactatcaaaatttggcaactatagaatctattttaaaaaaagaaaaacttagtaaaggtaacaaaccaaatacaatctacacatctcaattcaatcaaatattaataatgtcgtgtcaaaaaatattaataatgtcaaaatttagaatttctaaaatggtaaattttgctataggacacccaaaatttgtgtaatttgctgatatacatcgaaaaaacgtgtcatggctgaaagacattctaaaaaactggtaatttgctagaggacactttcggctcaattgaagagatggattcctaaaaaagacgagaatgcccctctagccacatgcttcaaacatggtgttagagtaaaaatttggaaattatgtaactctaaatttgccatagcccaaagtacatcactagcatacaccattattttattttcactttagtctcggctcaaaaagcttttgaccctagggtcattcttgtctttttgaaaaaaatttctctccgattgagccggaagtgtcctccagcaaattacctttttttttactgtctttcagccataacacgttttcacgatgtctatcggcaaattacacaaattttagatgtcctgtagcaaatttaaaatttaataaggttgatttaggcctcaaagtaaacatccccaatgtctccacacggacttaagtgtctgtttattggttgggttgtgtttaaaattacgtactaggaacactttttctaagaaaaagttggtaaaggctgagagttgagatgtgagataggtttaggtcatttccaactcgtatatagtgttcatagcattaaatacattgtcacacgagtaaaaacctgatacgacaagaaagctaacgagaaaagaagtaaaaagatggataaatcatttctcatgccataaaccatctctacacaataatcgagaatgaaacaaggggatatgtggataaaaaagagagagaaaaaagatgattcatgaatagatgagaatttaatttaaaaacatcatctgttagatatataatttttatatataacatctatatgatatgacaagtatgataactactccatgcttcaaaaccttcattgcatgagaagggttggccgacttaatgtctggcgttatgggatccttaattgctcagaacgtggcacgatactaccagtttcacaaattaaataattaattaatgtgcattggtcttctctctacaaatggagtattgccgactgaaagggtgctagtagcatattcgtttttctttttattgtttgactaacactttagtattctctgaatgtatctcgtttaagaatatatacatgcggattggctatataaaagatgttgtcatgattatgaataaggcataccttcatatgtatgacacgtctctatatatgataagaaaatcgacagagattatggaaataattctcacggggaagcgaataatagagtactactcggagagaatcgggattgtactatatcgtgctggatttggtgtttccgatttcttcttggagattaaggtaataaacagtataaatacacaccccctgaggggtccaaggtatcaaatcatagcgtcaacaccgccaacatagcctacaatttggaggacgtgaagcctactcgcaagaagatctcgtcgaaaccatcttgacaagggtctcgccggtaatctcgggattgattgttctctatttaatctgaggtttttcatatcaatcaaatataaactggattagtgctattatcatgcgaggggcctgaaccattatttgatatcatatcgtgtacacacatgttattacaatattttttaaaaaaaatgtctaatactattataaaattattatggacatatatgaagttgtagaaataatactacctctatttttgtgatgcttaagaatatatgtgttgcttaacttttgaacacaacgttcggttatttgtcttattagaaaaactatataaataaatatttttttatttatgatttcttttgccaataaatataatttaagcaaataatattttagcatggacgtataaaaaaatcaacctcaccatatatttaaaaatgaggaaaacggagggtgtagttaaattgcatgttatatatagacattgaaagcttgaactatcaataacagtgataaggtaaaaaagaattcgtagaacctgaaatacatttttattatatggagtcaaacattataataaaacgaacatgtaacttgaccgcatctatatgaatttggtaagtactaaccgtacaattagattagatctttatctaaaataatgtgtatgatttagatccatcacatgtttttgatatcttagtaacatgaataataaacatgatggaagcagttcaatccagagaagaacgaatattaatccaaattacaggatttgtagctgtttataatttaaaaatagatagagagtagtatacttgtttgttcacagggcataaggtcgtcctaaaaattcttttggttgaactcgcttatgtagttgagccaagcccatttagacttacccctaatagggcccatatatatatgtggatactacttttaagtcttgggctggataaaggaatacatttattttaggttgagttgagtttaaatcacatccttaaaccttaaaccgtaatgccagatataactgatctcttaacttttaaaatcagtttatacaaggtcccaagacattttggataatgatttctactgatgtaacgtctacatgattggtttgacttaagctttgatctcacaaagcaatgatgctaaattgtttaagaccaactaaccaagcagaagaaagcaaggcaagaagacaacattgccatcggctaatggccatgaccacgatacataacgcgagacgaggatcaagttaaaccaaccatgtggatgtcacgttagttaaaaccatcatccaaactgttttaggatctcatttgtgtttaattttaaaagtttaggaatacattatcggaaatgctaggtaccggtattccgttggtagcgatcggaacgggatcatcctcctcgcaccatccctctcaacaagtacgacgcacacgcgcatgcatgacttttattcgctttaccacgaggtccacgactgtcagatggcactgcctactcaatgttggccccacctatgcattttttcgtcattttttcttttaatcctttttagttaaatttgcttaatatctcaattgtttcgtttagtgtaactttgaaattttacttccaagtatttttaatcactgatacctacaatcatcatcaatcattgatacctcataggtatcatcacgatacctgtcaggtaccatttgggtacataaaaacaaatcttcgatacattgctatctgaaaggtatcatccctggtatttacaagtatcattactcactgatacatcttaggtatcatcacgatacataccatgtatcatttgggttcctatcgtcaatatacagatacctcacatgtatcatcctcgacacctataagtatcatcactcattgatacctcgtaggtatcatcatgatacatggtaggtatcatttggatatctatgatacctcatgtgtaatgttcttggtacctataagtatcatcactctctgatacctcataggtatcatcacgatatatggaaggtatcatttggttcctatcgtcaacatacagatacctcacaagtatcatactcggcacctataagtgttatcactcattgatacctcctaggtatcatcacgatacatgacaggtatcatttggatacctatcatcaatatattgatatctcacagataccattctcggtacctataagtatcatcattggtacatgcatatataaaaaacccaaccaatagtgcccataaatacgtaacagagcatggcccaataaaaaaataatacaataataatccaaaaaaataatacaaaaataatacagatcactaggcaagtaaaatataccttgggaggagtacatgaacgtggtgtgctcaccatcgtacgaagcagcacgcacgtctttccacgggatgaattacaggggtataccgtccaaacggtatcccgtcatatagcagtcccctattattcacgggataaacgattgtcgtgcggagatagccattcggactgaatttcaaacaggtaaaccatcacgtccacataatcaaatcgattaaccagacacggcgaaatcaatacagtataaatcaacgcatccaaataatcaacaaatcacacaggagttcgagtattcggcacacgaattactaagaagtgctagtcacacactgcataaaacacacacacacacacacacacgtattcgtagacaagcacaaacagcgcctcgatctggttgatccatgtcgaacttaatctcacaaaccggtgaaatcaaattaggctcgtaaagtccatgatctatgcccaataatgctcacaaaggtgtcttcaccttcacaactttaatcagaaaaacctgaccttcttctacctcccgccgtgaatggcgagcagataaaacagctgtgttgccgagagtatgatggtgaaggactccatggttttctgcaaaaatcaagaccagagcagcatgcacacagttaatagcgtgtcttcggttgtcacgacgaactaaaaaaaaaaactgtgtttgatgttgttcgatcttaccaatctggcgttcctgccgtgcaggtcaatctccttgacggccaatctgaaaacgtaacaaatgaatcaaggaaattgatttagtatacccgtatgcatgcatgggacagggtcagatttagttgcgttaatttaccccatggcgagcagggtgagcgtccatgcgatgaacccggaggaggccgccgccggcaagctctcgtggctccacgcgcggacgtggtggaacccagcgagcgccgccgcggcgccgacgactccggcgatcaccgcgaagatgacgaagaacccggtcgccgcgttccccatcgggaagtagatcggggagaagttcgccggcagcgccatcccggaacctacacgtacatgcagtacatacgctcaaacagtcacaaatctagcttcaaaatatatgcactttctattgacaaacataattaggcaccaatctcaatttagagcaagttttggttcgttgtgcccgataacaagacaccatcgagatcgacacggtaaatcaaaatgtgagctagttttaccgatgaagtagccggtgtggatggcgtggttgatggcccagccgccgaccgccgccacgatgacgtacatgcagaagttgagaaccaggagaaggccggccaccggcttcagccccgcgttagccatggatatcaccaccgagagctagcaaaaactctctgcactctttcagaacgtcttcgcaagctatctacgtgctgatctacgttacttgcgtagtagtactatttctacttgattcaggaggcgcaccgattcggcgttagcatccgggccttatatatatacacgcgatcgatagagaacgcgaaataatatgaactattttactgacgggacatagctggttttgttccttgcttccatgggatgcatatggacagccgaattacgttaagtttttgtgacaaacgtgatgcttaaggcatgaaagaaagaagaaaacatacgtacccggctggggtccgggggtttggtttcagaccatctagagttttcagagattctgttcgtctggaggttaagatgacggctagctggaaaagtacagccttttctttcatgcagagacatgtgtatcctttcagttcagttcacttcagcacagttctaacgagcgctttattccttaacagccggagaccgctgctttgcccaacgaaccgcggcgaatgtctgcgaggtgttaggattgctggatgctgcgtcgaggacacgtctggtagatgccgaaacgtaaacaaatattcagataaggatacgcataacccagggtgaaaggcatcgtatcgatcgtttcttctgccaataattccttgttgaaacggaagcgacagaacagctgcttgctaatgaaatttggttagtaggtccacatggtaattaactttgtttagctatctcgcaaagcccagcagatgctttttttggccccaattcagttctttttctcaaagctcgaacggcagcaggtgtgagtctttgtgtctacactgccggacctttaattttcctttttcggctgagccatcttttcagctctgcagagtgttcgattgacccctgaaaattgggaaggcgtattccactcacctcgcggatgctccatttaacgattattatgtcccgaaacaaaactgcaattcaatcggtgttgggaacccgaaattctggtggatgacaccgagatgatctcgatccgatcgcaccgcgacactaaaatgtcctgttaattgaagcccagagggaggaggcccataggattccaggctacccaatctttgcacgctgcggcccatatacagatactaccaggccgtgttggatccgtcgccttcacagaaaggaataagttcattctagctccctcaagttgtcgcctagtctgacattcgtccttgaacccccaaaaaccagatacaacccatcctccaacttataaaaccggtgcaaataagatccctcggcagtattgtcaccggttttggatgacgtggcgcctatgtggctcatttgacttggtctttgtcccacgtggcattgacataacacttacgtggcagtttgatcgaaaaaaaaaagagcaaaattgaaaagttaaagaaataaacaaaatatgaggaacccacatgtcagtcaaacaaaataaatttaaagtacttgaccccacatctaccttatctacttctcaaagagggagaggcggggagatcggtgagcttcacggcgctctctcccccgctgctgcattgcccacgctcttctcctctctcccactggacgtcacgcgacgctctctctcccgttgctgcccacattcctctcctctctctcgtcgatcgatgcaccgcgtacgctcctgtcctctctgctgctgaccaccacaccacgcacgctcctctcctctctctctcccgctgatcgctacgcatgttcctctcctctcccccgccgaccgccaaagagggtgaaggggatggtgaaatggttcgatgccaccagggggttcgacgtcaccggcggaggttatgaagctgaaccccttgcctatgccggcatgctccaatcgccgctacttcatgtcgacggcttgccggcgtcgttggcaaccacgggtgccaccaacatgtgctcaagggcatcgatggtgtcctgcagcgcgaggactccattgcgccgtagaccgcgttgagccaaagcagcagccgcatgagaacctcgctgacgacatgatcctcctcctcacgttccggctcagcgccttcgcctcggcctgcaccttcctcgccacctttttcgccttcgccttcaccacgcgcaccttccacaccattctcgtgggcaggaaccccctcgctgccacctccctctcaatcttccccccttcatcttcgtctccatctctggctctgacctggcaaactgcatggggatggacgccggcctcgccctgctcctccttgagctcgggtgtagtacatccaccgtctcccttggccgacctactgcggatgccaccaaccccactccacgcccacccatcgcctgcttcgccttgctccgcccaggtgggagcgagagaggatagagagaagatgggagtaaggatgacatgtggggtcgcatgggcccaccattttttattattttgttgtttaactgacacgcggatcatatggttttcattatttttcggaatagaattgctacttaagcatcacgtcgatgccatgtgggacaaagacctagtcaaaggatccatgtaggcgtcatgtcagcgaaaaccggggtcaatactgcctagggatctcatttgcatggttttgtaagttcggggacgtgtcgcatccggttttctggactaaagacgaaaatcagactggtcgacagcttgagggacccaaagtaaacttattcctcacagaaagcggctgacaaattagcgccgtttagcgcggcccataggctgcagcgtccgaaggggaaaacaaaccaagcgggccccctcctaaccctgcgcacccatgcgcttctcgactcgcgacgagcggaaaacgaagggccgcgaccgcgggatgagggattccaccacgttccaccgaccggtcccggcgaatcttcgagaaatcccggcacggacggcggccacgcgcgccgccgccgccgtgggggtcccatgagtaggcagcatcgcatgctgccactcgctcgctcgctcgtcggcgcggccgcggcctaaaaacgaaagcgaatttggaggcgtgggacggccgccggatgcagcatggactgcggagcaactgccctcagccctcgtggcgctcacctcacctgccgccgccttgtcgtctacgtgacgtgactggcaccggcgtcaccgcgcacgcaagtctgatgggctgatgatggctccagatgcagagttctactctgttgatggtaaattgcccattggctgttctctgtttgtttccagaatcttttcttagggcgtgtccacagcgtggagaatcgacaaatctccgaagctcctcattatccaaatcggcgcgtgccccgcacattgtcacatatcactctacaatgtacagtatgtcagtatatataatattctgatggaagataatgaactggcaagtggcaacgaacagacagtaacagaattcaggcattcgcagaaactgccgctggttaccacttaccactgcgtcatcgcacatgtccgcggttttgagtgagtatcaccatcatccatcttgctttacatccgcatggcatgatgcgatcttacctcggcggcacaaatgcggatatgctggcgcttttcgcctgccttcgtggtcgtgagttgtgacccgccaattttctggtgatggcggcggcatcaccgtgatggctccggtactagcagagtaacagcgtgtcgcccgttgattgaccaccggttgtttgcaagctcttgttccggagggcgtccacggtgtgaccgtgtgagtagaatgtcaactctggagttacattacggcacggtgcatgcacacaccgacacgcttaagaatgacaatatgacatgatctcatgcatgtatgacgctccggcgtcgatgttaggagtattaaactggcacttgatgatactttggtagtggtaaatggaaacagaatgcccaacggctggttaccactgcgttcgtggttttgggtttcgtcatccatcttccactacatctgtcgtacacccctagatgaagtatcagtacgtcattagggaaagcaaccaaatgattgagcaccactttaatttataagaaaaatatagaaattttagaggatttcaatcttatcgaaaattttcctatgaaaacctttaaaataaaagattaaataatattttatccttcaaaaatttctatggaactgataatcccatagagattttgaagaaaacttagtaagagtttcaacttcttggaaaatttcctccgatactatctctctcatctgattcctacattttttagttcaattaaacagttattcctatgtttttttctatgttttgtaattctctgttttacatttgtatttctatcaaaatcatatgttttttcctttgtttttccattcctatcattcaaaggggcatacatatgcaatcatacatccattctctcccaaaagataacactcatatatccattctagatttctagatgtctatgccaataatgtcatgtggatggcttaaaaatgttcatggcaggcataacaacggaaaactgtgaccccaggtaggcaatccaaggcgccgcaagcagtacgcaaatgcactcttttttcttctttttttagaagatggaaatgcgtttttttttcccttctcccaggtcaagcacagcgtgctgatgtgctgtggaaaacaaatccgataccaatacaccatatccaggccgattttttcagagcatcgtcaagaggattacagcgtcggttccttccgtcccatttcgtattgtatgtttagagcacgctcacagttaagcatgttccagatttatagtccagtccacctatagtcatttccggatggcacaactgcacaaaattgaaatgggaacgcacgttcctttttaggatttccacactagcatgtgtccacaaattccttgtgcgttctaagctgtagatcgatctgggatattacccaactttttgggaggatgagcaacaatgatttttttttggggtggaaaagagagggatgcacggtcaattggccacaaatattcaacacaagagagatatgaatggtatagtacacccacatgtttcagactggttgacatttcaccggcccggagaaaaaaatcgagggtgttaattaggtggcttaaccgcctaggtaccaagtgcacagtcaaagctgcaactggaagagcagttcgccataagaaaaccgtgtctggtttttaaattcaacaggttgcctatgaaatgattaatcacgggaaccctatccgattttgaatcttggaatggttttgcgtcttttattccagtgctgcagatattttaacggactcatatcgtcgacatgcagctcaaaaacgtttttttatgagagaatgaagcgcgatatgactcttcaacagacaggcaaatgtttacgtgctggaggaatgagagaggtgcatgagttgacgaagtaccaatccaaagtatccaatgaatcttttttaggcgcaagtgtgaaccttggagagcgacagcgatatggttggtacgatggtagcaatagaattgtcaacatatttttattgcctgtttcagcagacgcaaggagatatgcacggggcgaaaatgacatactagaactttcgtacatttttttgtcagcgagaagaaggaagggcgggtgaaacggccttgattttggatagctttttgtgtagtggttgacctgagagacctctcgtagggaacgggtccctttggaaattccaacagccaagtgagaccgcagtagagcagggggccaagtgcagtaacgcttggtcaactgccgggctcctgcctccggctgctggctgctgttgttagagcagatacaatagcaggctataagccagttataaatatattttaaagagataaaagaagagagagaagagcagcgggctacaattctgtagccagctgcagaacgaactacaaaatgtaatgtgtgtatgacaggttggaccagtattaatagtatagtaaggaactattgtatgaattggctattacattggctatagatgatttagagctagtagtggagggcgctgatacgcgatcatccgcgcgcgcacggttagtcgcccccctctagtctcttctcttctctgtatatattatacttatgtatatactatatatacacacacgtatatacgtgtatatatatatatatgaatattttttattgcataaaaatatatatacatatacaaagtttatatatgatgtatacaaagtttatataggacatatacaaactttgtatacgatgtatacgaactttgtatacgatatatataaactttatatacatacgtattaaaaaaataaaaaaacaagaaattgcatcacgtatacaaagtttgcatacacttatacaaactttgcatacgtgtatacaaactttgcatacttacgaatacaaactttgtattcatacatctaaaaaaccgaaaaaaaaaaacagaagagaaaccgaaaaaaaaaaggaaaaccaatctgaacagaaaccaaaacaagggaaaaaaacagccaaccgaacagaaacggaaaacatggaaaaagaaaaaaaaagggaaaagtcagtctcccgcgcggtgcgtccgccgccctctctccacacgcgacacgtgtccagtcacgcgtcgcgcggagaggagcgcgcgcgactgatcgcccaatagccttctcggctagtagtgggctatactattaaacttgctcgtagagcaggtaaaatagcagactataagccagctgtaaacatattttaagaagataaatgaggagagagaaaagcaacgggctacagatttgtagcctgctgtagcacgaactccaagacgtagtgtgtgtatgacaggtgggaccaggtattaatagtgtagtatgtaactattgtatgaatgagctattagattggttatagataaattggagttagtggtgggctatactattagacgtccattgatcagctgattacctcactgcatccgtatgattcgacttttttttcacgttgattttatattcacaacatggctcgtgggctcgtggctttccggtgcagtgaatatatttctcccgatgaaacgaagtcgacgaatggggaaaggaagtccatcccaaagggaaaagtgaagggaaaaagaggagtcacttacggcacgcatagcctaagcttatccaccacggacacaagattagcgtgcagttaatcttcgaagcagattccgtgctcacctgaaccgctgaacgaatatgcgcataggagtaagccaattggacgatccgtgacgcatcgatcggtcggtcggtcagtccgcgcgtccgaaacggagggtgatcctgcccatctaccgcgcccgccgtggcgccaggatttgaccaatccttcgggcgcaggcgcagcagcggctgcgatctcgtcaagccgtcgcctaggcgttgacgggcgcgagcgagcggccttcctactgcgcgcgcgattaccacgcgacgcgctcgctcgctctcttcccgcacgtgttgcacgagacgcgggtggaggcagaggcagcagccaccaatacaaatacctgataacctccaagaccttcgaaagctcgaacacagcaagtgagatcgatggatgcggctgcggtgatgcagaagcagctcaggcggctccgcacgctcggccgcggcgcgtcgggcgccgtggtgtggctcgcgtcggacgacgcgtcgggggagctgctggcggtcaagtcggcggccggcgagggcggggcggagaatctgcggcgcgaggggcgcgtcatgtcggggttttgctccccgcaaatagtcccttgcttggggtcacgcgccgcggggggggggagtaccagttgttc

SEQ ID NO: 44270 - DNA, 2290 bp, Oryza sativa
ccgccgtccaccggatcgggtacacggacgctgtgccagagattcccgaatggctctccccggaggcgaagaatttcctatccagatgcttcacaaggaacccaagcgaccgccccactgccgcgcagctactggagcacccatttctcgcatccgcctccagcgacatcgacgaaacggcgccgaagcacggctgggtgtcccccaagagcacgctgaacgccgaatgctgggaatctgatgaagacgacgaagtagaagaaggcatgtcacagagcgcaaccaagaggatcagcgcattggcgatcacctgctcggcgttgccggactgggactccgaggatggctggatcgacttgcaaagcgacccatctgaagtttcggaaacaccggcgcccatggtggtgactactgcagatttcggtctttggtgggaggaagcattggacgcggagattgatctccatttcgttgacgtggacggcgatggctatgttacgcgaactgtacgcgcgcgtggtttcattgagtacgacagacaactgagtgtgagagttcgcggtgatatgccgttgtgcccggttgattgccaccggagcgacactgtaaaattcggttgtcattgtaacgggaacagagtaataaatttcgagtctgcacaaatttgcctgttgttaccattcatcttgcaatcaagggctcatagattgcatagcgttgagctcccggtaaaaacttccgttttaaaaaaaaaggccccggcaaaaaccgttcaaagaattggtttaaggctgattctcactgttttgactagaatgagcaatttttaaccgagttgacatctttccaccaaaactttagaagtttagagcatggtcattcggcctaaaataatatccactaaatttcttttggaatctttaatcagaatttatggactataaaatatatactacttctttgcaaaagatatcctaaacttaacaccctaaaaaatagggccacctcaaatctctcccctcctcctgtgttttcgcgactcctctctcgtgatctcgcacccctccttccgtgctattaagaattggtagcaagcacattcccacaaaaaatagataacaagaagtccagtataagggcaactagtaagcaaacccgtgcaaatgcacacgacacttatttatttttctataagaacaacactgtaaaactaaaatagctcatgaacttttattacaaattaccttgctataagcatcgggaaaaaaagagaaaggagttgaatcttctgaatgacaaagtttagaaattgcctttctacaagcatagaaaaaagaggaaggatttcaatcttccaaacaacaaaaatgcacatggattcaaacataaatcactgccagtactgctccctcctcaaaatatagcacatattaactttttttcacggtctttaacattatagttgaatattattgtaaatgtattgtaaaaataccacttctatggttctaccacttaaccggataatgccgacatgatcctgcacccagtgaagtagactgcaattgccaaatctttcttctctcgtgcggtgaagccctagtttgagcattgacacactccttgagatatactcatgtgctcactcaagttcctcgtaaacacacccatcaggcccttcacattggctcgcttcaatcttctccgatgatatgaagtccaagctgatccaccatcgatatggcagttgcccttgaaacctacacatgctagcttcgctatcaacagacttcccgagatttttatttatacaccaattcaatctccaaaaagacacatcaatctgattcgttgtattggcttgcctaagtgagattttgacataattcttcacatctagcgcatagtttcttgtagtcccaccctagaggactgcattgtaaaatgtccaattggctttgccgctaccgcaggcctcccattgggctcacctcagcccgactattcacacacctgcgatacctacgtaagctatccaagttgtgttgtacatgcgtcaatggggaccattggggacggacaaagagaagagtctgagagacatagggaagatatggaagatcaagaattgagaatatgcagtggtatcactacgtggaagttttgagtctatatgtgatttagtagagacacaaatttgtactacgtaaatagtaccactcaaactatcaaattttgttagtataggtacatttttttctttaaatatgagtgtacttattattgggta

SEQ ID NO: 44271 - DNA, 2679 bp, Oryza sativa
gacatctgcggtcggcgaggtcaacgtgacccccgcaccggcgccctgaagagacagggagccgtcgaactgcatcacccaataggcggtgtgaggcagctgcgaagggcccgagctggcctcggggatggagacgggctcgggagccggtgtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaggacgtaaccaccgtgacccgatgcgcctggaaataatggcgcaacttcctcgaagccatcagaatagcgtaaagcatcttctgggcctgagggtatcgggtcttggcgtcccggaaggcctcactaacaaagtagacgggccgctgcaccttttgtcggggccgatcctcttcgccaggggccgcatctatagggcgcttttcgtccgagaggccgcgcggggcgcactcggcttctgtgtcgacgacctcggggtcggaaggcgacaggcgcggccttcccgcagtggccccggggccatcctgggggtcgggggcgcctggcaccgtcggacaagcgggcagagggccagctccggtcgtcgggggcctcgggccgccgttcggctcgggggcctctcctccctgctctctcccgggtcgagtcgacacagggtggggatgcgcggagcgagggtcgtcctcgtcgcgctccatgaccaacgccgcgctgaccacctgcggagttgccgccaggtagagtagcaacggctcatctggctccggggcgaccaggactgggggagaactgaggtacgccttcaactgagtgagggcccgttcagcctcctccgtccagataaacggcccggagcgtttgaggagcttaaataggggtagcgccttctctcccagcctcgatatgaaccgacttagggcggccatacagccagtgacgcattgcacatccctaagcttgctgggggggcgcatccgctctatagctcgtatcttctcggggttggcctcaatgcctcgggcagagatcaagaacccgagaagcttgcccgcaggcacgccgaacacgcacttgtcggggttcagctttatgcgggcggtgcggagactttcgaaagtttccgctagatccgagtaaggtctcctggttgcgtgttttcacaaccaagtcatcaacataggcctcaacattacgtcctatttggctacccaaagaaattcgagtagtacgttgaaaagtaggacctgcattctttaacccaaaatgcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatttatgcgtggcagggggtaagggtccttaggacatgccttgttaaggtcggtgtagtcgatgcacatccgaagcttgccgttcgccttgggaacgacgaccgggttcgccagccacttcggatggatgacctctcggatgaatccggcctccagaagtcgcgccacctcctcgcggatgaaggcttgacgttccggggcctgccgccgcactttctgccggaccggccttgcgcccggccgtacggtgagacggtgctcaatcacctccctggggaccccgggcatgtccgctggtctccaggcgaagacgtcggcgtttgcccgcaggaaggagacgagcgcgtcttcctatttgtcgtccagaagaccaccgattcgtgtggtcttggacgggccgtcgcccaaggcaacctgcttgatcgggacctcgtcgcacgtgatcatccgctgcctcggggcggctgggacggaggtgctgagcctctcgtcgccacccgcgggcttggatgccacggcgaggtggtccgcgcgctgcttcatgcaagcaagcgcgactttgaggtcgccatggacggtgatggggccaccggggcccggcatcttcatctggagatatgcgtagtggaccgccaccatgaacttcaccaacgcgggcctccccaggaccgcgttgtagggcagactgaggtccgccacatcgaagttcacccgctccgtgcggaagttggcggaaccaccgaaggtgaccgggaggtcgatatggcctagcggccaagtgtgccccggcgtcacaccgatgattggctgggacgaccggagcaccatccccggggccttgatggcgtcaaaggcagcgggggaaaggatgttgagggctgcacccccgtcaacgaggacacgccccaacttcacattgcaaacggtgggggaaaccaccatcgcgatctgtcctccccgggcaacgcacggtgggtggtcggtctggtcgaaggtgagggcaacctccgaccaccgcgcccgccgcgtcgcctcatgggtaggggccacggccagaagctctcgcttcatggccttgaggctccggcgagaagcgtgagcacacgctcccccatcaacggtggcgacagtggcctcaggctcctggaaccctaggtcatcgtcgccatcgttgatgtcctcggcgggggcct

SEQ ID NO: 44272 - DNA, 1789 bp, Oryza sativa
ggccgacctcttcttcctcctcctgtcccgtcgccctgaccgagcggcggatccggcggcggccgaagctgccacaccggaaccggaggagttccaggtccaggcctcctccttgcgagccacacggtccgcgagctgaaaaagctccgcggtggtctggggctccttggaggcgatcttctcgagcatgcggttgtggcgcacgccccccctgaacgcgtagatcaccgcgtgtgcagggatgcacggtatggtgttgcggacttgacaaaaccgctgaatgtatgagcgaagagactcatcgtcccctcgctgtaccgcgtgcaagtccgcttcttcacctgggcgcggatatgtgccctggaagttcatagtgaactgctggcacaaatcctcccaagagtggaccgacgcgggtggcaagttcattagccaaccccgcgcctgtcctttcagggccatggggaagaaattcgccatgaccctgtcgtcacccccggtggcctcgatcccagtcgtgtagatctggagaaactcggaggggttgatgcttccgtcgtatttttcggtgatggtgggccggaaccttgggggccaacggacgttccgaaggctcgccacaaaggctcgacagccggcaccgccaactggggacacagggggctggcccccgtgcccggaccgaagtggcgctccggacgaggaagcgccctccgatgcgtgggcagcacggcgatcattgcaccggcgctcgatattgaagcgggcatctggccccctacgcacatcttcttgggttggaggcgttgacgagggaatggcggacgaacggcgggtagcggccgccgctcgccgcgccctccgcctcgacgacacggagccagcagtagcaacgccagtggccttggtggcggaggaccaccagccggcgcctaggcgctgctgcgccgtcatgaccaaattggccacgtcatctagccaacgtcgggttggagtctctggatcagggatgacgggcgggtgacgcaggagcgcgcccgcagcctggagcgcgccctggggcgtgctgccatcaccgtagacgaggagacgacgctccccgtctcgccgtccttctccatcgcccgcgtgcggcgaagtcgcggatctttcgacctcctcgagcgcctcctcccgcccaagacttcggcgagagggggacagtggagtacgagctcgacggcgcgggttctgctccccgtcttcaccgctagcgctcggagagagattgtgcgccactgcccgttcggccattgggctgagcgggagaagcttggcgcacacgaaagaggacgagggcttagaaaaacacacgcgccccctacctggcgcgccagatgacggagcgtggggctcctcaccgggagaccgcgcaggcccccctttgccggttcggccgggggcgctaagtgaggttcttcgccctcgatctatctggagaatgttcgcgagagagcaagtgcacgagacacgggcgatgtagacaggttcgggccgctgagaagcgtaataccctagtcctgtgttctggtggatctgtgtgtgaaggatttacagagagccggagagccagagagttcaggctccagaacccctctcactccccctccctcctctctttttggtgggcaaggtcctccttttatatctcaaggggatactacatgcaccacttctacctacttttcttctgggtggggacctaccctatcttgaccaaaacttggcttgcaccttcgcctggaagcta

SEQ ID NO: 44273 - DNA, 1859 bp, Oryza sativa
cctaacccacacacgtggcgccaaacccacagggggccggggcgccccagccctcggggcagaaacgggggtggcccgacccctcggggagacagagggaggggcggccacatcaccctcaggcccgacccccccccccccgagggggtcaggccacgtgggtgactgcagctgccccaaacctctagtcaagatacccccggtcccatgtcaccgacacttggagattcatctcatagacggttaggtgtcgcccgcgagtttccgtcaagattgtggattgacccgggcaagtttgtgaatgtattcctcacctccgcaaggaaacaaggtaagtgagtaaagaaattgtgccgagtttttagaggtagtcctagtagagcaaacctcacttgtggttgtctctaaaaggttgagttggatcttggtggtcactcaccttctagagaaggatctaggggtgttggattgaaggctgtggacctcttctaggatctttgcacaagagaggcaagggtttaattgagacccagctttttgaagctcctcaaaggagagtaggatccgtgcatccgaactttgggaaaaaaatcctctttatctcttccgtgaatgctttgtgcttgcccctatgttttatatactgctatagtctactgtgaaccatattgacctaataggacctgttgttctctctcttttgaagtattttctcagtatttccagtacccggaagttcctgttcttgaactccggaagttccgagctgcctatagctaccaggaagttccggtgttcatcactaggaagttcgcgggtcctgtttaaatttgatcgttacgatttttttagtgattttcaggttagcctattcacccccctctgtaacatcctgaaaatccctaacaataaaaatcactaaaatttcaaactttttaaaacttttgcatcatgctggttgttatgattgctatggcttgccaaaccgtaaatgatcacaaagaaagaaaagaaaagatcgatatttaagcaatagatataatttacgagaatatatttaatcctacaaataattatgcaaaagatagtaaagtcaaatattaatttctattacaaattacaaatcaggtattaaatattcgaaccatgattgatagcttgatgtcacaattagctaaagaaatagtaagattaaatccaattcatttgaatccaatctcacatgaaatataagaacacatgaaatgatgatcaccactatagtgatcgtgtttataaataagtaattcaccggaatatatagatcgatacttgcaacatgtcgccgagttactcatgacatgaaaatcactcatataaaataatggtcatataaataaattaatccttatatataaacaagaatatgtgagtgtttaaaattagattaatgttgtaccgagtcttaatatactatttatagaataaatagattcaacctatccgtgtaaaatatattgctataagttcattcaatgtgctattgtaataataagggccacactaggatattttagaaccctcaaagcctccaaaattatctaggctaattttagaattagacctcatttaaataatacaatagaaaaatatatataagaataaaatatgggtaatattaaaatttggtaaactttcatctaaaattaaaacatatattgggtaaacctcatttatgtaaaaattaggatttatagaatgaaatttatacaagggataaactaaaatcgggttaaatagaaaatggcactgttcattgcactctaggtgctcgacgtggtccctggctctattttccccctcctcagccgcacgcgcct

SEQ ID NO: 44274 - DNA, 8946 bp, Oryza sativa
  unsure (1)..(8946): unsure at all n locations
caccccacaccatttccccattcccctcttcctcccctctttcctttccaccgcgccgccgccctcagtaccgccgcgccgcgccgtgtgccgcgccgtgtgtcgccgccgccgccgccaccgtcgccgccgccgccgtcggtaagccttccgccccctcccttcgttgccggtagccgcgacgcgccgctcggccgtgagagagagaggagaagacagagaaagggagagggagaaaagagaagagagggtagagtgggccccacctgtcatttgctcctataaattcctttaggaagaaaaataaaagaaaagaaaaagaaaataggaagaccccacctgtcagtcactatagcttgtggataaggttgtattataaataaatgaattaggaacagtgcctttttacaatttctcggatttattcaaatttgaatctttacactagcataacttattcattttagctccgatttgagtgaaacttgaacctaaattcatctaaattcataagctttccaatgatatataattcactatttgataaaatatatttataaatattaaataattaatatcaagatgatgcataatagtcaacttaaaaatatgttaataaataaaattagtattgtacggtagagtagatgtaataatatttgtctctaacatgtcttgccactgtaacaaccacacaaactaattttatgtgatgtctcaaatgaatggatgtattggaaaatactagtacttatttaatattcgatggccatataattaaatccatggcttataggttatttaaatcaagtgtagccttatgattatgtaactaaaatataaacacacatagatgaatctgtttaggagaataataatagagctaaatgtggaggaatcactaagtaaattaatcgatgcaataccatatagaatagcatatatatgcctaaattgattaccacttattagtaacccaatagaaccagtgcttaaacttgtcgcatcacatatacaatatcactcatagaaactagctaatgtataattaaactacaatatattcaggaatcacttggagcattgggtagtacactttctaaataagctcatgtacagtaggcgaccaaaacattatacgttgttgcacacatatattggacatcccattatagttatacaattaatttatctttttcatatattaaactggggagtatataacaaacatgcatagtagataagtactaattataaatcttgacctcatatgttcatagttcaattgtaactccggattgttcattaagagataatctgtaactataatattataaacctcccgaatttaacatatagagcatggataattattagcccttttataatttataatggcaagtaaaatatgttcataattaaagtaaagcttccatcaataaaataataatacaaatgattcactgtaattatttgattgatcctaaatccatctaacaacagaacctctgatatgtaaccgtgctatttagatatatgcatacgtagccataatccttccatagctatttgatagactaaaccaccgattagccaaatatatatgtatcccataaatgctatgttggttaactcctaaataggccacgatgacaatagaaagattaagaaactttagccttagcatgattgggatccattagcaaacacgaatagtacattttgttgcgcatatttgattgttgtttgaatattggtttttctcgcgtattatagaccttgtgtatcggttagtcgtgaggcaacgtctgcaacttccaggaggtgaaggttgatcaagattatatcaataataaggattatcctgagcaggcaagtcatcactattccttgaacatgttgatcccaattgcgaaattatttttatttacaaataagattgcatgcaatgatgaacatcctatttgtgaatatgccataccttgattattgtttaaccttattcccttgtaaccatgattacgtatgagtctctagtcaactatgacaaatgcttagagatgccactctagaatcatgtatactcatatttgtcaaatgctatatgcttgggcaattacctttgggaaggtaattgaaatgcggcatgtggagacatgagcgccacattgccatgatattgatgacatgatttgtgaaaggaaaataaagtgaaacaactgttttcgactggggcggctggaggatttgggtggtgtccggaaaaggctagtgccgtccctggtcaattaaggaccgagccatgaagttaagtatgaaacgaccccccgtacaaccgcacttctcgtatgggtatagacctagcggagtagatagctgagcggaggcagtatccatgcatagtggtttcttgatgtgtgaggcaggggctctacggtggggcagccattggtaggaccgcgaggcgggtgtctacagtggtgtcgccatcggtaggactgccatgtgagaatctaaacataattataacttaatgcatgtgtgagtcttcccttccaaggtgcgccagaactcctcttactgctagaaaccgtatacgcctagagtgcatgaggatgtaaaagttcatggagcgggtactgccaatgcgaggttatcgaaaagctttgccgtgacacatctcatgtgttgggacgaggctcatgtattgggcagttgcggagtgcgggtaaagtgtacatccactgcagtgtgagtaaaccaatctattcgaatagccgtgctcacggttattgagcaccgggacatgtattacacttcgctagactctaaattcttaacttgtgtgggatgggatattgcatgatgaattttatgctgatggagccacttcctgagaggagggaaggtggacgtcctcagaaaaccatgaccactcaatggcgggaagctatccttgggattacaatggatggtggacagaaccatcgttgtttaatgtgaacactggtattaaaacttgatcagtctatgctaggtcttaggcttgtgaaaagatttgtaaaacttgctttgcgcaaaggaacctgaagccattccttgaaataccctctatcatatgcatcgttgctgtggtggcttgctgagtatggttggtactcacccttgctgtttatatatcttttaggagagtgttgaagagaagcccttgtcggtacgcttgcgtatccaacaagatgatcggagtgcggtcttgttctaggtctcgttccccagtcgactgcctgtggcatgttaaccgggcccttatattattttgtcttccgctgatgttctctgatagttgttggcctacctggccctaatgtaagtatttaactcttttagcctgaattcattcgtgatatgttgtgatccaactatgtatgtgtgtaccaactactgatccagagattggtacggataaacacagaagatttccgatttccaaaatcgggggtctacaccctctaagctacatcttcacctttcagtaactatatagatagtatatatccatttgttttaatgtcctcaatgctccttccatccatccatcccagtttgaccatcctctaagcaaagcgtaccaagaccaaggacaccaacatatccatcattcttaaattaatgctaaggtgttccatcgcttcgtatcccgtgaactgctcttattttaaatattatgatattgcactaatagaaattaatcaattttagttacatgcaacacatgcaatgatgtacatttactcatttcataaataaacgaaaagacactagttaaatgatgatcattttaggaagatcttagaaaccttaggggatgatcaaattgagatggagagagtacttttcactgaaaatatcttgatactagaatataagtaaattttgtttgttgaactcaaacaccacaaacttgtcacaattacatgtgatgatctacatgccatcttttttttttggtggttgggcgatcgattgcaccacgtatatataaaatcaattattttttagcacctagggtgaaaaatgaactttgagccaaattcaaggaccgaaataaactttaccatgccattataactttgtaaagtttgagatatgttatcggtatctcaatgacatgtaagacccacatgagtcaatgacatgtggatcaggatggcatataacaaattttgcaaaattataatggcatggttccaattttcccactaaaaattgtagcatgttgttgatgttacttggccaacttgggacttggcaaatacaaccttcatatgttacattttataacaatagtaaaatagaactcctgttgggttaaatagctactccatccatttcatattgtaagactttttagcattgcctatatttatatagatgttagtgaatctaaatacatatatatgtctaaatttattaacatctatataaatataagtaatgctagatgagtcaatgacatgtggatcaggatggcatataacaaattttgcaaaattataatggcatggttccaattttcccactaaaaattgtagcatgttgttgatgttacttggccaacttgggacttggcaaatacaaccttcatatgttacattttataacaatagtaaaatagaactcctgttgggttaaatagctactccatccatttcatattgtaagactttttagcattgcctatatttatatagatgttagtgaatctaaatacatatatatgtctaaatttattaacatctatataaatataagtaatgctagatgagtcaatgacatgtggatcaggatggcatataacaaattttgcaaaattataatggcatggttccaattttcccactaaaaattgtagcatgttgttgatgttacttggccaacttgggacttggcaaatacaaccttcatatgttacattttataacaatagtaaaatagaactcctgttgggttaaatagctactccatccatttcatattgtaagactttttagcattgcctatatttatatagatgttagtgaatctaaatacatatatatgtctaaatttattaacatctatatgaatataagtaatgctagaaactcttacatcatgaaacggaggaagtatattcttcgtatagtatgaaatatcttccgcctttccacatcacgcttacgctttctatccaaagaaaaaatatcctgatggagcgatctctccattacagtcaaacggacagaaatggccactccatccggtcatccgtattccccaaaacacccttaaaaagcgtccgctgctgccataaatatctaaggnnnnnnnnnnnnnnnnnnnnnnncaaccgcatccgccataaaagccgtcgggtttagcgataagggttttaacatttggctaaaaaattttcgagccaaaaactttaccaaaatcctccgaaattcctgcgtctttcagctcggatcaggcattcaggcccttctccccgccaggatcggtggtaagctagttcatccctcaatctctagaacgtccaactcttcaatttggtggtttctgccaattcgctgtggtctcatttcgctaattggacctctcgttcggtgaaaatcgcatcgattcctttctccaagttgagttctgatgtttctgttgcctttgagttcgtttatgacggtttggtttatggtaaaaattcaaggatggagatcatcaacgggccggttctcccgcgctatgctgctccggcgaccggcgccctgacctccgacgcgaagatcagcgggcagctgcttaggcgcgtgcacctgaggagacgagcctgtgggttgcagggagaccactaccgggcggcgcgcaggttcttcggtttcccgtccgagcggcatgcgcgaagcggctgggtctggcctgttttgtgcagttacggctcgtcttccgacggggaccgcgccgctgccccggataacgacgccagcggcgaggagttcgtcaactcaagcgtgatggaggcttgtaattgcttacttctggtacactgtaacttgtaacttcatttgggttttgatgcatagtcgttcgagcaatgtccgggtccggcccactgtttgttgggagttgggaagttcgctgtgagcctttgaaacagttgctgttgtttgatcagctacataccgtttatgccaagctactgttgcagtattagttacatatcactagtatatcatttatgccgattgccaaacaaccattgtacatttctgagattaaacttgtggttttatctgtccttgcagttgagctcagaagtgtatctgatggatttgtgattaaaatgcgtgatggcaaaaaccttagatgtgtccaaaacaacccgcgggtattaagattgcgggattctgcacctcaccatgctattgttctgaagatggaagatggaagtgatcttttgcttccaattatcgtcagtacgtattaattcttgcttgggcatgctttccacttatgcagatgcttttctaattgtgtgatatactcacattacttttttccagtggaaacaccaagtattatgttgctggctgcccttcggaacattcgaattgtaagagttggatgtagctttaataaatatatgttagatgttaagcatccacatgattctggttttaaattgttttcatgtactatatctgatttgcatgactattctgtctttccagccaaggccaactatttataatgtggtaaaggagatgaccgaaaggatgggatatgcggtgagtttaagatgagatcttataagcagactttcttttgcaactttcgtgtggcttcatggtttaggttttctgtttagtgtttcatgggtgtgcttatgtgtgttactattttagttttattacttaatgtatgctggttatcatgcactcggacaatacatacatcttttctaaagtgtcctagtggaaagctgttttccagagttcacggtctgcagatctgttctcttaaatgtcatataatatgttcatttatcagttacttgattacttcagatctgttccctttaggtacgtttggtgcggattacagaaatggtccatgatgcatactattctcgattgtatcttgctaaggtaaaatgacttcacatgaactactccctccatactcgtaaaggaagtcgttttggacagcaacacggtctccaaaacacaactttgacttcttgtttctataaaaatatttattgaaaagtgatatatgtatacttttatgaaagtatttttcaagacaaatctattcatataatttttacattttcaaactcaacaacttgagagttattcatgatttatattcctaaggtttgacttaaacattgttctaaacgattttctttacgagtacggagggagtatctattttacttttgtctgaagtatggtgtcatgatatccagattggcaatgaagaggagactattagcttagatctcaagccatcagatgccatcaacattgctttccggtgtaaggtgtgcattcatctcctgtgcagctgtgcttctgattaattgctgagtgctggccatatttcctttaaggctgctaatcccagaatattggaagtgctgtgacttagttgcatgttggggattataacatgcatctatctgtttgagcgctagccacaaaactgtaaaaccagcaaacaggattcccttgtcctgtcagaaaagtgatctattttttggtgctgttgcttaaccttgttatttgtggatgatatgatttgcatgcaatacttctagaggtactcctttttatttccttttaaatcatttgaggaaattttcgtaaccaatgatttgagtacagcagtcaaagaatgtggaaaaatcctgatcttcttggtgttttgctgctaaatggatgtttatgatactcattccaatttattctaactttacataggttcctatacaagtgaataggcgtatagcgtataacaatggattgaaagttgtacaaccaacaccatctgagagctatgtaagctcagaccaattccaatacacaagacttgacaggtttgtaacaaaagtagcttcataggtttcagtaaagaaaggtttattttaaagcactgctaatgcatcccgtaccatttgaaggcctgacgatcaaccttgctttgaggcccaagagtttgatttggtccgcaatatgctggtcgctgctgttgaggaacgctacaaagatgctggtaagctcttgttggcttaaaatgcatatagtaaaatagtcatacattgtgacagtgttgcattgcattattttgcctcctctggaacagataaattttatagtttttcttttgtggaaattgcaactaattcgtacaaaattcctgcgttcaaaatgggccctaaatgggaagtctttgtttttttttatccgcctcccgactcacaaatatatgcagcagattgttcatggcggctaatatctggtatcatctgtttcagctcaatacagagatcagcttttcatgttccgggcaaagaaaaagaacatgatttaacaggtaacagtcgcccatgccattcttgaaatcttcatatagtcaatttctttgtcaactttcacgtacactagctcgatcaaactgacaggatgacaattcacttttcttgatcagttcctgaagggaggtgtacatactagtcccgcctgaagtgcataaagccaaacatcaagaagaactttgtaaatacttacagaagaacctatacatagatacatatacatactagaacatgattttgggtgctttcaattcgtggtggcgttggtagtaaaatnnnnnnnnnnnnnnnnnnnnnnnnnnnnnnnn

SEQ ID NO: 44275 - DNA, 2208 bp, Oryza sativa
  unsure (1)..(2208): unsure at all n locations
tttttcttttgtggaaattgcaactaattcgtacaaaattcctgcgttcaaaatgggccctaaatgggaagtctttgtttttttttatccgcctcccgactcacaaatatatgnnnnnnnnnnnnnnnnnnnnctaatatctggtatcatctgtttcagctcaatacagagatcagcttttcatgttccgggcaaagaaaaagaacatgatttaacaggtaacagtcgcccatgccattcttgaaatcttcatatagtcaatttctttgtcaactttcacgtacactagctcgatcaaactgacaggatgacaattcacttttcttgatcagttcctgaagggaggtgtacatactagtcccgcctgaagtgcataaagccaaacatcaagaagaactttgtaaatacttacagaagaacctatacatagatacatatacatactagaacatgattttgggtgctttcaattcgtggtggcgttggtagtaaaattgactcaaaaggtgcccatgtttgtcactcacgattgattttagcaaaacgttaagcaaattgctttacacgaatcctcgtgcttctgatttgaatttgtatgcctatttagtttgcggtgaatacctgttttgctccgaactaagtttcggcccgaaccaacaactgtactctcaagttccagcccggcccaaaagcctcgaaccgtcacgtccagaataaatttcggtgaaccttgtccatactccatagacgtgaaaccccaccagcgaatctcaaaaaaagggaaaaaaaaatcaccagcgccgtccactgctgcgagcctgcgagcgtgtcccgatcaggccaatcagaacctccaaggagaaatcaacggctcataagcatcggcatctgcagatcaaacggagctggttcaccatagtgggctctagccgctctacaccggctcgatctcctcatattacgggcgtaccgtgcgcccatgcgcgacgcgtggcacgcgctcgccaggtcgacggaccagagccgatgtgagccgcccacgtggcacgcctacgtgcaggctgatgcagcgtcgcggttgttgcgagcctatggacccggtccacgagaggatacgtgtaacaccccctcccctcttgccctgtccccttcctccaccgatgaaaagaaaacagaagcttctcttcccctctcccccaaaacaaaagcatcaaaatattcctcctaaatcaaaagaaaaacaatcaatttcaaacgagccatctctctccattctcgtgcccctcctgtctccgcgcattcctccgccggaaaccctggttcatcggcgagcggcgaggctcggggactcgattaccctgcgaggaatcgaggtcggaccgcgggtggggaaggcgaagatggcggggtccatcgatcggccctgtgagtgcgaactgtttcccttcttccttcgactgcgtgttccctgatgattcgttgtttctccatgccgccatgcgttgcccgttctcgtttatgcaatgcttacctgcttgtcattcgcgaacaccggaaaattgcggttgcagagagattgattctgtgagggggttcattggggcaagtggagaacatggcaaatcactcggaaatagacaaatagttcatgttcgagtgggattgaaattttaatagtagtagtttagcacctgtagagattataatcacacctccctaatttttttaacgtgcgtgtaattgcgctgctttcagttaattgcaactcctatgtactctgctctcgtattgattattttcaatgtagttgttaccatttcaacctgattaggaggaggggcatttcgttgaaactatatagcaggtgcaggttttgaaggcattgtgcatgatgatgataagaaagagtggaaatccgatgaggacaactcagaaggtgacaaaaaggccaaggcagtctccttcaagaaccgagctatcagtgctggaaataaatttaggcgttccttgagaaggaagagaagaaggagggtcggcgaccatgtagcctctatagaggacataagggatgtcaaggagctggaagctgtccaaagatttcaccagtgcttacatgatgagggcttgttgccagaacgtcatgatgattatcacgtgatgttgaggtgcaatttttttctgatctcagagtcacagttacttggattt

SEQ ID NO: 44276 - DNA, 7856 bp, Oryza sativa
aattgcgctgctttcagttaattgcaactcctatgtactctgctctcgtattgattattttcaatgtagttgttaccatttcaacctgattaggaggaggggcatttcgttgaaactatatagcaggtgcaggttttgaaggcattgtgcatgatgatgataagaaagagtggaaatccgatgaggacaactcagaaggtgacaaaaaggccaaggcagtctccttcaagaaccgagctatcagtgctggaaataaatttaggcgttccttgagaaggaagagaagaaggagggtcggcgaccatgtagcctctatagaggacataagggatgtcaaggagctggaagctgtccaaagatttcaccagtgcttacatgatgagggcttgttgccagaacgtcatgatgattatcacgtgatgttgaggtgcaatttttttctgatctcagagtcacagttacttggatttctccttactcttgcagaaaattcagcgttgcttatttgatttaaaatttcttcatgtgcctatgacatgttacacatgtaggttcctgaaagcgcgaaaatttgatattgataaagcaaaacatatgtggtcggaaatgcttagatggaggaaggagttcggggctgacaacatagaggtaaagcagagactggaccatatgctccagtacgtaggtagtgatagtctttcttcatgtaacttctggaagtttgacatctggatcatttaggaatttgactatagcgaattagatgatgttctggagtgctatccacaattttaccatggtgtggataaagagggaaggcctgtctacatagaactaattggaaaagttgatcccaacaaattagtacaagtcacaactattgacagatatgtaaagtatcatgtcaaggagtccgagaagtgcttgcagatgaggtttccagcttgctccattgctgcaaaaaggcacatagattcgtgcagtactatcttggatgtgcaaggagtggtatgttattttatagccaatcttgctatcgccaaaatttctgggtagattagtagttaacttgttttttatgtgaagggtttgaagaacttctcaaaagatgcaagagagctaatcatgcgacttcagaagatcaacaatgacaactatccagaggtaggtgattccattatgttttaatgttatttttcactattgccctttcacttcgttttttgtcactatatacatttctatagaacttgtttttatctggggtcataacaaaggacttatctaatacctttctagtgctcgtgcagaccttgcaccgattgtacattataaatgctggccaaggcttcaagatgttatggggtacaataaaatcatttcttgatccacaaactgcttcgaagattcatgtaagtattgaaaattgttattcagaataatatttacttctagtatgtgataatagccttatctgtcttttttcacctaggtccttggaagcaaataccaaaataagctacttgaaactattgatgagaggttaggtcttttctactgtcacaaatactgtagtttggttcctatcctaataattttgtttaattcatgttttcagtgaacttccagattttctgggtggcaaatgcaggtgtgaagaacatggaggttgcataaaatcagataaaggtccttggaaggatcctgacataataaaggtcttccactcttcctgaaccctacccttcttcttattcatcctgtacacctttttttttttgaaaagaaatcctgtacactaaaataatgtgtctatgattttcagagggtccttaatggtgaagcaaactatggacggaaaattcttgctatatcaagcgttgatgggaagaaaatatgttatattaaccctagacacttaactgtaagcatgctttgaatggagattactcatacatcatcttaaaataacaactatccgttagaagcttgattctatcccctcgcagaaaaaatgcagcgatgcctctgctgagtctagttctgaaatggaagatgtttcatctcctatagcttcagttaaccccatcataaaccctcatttgacacccgttgacgaggcaagatcttgtaccttttggttttttcaactgcacgaggctgatattaatgattagtactcgttctattggtcttttcaactgcacaaggctgagctcagattactgattagtactcgctctaaacaatgatgtggcattcttaattttcttcctccttaatcaatctttatgttggtaaatatgatcataaatgcatctttttatatttctgcagtccaaattgccgggaaatacttccacatctggtgcccctcccagagtagaggacatccctgttgttgacaaggctgtggacacatgcgccggtccatcaaccagctcaatggcttttaattcaggtctttatatgacaccttcatacttgtacctcttattgagaagttgtctacttgctgatttcaaacattcgtacccccatatgcaactagggaaatgtgagatactgggaattttgttggccgtttggtttgaggaatcaaactatctagaatgggtgatccatcatgggaccatctctcaaatctagtggaatgactccatttctcagtttctcatttagtatgtactttttagagatgatggacaaatccattccattcctcaaaccaagcgacctgtataagatcaagtggtcatctcattcctcaaaccaaacatgccattacattatagtatgtagtgagtggtgaccggtaagcccaccaagagtttattggagtgattttgactgagtttgttgcatgttttacacagattcgttctcgttgagaaacataacgatggaactgggaggacttcgaaatcgaattactgcgtggttgatagtcttaatcgtgagctttgttgccgtgcttcgttctgtcccaagcagagtgactgcaagtctatcaagccaggccatttcccgtggtaactatagtgctgagttccctcaagaaattgagtttttggaagagttttgacctccatcttctcccggattcacagaaaacagtacacattcgtctgtattgagacgtcttggtgaattggaggagaaattacaggagcttgaagcaaagcaatctcaaatgccaccggatagagaggaattgctcaatggagccattcaccgtgttgatgcattggaagccgagctaatatctacaaagaaggtactgttgagtcttgacatatcatatgcactctgtgggtgtgcatgtgtgacaaggaagatgtactctcgttagatagcttattgcttagtggtatcaaggatataactactgttctgaggtaatgtttctatatgttatactattacacccaagaattggcagttcaccgaatttcttgattgttcgctatagtaagaactaagaactgaacaaaaaattgcgattttccatattgacctttgtttctcccatgagcagatgctttatgatgcattgatgaggctggacgaactgcttgcatacgccgaccagcaaaagaatattcaatttcgggtaagttgtggatttttcctatgaattactctttccttttgagaaatgcttgttcttgatgccaactactctttagttatggatgtgagtgagttcacccagaagtacctattgacccgctagtttatataaaaatgaatttattctttgttgctaagtgtgtgtttttttaagttaaactagattgagtcaaagggaacttcatgatttggttcgcacacatccctgttctatcgtactccctctgtttttaaatatatgacgccattaatgtttaacatacgttaaccattcgttttattaaaaaaagtgtaaatataaaaaatataagttatgcttgaagtatctttaataaaaaaataaatcataacaaaataaataatacttgcatagttttcttaataagatgaatggtcaaccatatatctaaaagtcaacaacatcatatagtattaggaaaaaaaatgtaaagaatatctcataacactgagctagccaattcatatgtgttcatccattatatgcagaaaaagaggttctgcttctaagtaccagagtggcttgcttgcttttctcctcgaaggtttcgtgttcttctgtcaactgaatacttgtaagttggactctttgtccaattttaaaactgtgaatattttgttcagccgtgtatctctgaatattaaagaaagaaagaaaggtgggtggtcactttgccacctatttgacttaataggcttaggtgtatttctaaattttgcaaggtgcggcgtgtagttcagagaaataaagggtgtaacatgtagaattgatatcttgttttcatgatcgattgagatgttatgatatattagtcaaacgttcataaacaaaatgtaaaaactagtagcctggagaagtatcccaagtaggtctttcagtgcaaaactatattggaggggcttcttctctgtctccactggatagcgtcggtgagcgaagacactagggactggaaattgtcagatctgaatcgatggggattcggccgattttagggacatagtgacgaatgaaatatggatgagagttgtgtatcaagatcaagacggtgcggttttttggcgcagcagggtacgtgaagcgggcggttttttagcgcgacagggttcgtgaggcagctaaagatcgaagcttagtcttctcgtcttttctttgctatattctgttgcttcttagttttggggcctgaatttttttatccatgtaacttttggctgtggatatagatgccgaatttctattcatctacttaaaagaaaaactatcctctcagtgtcaaaatatactcactccttcctaaattgatcatatcatatactctctccgttccaaattgatctacgtatagttttttttaggttatttctaaataatctacatatttatattcattcattaagtctatttgttatttgtgcattggagtaaatgaacattgatgcatgcatccatgcacacaagtatttataacccacatgtaatatcttgatttactattggctagaaaatagtggggatggtgtatgcatcgagtttgttgctagagtaaatatagtatgagagagttattaacttttcttggtcttggtgtacctatgaaatatgtagatcaatttggaatggaggggatatgtttatgcaccaaaaccaagaataatttaaatcacatcaattaagataccatgcacacattttcacacaatgcatgtatcgtttaaaacactatgccaaatactacaccttagtatgcacacattttctcatgctacattaattgtattttgatgaaatacgtgtccatgcggttatatgattatcaatttgaaaaattttgaattctattatatgatgatcaatttgaaaaggatggagtagctactaagcatatgtttggttgaagggttggtatagatcagattgggttgaacctatttttcatggtgtttggtttaagaacaaatggaatgggatggttactgataggggatattcctaagatctgggttgacatattccataaaaaactaacggacaaaatcaacccaactttttctctcgctagcatatgggtcttctcttaaaaagtagaatcatcttatttctcatgtcaaatggatagataccatcccatatgagtccaacctatctcacctcattcccaaacaaaacatatggtatggaagcacttggagggactataagaaaaccaacacatggtagggaaatacttggaaggactaataaaaactactacctccgtttcataatgtaagtctttctagcattgctcacattcatatggatgttaatgaatctagatatatgtatgtatagatttattaaatctatataaatatgagcaatggtagaaagtcttacattatgaaacggagggagtactgtgcaatgtaaaaataaccctcattataatctagggctaggcggttgtgtaatatattacctttatcttaaaatataacaactcattataactcattataggattggatataacataatactacgaaaagtagattgatagcggtaggatgggaaagtaggtgaaaaaaatcaactttttataatcctatgtagttatatttgaaataaatttaaaatttaaagataactatatttttgtagcgagggacatatacacaagcgcttaacataagtgtgaaagcacatggtaccgaccagtgcaatactaatccactttcaactatgatcaatcggaaaccagtgcaatactaatcccctgaggggctgtttggatcagggctaaaattttagtactttatcggatgtttaacactaattagaaatattaaatatagactaataacaaaaacccattttgtaaccctggactaattcgcgagacaaatctattgagactaattaataatacatgattagcctatatgatgctatagtaaacatgtgctaattatggattaattaggtttaaaaaatttgtctcgtgaattagctcttatttatgcaattagttttattattagtctacgcttaatacttctaattaatatcaaacatccgatgtgataggatttttagtcctttatcacatcggatatttgaacactaattagaagtattaaacgtagactattgacaaaacctattctataactctggactaattcgcgagacgaatctattgagcctaattaacccatgattagtctatgtgatgctacagtaaacattatctaattatggattaattaggcttaaaaaatttatctcatgaattagctctcatttatataattagttttataaatagtctatgtttaatactctaaattagttttcaaaaatttaatgtgacatgtactaaagtaactttagtactcgaatccaaacaccaccacggaatgggaatttctgatgcatattcttctcgtgatacctcggcatgtacgcggtcttttttcttggcacgcagttttgatgtttggggacatcatcatgcgcttatggcgtcagaccaaccaatcaagcagacgtgcaacgtgcaagagccacacgaccatctgcccatctagttgaagtgggtgattagacttgattgatcgactcgtacgtatagcttgtaggatctgaccgctagaatctcccattcttcacccaaattgttgcaccaacgtactgctgcttccacattcgacgcttccaaatcgagcttgctgtgcccttttcccgtcatggtttttgtttcgtcatggaacatcacgatcgtcagcaacaagtggactagggcaccgaatgggttccggtgaggaatgctacatgtacgaccaaatttacatgcatacaagtaacacgtggataattgaaggatattaggcagccatatctttcggtcgaagtatgaaaaatataccgcaaatgttacaaaagttacttgttatatcacgtctaattttttcaaggattttcaattctttatgttgactagaaaatagtgcccgtgcattgtaacgggaaaaatataagcttacgttaaaggttgcatgaatttgaaaaaatatatttttgtgattatgctaaggaccatgttggaaatttatacaccttatttacatttgtgtcattaaacataatgtcatgaaaactcaactttgtttagaaaaataattctgcaccgtaaaaaatatttaactaaatttagccttaa

SEQ ID NO: 44277 - DNA, 8573 bp, Oryza sativa
tttcacttccctcctccgcgctctaatccccaaaaattatcattttttctcctgtctcagtgagcatggactgcatggtagtgaaggaagagactaatggtaagtgctatggtagatatgaccattaccttcaaatttatctattttatttactcatgaactgctccctccgttttacaatgtaagtcattttaacattttttacatttatattgatgctaatgaatctagacatatatatatctatctagattcattagcatcaatatgaatgtgagaaatgttagaatgacttacattgtgaaacgaagaaagtaagagacaatccatacaatatatcatctctagtacacaaataccaatatctctaatgctctcacacttttcttgaaatttatgtggaggttgcctcttgatttaggggtggctcatcgtctttcttcacttttcttctctacctaatcactcaatctaatgtggtagaatgctggcctggaatacggatagaaggtggattaggaggtcaaaagatgtggcagaggagactgcaggtgtatggatttgttactcattagggcagtcccaacccatagtgtctataagcagtgtctatggtgccatatcaataagacatcacaatagaaaccacactccacaacccatgatttcttaaagtgggccattaataaatacatcatctctcttttctatcaatcatattaattcttcatctattatgaagacactactcttttccaatgcaaaacttgatagtgtttagtgcataggttcttgtgttgaagctgggtcttacatgagacccagtttcttcctctcttcactctctctcttaattaatatagtgccacataaactaaaagttctacatggtaatatagttaatgccatagaaactattttaggtggagggttgggactgtacttagtaaataaatctttgctttgattgcgtttcttccccatttttttctcctctcatcagccttttagtttccaaacggggaccgtggtgggtctagtcctcgtgggctcgatcaacaaagcagaatccatggaaatagcccacagtcctggtttggaaccagaatctgatcctattttgtactctctctatcgtatttttaagtgcagctatgagcttctatatttaacgtttgatcattcgtcttatttaaaatttttcataattagtagttttttattagtgacttatttttttaattttttatattttttaaataagatggacggtcaaacattaagcagagaaaccaacagctacacttaaaatatgacggtgggagtatctgtttcgtattggctgtcgacaagggtgttggctacacacaaaagaattatgtgaggatggaacgtgatgcggatagagtcggagtgacgaacgacgactaacaaaaacctaaacggaagccttacgtatttttttataagtatataggtatatataaatttggtgtcttaaaagataagacggttgtcggtgatatgtgcccggggttaccgggagtaccgaacttacaagggaggagtcgcccttggcatccacgtggcactcaccccgaggggtcgcgcctgtgaacgagtggaagccgtccgtacctaacctgaggggtcggccccgaaccctcgggctggtcaccacatggccaccatgcaaagacgattcgtggacgccccctccacgcccacctaatcgcatttagtgcgggcgaagcgggcagaacgagcgtgcctcgccacattaaatgtggcctgccgctcgcttgaccgaatcttgaccgacggacgggacggtggcaaagccacgtgcggtccgctcgggtctcaggcggagtgcagtaggtatgccctgtcccatcaagatgacgggaggcgcagcgcccaggacagagttcccggtgcgtacaaacctcaagtctacaaacattaaatgaagaatgacatggatcctcctccatgtcggcttgtgttagccggcatgatttgatggggcccgctcgacaaccgatgctcagaatttttatgcggtagcacaagacacacattcaacatagaggatatttacccttttgctccctccgtactcgtaaaggaagtcatttaggacaatgtttaagtcaaaccttgataatataaatcatgaataactctcaagttgttgagtttgaaaatgtaaaaattatatgaatagatttgtcttgaaaaatactttcataaaagtatacatatatcacttttcaataaatatttttatagaaaaaaaaatcaaagttgtgttttgaagaccatgtcgctgtccaaaatgacttcctttacgagtacggagggaatatgtgtttctattgaaagatatgcctttcgacctaataatcatcctcggtaattgactatattgtttttaatcgtgatatacatatacacatactcacatagtattgtttttttataaccattcctgttttcgtttgcttaggctggccttttgtggtcaaacaacaaagtttcaacggctattattggtgcatcttgcaaatttcttgccaacttgggaattaacgtgacatactaaggaaaaagagatacatactaaaaaccatccatttatagtgcccttggctgtagccacttacttctgttcgacgacaatgcagtgaagagactgcgaagacccaagctggaatgcgacactgcatattcacaacactgaggactgaatcagggatgccccccctagattcagattctggcgacggacaatggcaccgaagctgatctatgtcttgttttaggatttagtggagtgacgttgtaaattcggtggttgtattgatggtccaacttaactgaacaaagggtcacaaaacaactgaaatcttatattccgattcttttcaagtggcaaacgcctataaccctgtagaagagcccgtaggatgcaaagctatacctgtagagtttcatgacgtcaggaataacataaaaaatgaatttaggaatgtattgctcccaatttacaaaatatgcaaaattcggtgtagcttcaatgatgaattggtatccacataagggtgaatgtacttggacaaactattgcatttttttttgtcaattagagcaatagcaggctataagctggctacaaatatattttaaagagataaatgaagagaaagaagagcagtgggctacagatctgtagtcagctgcagcacggactccaaaaacgtaatgtgtgtatgacaggtgggaccagttattaatagtatagtaagcaactattgtataaattagttattatattggctatagctaatttgtagctagtagtggactgtactattaaacttgttcttacttccccgggcctacttcctaaaaaaaaacaacaacaatccgaacagtctaaaaaaactctcttcactttcctttccccacttcactttaaaaaactaattaatttattggtttctctatgtttctatggttatttgagaagctagctaaacataaacaaaaatctcctcatcatttataatttaatactagttctgtttttaatgtatgatgtctttttttctcaaacttcaacaaataacatttattcacttagctaatgaaagtgaaaacaatactattatatccctggtatgtttatatatttgcataaatatatttatagaaaagccgaatatatagtcagatgatcgagtttgtgtttgtgttggggcgtgggtaggtaattgggttttatctcgtagatactcttgtgaaacaattagtttgaacgcgacatagagttatatgcgtgcacgttaagtgaaacgaccctttcccgtgcacaggagtctggaggtgtatatgctgtagtggatgtgttgtattggtaaggctaagttcgtttaagtgtttaggctaaaattttcgacggcaggtgaaacgatacaagcctcagcacatgataaattaagtaattattgtaatcttataaaataatttatttgtttttcaagaaacttttttatagaaattttttacacgaaacatactatttcaaagtttaagaagtgctaacagagaacaagaaactagttgttccaaaaggctgtttagggtgcgttctatatagctgttaggattagctagttagctgcatgaaaagcgatgtactcctaagtcattagcatataatcctttagttttttaatagatgacgccattaactttttctcacatatttaaccattcgtcttattcaaaaattttatacaaatatataagatataaatcacacttaaaatactataagtgataaaacaactcataacaaaataaattataattaagtaaattttttgaataagacgaatgatcaaacatgtgaaaaaaagtcaacggcgtcatctattaaaaaacggaggtagtaataattaattaattattatctattgtatactttaaaaattgatttatttgattttttagagaaacttttttatataccgttttagcataaaatatatagtttagcagtttgagaaacatgctaatgttcaatgagagattagctcagctcaaactcagtttagaacgcggcctaagtcatatgcatctcttttgtgccttagaaaataagcctctctagagagtgacactttattctcagaatttcccctaccttaccttattccttgcaacagcatgtattcgtccgttacatcagagaactgtaaaagacgatggaccgaatgccctatataagctacatacatattatactgtgcacgagcataaagtcttaatattctctgcgattgtgagccaacagaatgaatgtgtggaaactacaaaaaccagggccctcgcctcatcgatgactaaccagattcacgcaactctatcagagcggctagcctgaagggtcgctatgctagtgtcaaaaagaagcttggagtagagcagcttagctacttgctgctactgcatttccatactataattcattcgtttcaaaatataaatatgtttagaatttatttttttatcacaatacaagtgttcttctctgatttcaatgcacaaaaaattatagctaatcaggtgtttggaaaggggttatttaagcaaactaaaattcaaaatttgaccactgagataactaaatagaaacaacctggaaatacctatattttagaacagagtaagcatgaatgacgcttttcaaatggcaatcatgttataacactgatcagtacagtactaggcatatatagtgcgcatgcaatggctacctagctaacgaagaagcttttcacctggtgaacactacaaacaaccacaccggcccaattgaccctgagccctaccatgcgccactacaggggaaaggcctcaatgagaatccaaaaagaaccaccacctcttctatcaccagcaccagcatatgcttcgcgtacagttcctaccatttcagtatctgctttttcgtgccaacttggtactaatatattacctgcaccgaaccgattcctattagtcggccgggttgtttacaatgacgcctaccaatttgcattcacacgctatcatcttcatgcgagtttagaagaaaaaaatcggcactaataacgacaattcgacaaaacaaataatgccgacagtttgaatgtagatatttgctctcggaaagggtaatattatcatttttaagaaggtacagaaatgttataaaacttggtactttcagataccaaaatttctaatataaaatttaggtacttcctcaacaaccataaaatttctaaagaaaaaggctggactatcaaagggcttgcttttccccgcaaaaaaaaaggggcttgctttcagtcttgacaatcttgttctcagaatcgcagagcacataacataacgaggtgctgtgattttttgagttaactggccaatgaaagtttatgtcaacaaaatcttcaatgtttcttctctattgcaagcaagtgcgatgttattttcttatatgttttcaagataatctgattaagtgttgtcaactgcatctcttatatgcagcagtgccttctgaactactgtaaattttccccatttcaagggaataaagcagttgtactttgtgctttaaaaaaaggaaaagatgagtaaaaccggtcttgttttcagcttggtaagctgagtagctgacactttgcaactttcagaggtcatacgcagtgtcctgagtggacaaagtgttatgcattgataccttaaatattgtatctagagacaaaaattgtggaatatatcggccatatctagaatttaaaatgtgttgtcaaattaaagggcattagacacttgcagtaatgtatgtggccgttgtaacgcatttgctaggccagaattcgcattttgcttgttctgctttacctgaaatacaaaaggaagatgcctattagctatttagctaagcctatatgtctggaatttcttttgtctagtctatgtcagtacttgtgtaaatgcctttgctaaacttcaactgtaaaagctagccaagttatagtattttttacattgtttgtccttgcttttcataagtgcagacaagattcttgttggttctcagaatttacttttcctgatatgatgttagtccacagattttcactgtgtgattaacataaagcctacctaatgtaaagggtttaggctttcttgtgtatcagtatatgaaattatgtgtttatttgcttcttcaagaataaagttcgcgcgagcgtaaagataattcttgcctgaaaatgactggaactatgacaactccagctaactcgtgaacagttagtgtgtagttctcctgctttctctttttagccgggtcgcaggaaatgtctcctgctttctacgttagcatattgctcgtccgttgcaatgaaattttaattaataaaatgtatcatcaacccatcattattttgcgtttacatctttatatttgttacaaatatgtaagccatctagctcctcagtcttttttcttcccataataattagagagtaggtagtagggatagctgacatgcggattctctgactctacatgccatttcttcattttaaaaggatagagtgttagtgatggggatggtgtccaattcatcaccacttaccaccatcactactttttatagagtacagaacagttatatagatggtgtttgccatatgtttctttacgtctctgatttgaaacttcaccaggctgggatgagattgcccaggaatgaccagcctgggcaccgcataagtgcaaactacaccaggctggccatccaaaataaagtctagacctcagacaggttggcaacttgaggatagccaaatggctctatctgccccctacgttgacagacccaggagatggccctccacctccttgcagggtgcatatacacaagaacttaggcggctctagcggattggacaacatacggtcagctagaccctacccagtggcagcaagcatcgatagtgctagagtggtgagagaatacttcaagcataaaagaagcaccaaagaaaggcactacacacactaacactgctaattgcctgagagatatgaaacgaaaggaatcgtaggaccttcccacataaggagctcttggcgcccagtcttctggccaaaatcaaggaggagaccaaaacgtgggtcctgacgggtgtgaaaaagctcggtgcaatgcttacattttagttagcttggaccaaaggtcttgaggctgtacatttttttcctttcttttttgatatgtacagttttcttcttctctattaaatgaaattgacgactcgccgattcgttacaaaaagtattcactgcaagagaaacggccaactcacatcatctgttcatgttttacaagcaaaacaacaaaatggaaggacaaaccagggttaaatggttttaggcttttacttcatttgtcctcaaatataagtatttatgagagttaaatttatgtactgtataaacatttatggaacactgattccaatacacataaatccaaacattgcattcgagaaaaaaaataaaaaatagatccaagcattgtcagctaatcagatatttatgtagggaattcaggcaattcaaaaatttacaatttgataaacgagacaactgaaagagaatattttactttgtccttaaactttgctcaataggataaaagtctttatgccatgtatctagaaatagagggagtagattgtagagtagctaacaaccaagattcggtgacgaaccccgattcagctctgtcggccattgtcttcgattttgagtagggttggggcgaagcaagctgacgatgagcagatcaaggtgttgacaggacgctgacaagtggggtgctgacgagtagatcaaggcgggcacaaatggtagacgatgagaagatcgagacaacgacgaacaaatcgaaaagatgcaaatcagggcagccattgccggcgacgagctcccggcaacg

SEQ ID NO: 44278 - DNA, 6591 bp, Oryza sativa
  unsure (1)..(6591): unsure at all n locations
aaaagctcgctccactaccccgcgctaacgcacgcggctccaccttaagcttatggtcctccgatttctacctgtccggccgcgatacgccaccacgtattcccacaaaacaaaaggggaaaaaaaaaaggggcacgagacgaatggatgcgccgtgacaccagctgcgtgcagcgtatcgcacccaacccgtccattccatatgcacgtatcgtatcatatgatataataacgatgacaatatcttactagcaaatcatcgtaagttcatagggacatataggcaatgcgagccagctgatatttatctctctctctctcccccgacctagcagccatgttcctcttatgtgtgtgcgtgcgtgcacagttcgtgcaagttgggaggagacgcttgccaatggctggagccacatgatcgagccagcgattctgattccgttggcctgcctataaataccccgaggagcgagcactgcagatgccaaggcagaggccaaggtttcttctctgctagctaactagtgggctgcttgggtggggagcccgggccggcagatatcctgtctgaaacccttaggtatgtattttccctcaaatggctggttaatttcggctccgaaatggcagttcgcatactatcatgcgaatggcattgtcttcttcgccatcacttgtataaagtcactagtgcacatgtagctttcaagaatcaagaggatgatcactgctagctagcttatgcgtctgtttagttaggccaagcagcagcctgtgttgtgttacctactcatttccaattgcacccattgcatcaggaaccttccatctttcacttgtaaaaatcttactgcatctgttttgcctgttcaaacatggattttccatgctctctcaagtgtgaagcagatcgtttgcaacttgcagttgtgtttaggagccatagtagacagggtatcaattaagcacaaaggtcatgttgcatgcatgactcaaagtttttttttccttcatttttttttgggtgggaagaaaaagtttggaccaatggttttacgccagcttttatctcctgtagcatttcacgcactttcacgttgtgttttttctccctcccgggagtcaatctttcgccgtacgtgatatgataatatcgaatccgagcccatatgtccttgaagagactgacagaattgtactttatctgaaacccggttgctcggtcggtcacaccaaactgagccaaaaaggagatccgagttagacaaatcgcgccttgtttgcataaagcggcctaaacttagatgcccatattactatcacattattctgaagaatttttgttcagaaaacaaacattattctgaagaatctcttttgcacatcgcgtgtagcaattgttcgtcagtagcttgctacgttctacagttctctgcacgagtggcctaggtagatactgtatttttttttaatatcttgtgcgaaatgggtgtacaaaagcagagtcctgaacatgtacgcactgcattgcgtgatcacagggacagggacttcgaattcttggaggcaatggcgtcctcgttgctccactgctccgacaagctgccgttcatgaacgtggagaccgtcctccacatgaaggaaggcctcggcgagaccagctacgcgcagaactcgtcgcttcaggcgagcaccttgcttccttgccgctcatggccattgattctttttgatccgtgcatgcatttttttccgagttctggctctgagccatggcgtggccattcttgcagaggaggggcatggacacgctgaagagcctcatcaccaactcggcggcggacgtgtacctgtcgcagatgccggagaggttcgccgtcgccgacctcgggtgctcgtcggggccgaacgcgctgtgcctggcggaggacatcatcgggagcatcggccgcatctgctgccggtcgtcgcggccgccgccggagttctcggtgctcctcaacgacctcccgaccaacgacttcaacaccatcttcttcagcctgccggagttcaccgaccgtctcaaggccgccgccaagtccgacgagtggggccgccccatggtgttcctctccggcgtcccgggctccttctacggcaggctcttcccggccaagagcgttcacttcgtctgctcctgctccagcctgcactggctctcccaggtacttaactcctctgacactgttgcattgtttgatctaacgattaaccggtgtttaagtgggaaattttctaaatacttcaggttccttctgggcttcttgacgagatgaacaggccgatcaacaagggaaagatgtacatatcaagcacgagccccctggccgtgccagtggcctacctgaggcagtttcagagagacttcagcctgttcctcaagtcgcgcgcggcggaggtcttctccggcggccggatggtcctcgccatgctcggcaggcaggccgacggctatatcgacaggcgtaccaccttcctctgggagctcctctcggagtcgttcgcctccctggtcgcacaggtgagcagatagcctgatactcatcagtattcagaactctgaactgataatctgaacctgacggcaatgcaatgggtgggtgcaggggctggtcgaggaggacaaggtggacgcgtacaacgtgccgttctacgcgccgtcgataggggagatcgaggaggaggtgaggcgggagggatcgttcaggatggactacgtgcagacgtacgagatcaacctgagcagcagcggcgacgcgaggagggacggcaggacggtgtcgatggcgatcagggccatccaggagtccatgctcagccaccacttcggcccggagatcgtcgacgcgctcttcgccaagtacaccgagctcgtcaccgcgtccatggagagggaggaggtgaagagcgtccagattggggtcgtcctcaccaggttgtgacacaaaccacaaagctgtgacgactgaccagagcgatttgtaccagtttatagtttgaccccatgtttctgaattctaatgtgtgaccatgtggtgtttagttgttgtattgagtaactgatgatattaacaaattccatgtgtacttaactggtaggatggaaagaaattaatggaaagtggattaacaagtgtgttgaaatgccataaatcgtccgctactcccctttatcatcagtaattcaatatccagcaatactactgattttgtggtttatagctagctacacattcatacgaacgctaataaagttttgcgacttttttttggtttcgtaaaaagaaaaaacatttttttctcgcaaattttttaacgctttttatactttccctcaaaattaatgtcacaaatgtgaaaacaactgaacatgaggccttgtaatgggctggcaagagcaaacaagggcaacaaatttcgaccatcgtgggatgagatgggcttaaggaggcattagggcttgttcagtttgttgctaaaatcaaccatactaaattttggcattgtcaaattttggccaaattttggtaaggcaataaactaaatgacactttaccatcacaaccttgccaatccctaccaacatttgggattctagaaacttctactcatataactatatcaaaaattgttgaggtgtcaaactaaaggcctgttcactttgatgccaaaaaaaaccctatcaaaatttgtcattaccaaaattttggtaactatgccaaaattttggcatgatttcttatatagttaccaaaatttggtagcaaactaaatgtagccacttttttagcaactttatcaaaatttggtaaggttgaaaatgacatcaaagtgaacaggccctaaactccatcttcacagcttgatctttgctaaaattttagcatcaccaaattttgccttttcaacaaatggtaaggtcttttttgcaatgaactgaacaaaccctttgtttttgtatgtgaggcccattaaggaataagtccatttatatccctcactttttgttgagttggaaatcttaacccctaacttacaaaaccgggttaaattaggtcctatagcagtattgagggctggtttcactggcatgacatactagtcagcgaaagaaagtcagtgaaaagaaaataaaaaaacatatagggcccacatgtaagtgagcttgcacttcttccccaactaccctctcttctcatccctcgacctcaacctctctctcccccaagagctcgccggtaaggagaggggcggtgggcggtggctggcgagagaggagcaagatggcggtggctcatatccttaccgacgagccctacgtgggaggttggaggaggagatggcgcagtggagaggggatggagcgagggggcgaccgccgtcaagggtggagctcggggagccgccatcggtgtggagagggtcactgcggctagaatatgtgtaacaaccctccctccagaaccgcgtagccagtccatccgacgggcgggcccacttacacataccactccacttatactttcgtcttcgttttgtgtaaaaaggttaacccgggagtgagatatggttggagggaagatgccttataagttggtttcacccttactaaactagcaaggtggtactaaacatgcacacacagctctcatgggtcatacatgcctcatcctaattgggccaggatgtcacaatatggctgacgctgtccttactcgcaaccgctgccgagggcgatggtggcagtgaacctgtggttgccgaagcaagagctgacgatcacatcatggcagtaggaggagcacaatcagtggactccatggtttcaccatgggcagggtgattgggaggcttcgggtggccttggcctctagctcgatcgtatcagtagtgagtgatgctttggcctcctgtttgggtggctttgctatagcgcctccctcatggccatcgtcgctgagatccatcaaggtatgagaatgggtcaccgcgccttccccatggcttggtgatcgcgttgcatcgtggagcacgaaatgaagcgctacgagagcggtgatccacaatgagtaagtgctctgtgtgttaggatagttgctcgcgcttcactggggaggcatggttgtgatgctgaagcaagcgtgccggtttaagaagctcgtgatcattgnnnnnnnnnnnnnnnnnnnnnnnnnnnnnnnnnnnnnnnnacatgaccatcaacagtacaaacagccaacagacaactgaatccatatagggaaaaaaaagtacagaggccagataagcaaatgaacctagtagtgctgaagaataaatctagagagagacaaaaatgatgtgatgaaacgacttaaaaaaagacatacccggagttaggagaaaacccttgttgagaccatgaaatagatcgagcgcataattcagtttcacgtgctaaggaagtgggcattatacatggttcaaagagatctgcaaaataagcaataaaaactgattcttggtgcgcaccttctatcgatgtccagtgttacttttcagtttgtcacaagagaagttgactgccaaaaatttcatgtaatcaagataattacatattaaaattacaattttatttttgtaggaactcaaatccacactgctgaattgatgtttaagaaagcgtaacttctggatgcatattgttgaattgcatcttcacatgcaattagcctaaggcattgcttaataatttttaaagaaagcaaagtgtacatattgatgatatttatcatcatttggagttgtccaccgtgatctcaagcacaacagccacccataacatttaagttgttgacagaactctaaagtaactgctaaactcaagctgtcccaatcattttttcttactatgcagtgctaacataaagaaacttaacaccgagcatctcttccactccacttcggcaatcatattatccgtctaaactgataacacgtgaaaagcaaaaggaatgcagcacaaattcatgtgtttcactggaaaccgtaccttctctgttaaccactcctatgggaaatgggtcgctaggacgaagaacaaccagttcccgaggcccctccagtgcagatgggttctagaatcaaaaacacaagatgaacagtcataactcctgaggaggacaacatggttcgaatacactaatgcaatgaaaccacacataccaggatagtgataaggtgaccagaggcaacagccaccaggttctcagtcgaccaagcgattgcatttgggtacgacggcgacgcgatcaaggtggcagcctggtaatgcgaagccatggcactcacaacaaaaccaggcggaaattaacgcgggacaagggggttcagttgagccactgactgcacctgcacctcgtctaagttctatcatcctatatgtaagtccacagcatgcttgtttgacacatgggggaaaatcctcactgcagatggatcgggtttaatcccccaccacccaattcctcttcgctacggagaaatttcagctaagccctaggaaaggaa

SEQ ID NO: 44279 - DNA, 16855 bp, Oryza sativa
gacaatgtttggctagaaaataagtatatgacatgtatatccatggaacaggaaagtgtggcttgccacaactgaagcaagtaaccaaacgctaagctaacaatctgtggcatgcctaacatgttgtgtggcaatatgtggcacctaaccaaacagcccatttgtactaaaaagcagtcgattttaaattattcaaatcttacacctttaaatttctcatttacactttaatatttatggcatatcaaataagacgtcagcatgtatcactagcttcaggggttgcatgtgttcgtcacagtttatggtaggaaaataaattacactcctccgtgaagaggcaaaaaagagaaaccaagcaacactacagcataaaacacagtataaattatacagttcaaagtttgactgatttccatggagaaatgtagcgacacatctctggcagaaaagaacgaacaagtatataattatcgtaattatatatttcggccggcgcttcgccggcccgacgagaagtatataattatcgtaacaagatgaagattgatgcattacactattcgagtagcacaaaaacaacttgaccgtcggaatcagaacaaatatctggattcgatagctcacatctatctgccagataaaacgaaatcgatcctctcctctctaaccaagtctcctgccattaggatttaggcagttagccctaacgacttgtggaccttggcgtgacaacaccaacagttattcagtttccagttctgactcgaaaagaatcgaccccgtccgtgctacccgcaggtcgtcttggcaacgatggggctccgcacgcgatgcttccggtccgggtccgactccgactcctccgaccactcgatgcttccgaacacgtagttggcggccgccgcggcgtcttgcaccttcagcctcaccgtgaactccctctcctccccgtaggactcgaagctgagctcgggcggatacaccgtgaccttcacccccgccagcgcctcggtgacgctgaccgcgtaccggcacggcgccgcgccgacgttcttcacccggcgccgcaccgtcgcggagccggacaggcacggcacggcgatggacgggtagttgaggtcctcggggcggccgtactgcgcgccctggctgcacgcgcgcggcttgccgtcgtcgccgaacaccgggagcgggagagggttctgggtgggcctcagggcgcagaggaagtcggcgtagtcggccgacgtggtgtcgtacacgaggcccgggtccagcgcctgcacggacctcacgtgccccgacccgtaggcgaacggcgtcgcggccgcgccggtctcgtcccggatcttgccgctgtcgttgtccccggtgatcgctgcaatgcacaggcatattaaggacgtgagatcgatcagagtttatgtgatgtttgcgctggctcgattgatcgcgatctgcatttctcgctcacctgtggtcatgatcgccgacttgatcatcgcgggggtccagtcggggtacttggtcttgatcaggccgacgatgcccgacacgtgagggcacgacatggaggtgccggacattatgttgtaggggacacggcggtcgtcgaaagagagttccgtcggcgaaaccgcctcgctgtaagccgcgatgacgctgactcctggcgcggtgatgtcaggctgcaaaatcaccaccaggttagcatacacacacagctgctggtcctatttggaaggggcaagctttctctctcgagtatctgtaggaatacgatgagcaatgtgccaaccttgagaatctggggagttatcgggtttggcccacgggaagagaaggctgccatcacaggcgctggctttacgccaagcctggcatccgatgcagtgatgtaaccgaccgggttgctacatgaaccagagcagtaacgttaattagtatagtatataaccatgctgtgatgtgttgcacctgaaaagtagtactatgtgctgatgagcgatgcttactctgttgacccgaggtagttaaagaggttgatgcactgggagtaggagacgtgagccgccgcgatgaggtgcgggtccgcgatgacatcctccccgttgccggcgtagttgcagagcaccatgccaacgccgccggcctgcttcaccaccagccccttctcaactctggcgttcacccctctggtgcagacaactatcttgccgcgcaccttgtcgctgtccagggagccagggaagcacaacgtcctgcacgcacgcagcagtgcaagcaaatcgacgtcggttcgattcgatcggtgcaagtcgagatgatatctgagtttttgatttcttacgagttctcgctcggtacgtttgcggcgttggcgttcttcgcgttgatcatcgcgtaccgttgcccttgaggcagagtgctgtttgacagactttgcccctgcaaattgcccaaatcccaatggcatgagcaaaagtacgccgtattctcatgtgcgcaaactacagtgtgatttggtcggtcgtattgtcaaaccttgatggtcatgctgctcgtgacgccgccgaaggtgacataagccgggaagtccctgtccatggtgctcgcgccgaccgtaagtatccatggtgccacgttggtgaccgagcccggctgcgggccggagttgctggcggagcagacgacgatgacgcccttctggacggcgtagaacgcgccgatggcgatcgggtccgacaggtagtcgtccgccggcccgccgacggagagcgagagcacgttcacgccgtcttccaccgccgtgaccatggccgcgaggatgtccgagctggagcagccctcggcgtagcacgccttgtaggcggcgacccgcgccagcggcgagccgcccttggccgtgcccttcccatggccgaacacgctggcgtccggcacgaacccgccgccggcggtggacagcgtgtgcgtgccgtgcccgatgtagtcccgtggcgtgtacagctctgcagcctggcttggcggcttcccctgcagcaagcccgacgctaggaagccgaggttgaagaaccccgcgccgatcagcttgctgcatgtacgacatgttagtttctcgccagaaaatttactgcattagttgcatgcagcttgatgagcagctgtggacagtggagttacttgttgcatttgaaggtcgtgtcgttgccagtgatgcacttgccgcgccacctcgacgggactgaatagccgtcgtctttgaagctcgcggattccggccatacaccttcatttgtagggagtacgtgcacgcacagaaaataagaatcaggagttcaggaatcagaacaggttccggctatggctaactgcacagcacttcagtacagcagataggacgacagcacatctgaaccaggccaccagggatcccgtaatccaacagaggcacaggcgcactgcgcccatggcgacgctaccattttgcgaggtttgaattgactttttagttcccgtattcttgggatttgattctgttaacctcatgtcatcttggggtgattattttaagttatctcgcgcatgtatctcatcgggaagcatgtaccgatgcacggaataactgattcgctccgatcgttctgtgttcattatttggggctgtgtttctcaatttcacttcctcatattctagggcacccgcaatggttatctatagactctctacaagagatccatgtcagcatatttttctacttggaacagattaaatgaagagagagagagtaaatctatctactaaactggagatagtttatagagaaaaacgaggcaatggatgagagagctacagatacccatgtagacatactattgaggtggtttactatcaatctagtctattgctgagatgtacatttttatagagagcaccttactttactattgtgggtgctcttagtgcgttttttttaaaaaaaaatccattgaaaaattaatttaaaaaattcgattttcattagtttttggttgctagcggttgtaccagtcgctcgtgaaatccattttgatcgtctcgaatatcatttttcaagtagtggtacctgtgtcgacgttgccgatgatagcgtccaccccgtacttcgcggcgtccttccacgcaccggtcgccgcgccatttcgctctagctcgaggaaatcccaggaacgcgtcgtgtggaccttgtgcaggacgtcggggatcacggccagcacgccgggcagctctgagtccaaagtacgcgaaaaaaagaacgcgctcgtcagtgacaggtatgaactgcaaactccaaggggggaacacactataacatgatgatatatgtggcgtacgcttgatgactcctacgaaactctcatcgatctgcaccacgatcacttggatggggctcaagacgtacagtaactgaaagctgtttatttttacggcacaaaatgaacacattagtgatgtaggagtacatagctagtagcctagtacggtagcaccgacatccataacggccacactagtattttctgacctggtgacgactgtagcaagcaaaccagaaggagaagctggtaagccatcaaagacgatcacataagtctgcatgcacgaaagtaccccgcttcatggattagagatcgtcaatagaacatttaatcgcagtcctatatttgttgacttgcttgtattgtacgtgacgaatatacgatggaaaaacatttttgcagttttaaggaatatataccctgttttctgtcatatatcatcgaaatagttataaaaattaaataaatttaacaacacaaattaatatgtgatatatcactctttgtaactctaaattagaaataaataaataaatacgacggtaagtagtacacgttacagtttagtttgattttctcattgaatttagttgttgatttataattgatcaaatttaaatcacatatgaatatgttatatatgttgccatttttttttgtaaaactatttgagtggcaagaagtaaaagagcatccccttaaaaatataatctccatgtatgattaaaaaatccattaaatacatttttttaaaaaaatatttttcataaatattcgaatgacatacaagagaaacgagaggacatgcaattaaagaacaaaatgactttggcggatatatttttaaaaaatattgagggcatgtatgatgaatagatcgagagggtaagagagagaagtgaagaaagagcattgcctttgtgcctgcggacgccggcgcctgcagcgcgaggaagagcaccaaggcgaggagaaaaactcgggaccgtcccctcattctgatgattggttgatctgcttcgtgtctactctgttcacataatcccgcaatttatagacgccaaggtcaaccttctgatcagtatgtccgtagtgaggagcacgagctcacgtgttggataacctggcatctactcctaagtcaccagtactgcttaattaccagacagcagataatggatccgtccacatgcgcgcgcagcatgcaaaacagctagtgctcaggattagagcaaaggcattagagcagtccaaaccctctttctcacacctagcttacataccgttaaatatacagtcacctatgtcggatggaagttcgtcacattcgttgggagattagacttttattttcttcctcctccccctcctgtatcttgtccccttcgtgtttttgatttttcggcccgctctgtaaatacttttattccttcttaatataaagatgcgtctctcgcgtatttaaaaaaaaaacagtcacataagtaaaaagaggcgataaaatagttaatgagaagagatgaaaaaaaagatgaagaaatcatttcttacgaagaaaccagctctgtgtagcaaccaataataaaattgagagagaataaaagtgattggatgggattttattttgagctctatagataatccctgtttatagttggacgtggccagctatcatacctgaacttttgtaaaaaaacagaaccctaagaacatagctggcttacgggctttatatttgccggaaattgactcaagtttatttaaatcagcagatcgaatatggagatctaccctaccaatatattatttgccctcctgattggagtgggcaatagttgtttagaaaatcatagaagcatgaattcaaatggtccaacttgtcaagattctccccctaaaagaacttgtcaggattcaagtcttgattatttcctccaacatattgcatttgtgtcccttacaagaacggcacaagatatgcacaaaatactagcaatgccatgttacttgacaagggcacattcttaacgaaactacatgaaatcccgcacaatattacgggagcttggtatgataatagtagaaatagcgtataagataactaaataatataagtttatataatcatcatatttgatcgatcattgaaaaaaagctataaaccattaaattgatgttgtttatgataacttaaacaatatcaatcaatccttctcaagccggcagttttgcctattgttgattggtccacgtggcacaacaatgtttgagaaataattggaaattaataagtgtaaaaaattgctaggctctgtaaaacaaaataaatcaagagaagtatctagagatatgcagtgtgctgtgggttagaataaattttctttcaatgatgccgcatactccatgtccttctcgattttcatcgagaacgacctagtgagcatgacaacgttgactgtgaagtctcggatgacaacgagtactcatttgagttgaagtcggggggctactgtcatggttacggataaggcatatctcatatcctatgacttatggaatatgtggatacggcatgttttcgtatgtatgatatgtttccgtatacgataaggtaattatcaagagattatggaaattaccctcgcgggcaagtgtaacgctccgcatttcgtgaggcgttaaaaactatttcggcaaaatcctatatgcgaaaatttcattctttgagtgctgagtctaagtcgtgccgtggatctcgatataaatctccttgatccctctcgtcgaattcaaaaatcgcctcatcaaaatcccccacctcaagtttccaattccgattcgagtctccgaaatcaaattcctaaagtcaatcccctcctttgaatcctctccaaataattgttcccaaaagtatcaaactcccgctttgtttccttcctcatctccttgaacccttgtgcacaagtatcaaatttagattcaaatccaagctgcaattctctccaattcaaattctaagcagaagtctattttgactccctcttggtcgttgggccgattcttcctcccttggcccatctcctccctcagcctcgcacgtgcattgcacgcgccgagctgagccgagccgagagagagagagctctcgccctctcgttctttctctctctccctctctggttctctctctctctctcgccgagctcctccaccggcgtcaaatcccccgctctccgccattcaattttcggtcggccgccgtttcccccgcgcgcgcgcgccctggtggcaaccgtcgcccggtcgccgcccgtgcccgcgctgccgcccagtcgccgccgcgtcagccctgccacgcctacgccgtgcagccgccgaaccccgctcgcttttttgcagtcatcgccgctgtcatcgcccagtcccgacgcccccatgccgcatgcttccaaaacgcggagccagagctcgcgctctctccctcctcctttctcccaaaatggcatgggcagagctccctttctctccccttttcttctttttccctgaccagcgccattgtcacctccactgtcgcccccaccttgacccaaccgagctccccttgactgcccgtgctcggttccttcccctcgaagctccacaccccacgcctataaaaccacagccaagccgctcgcctgctctctctctctgttcttgccaccctcgccgccttgctgccgctgtccttgcctccctccgccgccgtgtgtgctggtgaagccggcgtgcgcgcgaggagctaacgcggactccgggcaccctcatcttcctcttccccggcccgaggccgtagcgatcatgccccgcgccgtcggccgctcgtcacagcgcccgtctcggctcggtagtgcctccctccgttctcccttctcgcttgccctctccctcttttagctcgcgtggtagctcggtagccctcctgaacgcgcgtagacgaagccccgccgccgcccggcatggcctcgccaccattgccacccgttccggggagccgccgctcgtcggcctccctcgaggcccctccgtcccatccgaccccgagaatgagttccccgaacaacggagatgctcccgacgccttgaatcgaaccctcgccgccccgccagtttttccccttttgcacgccgccagccgccgccgtcgcaatccaccgcccttgacctctcccggcgcgatccgagccattggctcgtcctctcttgtgccgctcgccaatccggtgtgctcccccttgaccatagtcgtcttgtcgagctccggtgaactcggccgccgtccgccgtccatctcggccttccccttcttcctcctcccgctggcccgcgtggctgccacgaaggcgccacgtcggcgccatctcggctgcgaccggttcaaggctgaccctggtccaacgctcccctgcacccccgctcgcgcgcgcgcggtccaccgcgagccatgaggctgctcgtgggcccgccgcatccgcgtccaccgcaaaccgcacgtgcgctgcgactccccctcccaaaccctagcgcgctccgcgtgcgccccgctcacggtgagccgagccgctaacaagcgggtcccactcgggaccacgcgaggtgagcccggtccatcggttccctctctcctcgcctcccgcgcgccctaatgggccgtgtctccttaggctggccggcccgttatctcggccttagggtctccggctgggtgatccaggttagtaatgtcgtgtgggtaaagtgtacctcctctgcagaggttaactaactgttcgaacagccgtgcccacggtcatgggcggatgtgaggtgtttcctgtagcgtagatttgtttgcctgtgctttgtgaaaagttgttgtggtttgggaatcgttaccagaatcagcctatgtggcagatggatgacctgagtggtcaagaaacgaatctgtgtgattcgggatgtctacgggcatcatagactaggcttcctgagtggaagcggattgttgtgctgctgggcagctggactctgggagtccgagaaaatgaaaaggctttgggagccgattaatcaagtgaaatggctctgggagccgagaagtaatgatctgaaccgggaggtcggtacattaccaaatgagctgttgaaaaacatctcttaaagtcgaatcgagacacaaatctctttttggcccaaacttagaaagaaataaatcacttagtgatttcaaaatgatttccaaaacaaaagatttgcaaaacaaccttgcctctcttccaagcttgcatcagacacctaaattcccgtgacttgctgagtgcgaaagtactcacccttgctctatataaatatagttcctctgccttgaagtcaagatgaagtgaagtgaagattaaggtttcgtcctggttcccagccgtcgcctgtggtgttaggtgttagttcattggttccgctgctgctgctgctgttgatgtttcctcgtccgcgtcgtcggttgtattctcaggctgtcctgagctgcaacctaagttaaggtaaataagttctctattaaatttaaggattgcaatgattcatatttgtcaccgtgggtaccagtgctaagtcctgggactggtactgtgatcgcagtttcgtaggaagcagttcgcgccgtttttcctatgacacgctcctatcaggtgccgttgtccggcggtgccagattggggtgtgacagcaagtgaatagcagagtcctacttggagagaatcgggtttatactatatcatgcggggtccgtagtctccgagttctacttgaagactaaggtgattcacggtgtaaaaggcataccccctgaggggtttagatgaccgaatcatagcgccagcaccaccaccatagcctacaatccggaggacgtgaagcctactcgccatgagatctcgttgaaaccatctcgacaagggtctcgccaacgacaagggtctcgccaacgacaagggtctcgccgataatcccaggattattggtcttctattgtaatatgtggttttttcatatctatctcatatatataaactggattagggctattaccttacgagggcccgaaccagtataatccttgtcttttcgtttgcttgatgttgtatcgtgtagatcctcgtaccaacataccctaatactctatttatccggtttatgggtatccccgtcgacaaaaggatacagatacccttgaagtgaaggatctagatagatcctgatgtgtgtgaagttaaaaatcgagataaacagggtttcaacttttagtatcttccctgctcacaacacacatagacattaagataaatctagggatcattggtgtgctgaaaaacaaaacaattatcttctcattagcaatcaaataaatttgcattccttgaacctctcgatcaaatataaatccattgttaagaaaaactctataagaaatcaaacattgtggaaaaaaagtctcacttgcctttcggctacgacaccatcgtcgccttgatggtgatggtaaacccctgtcaagctcacgttgacgccctcgctacttccatataccaatgagacaaaatgccaatggttgatagctgagagcacagcaacgctaaccttgtgctggacagcgagctattgttgcgcaatggcaaatctaaggagttgtggagtttaagaggacacacaacttgggttcaattgaatttattgaaaaattaggttgaattgagttagtaaatcataactcgagttttttttttgtaagaacaagtaacagagctagtcaaacatactccctctctcccagtttgatcatcgcctaagtttttgaggttttctcaaaatgatgatcatctaacaaagtgtctctttatttatttgtacaaagagtaaatgcacatcgtggaatgccctgcatgcatgcatgcaactatacacattcggtcaaccaatattaatttctattggttcaacccatgcaacatttaaagcgtgaattaatttatgttggacacgaggggatatagcacattcatcgatgcggattaattttagaatgatgaatgcgttgatgttattggttttggtaccatttgcttaggagatgatcaaaatgagatggagggagtattttctttatacaatcatcgttcgtttgacactgattgaaacaaattaaaggattttacagaaattggattaaggctagcaaaatatcttcaatattttttttgaaaaggatcttagcatggattatactagcaaggcgtgccgattttctagtatatattaataattgaccaaaagcaaaagtaaggtggtgtgacttcatgagagaagaaaatgagagataacttaaagcatagagtagtcatccaagggatagaaacaattaaagtgtcgtggcttaatgagagaagagataaacaattaattaagtggggatgcaatatactggatatcgtagaaatataatgaattgatatatatattgaaatgctatgtagatgatgtgtaatgatgatttaacatgctaatattttaaatctctaaaatacaacaaattataaataacgtagtatgcctgtattctttagtgcggagtggagactaatcccatgcatggaaaacatagcaaacttaaaaaaaatagattaatatattttttaagcaatttctgtatttttttttaaaaaaaacataactgtgcgtgcggaaacgagatactggaggttgggaaccttaggaaacaaacacaacttgaagatacaataattgccagtgaatgatgatgtgacatctttacatgttaagttttagaatgtggtgggttgtaactaaaagtgcacctaacccccctcctatgtgggttttggtgattaatgacaaaatgattaagggacttatgattttactgagtaaatgcaggtgtattagtcccaggttgcttacgaggtggctaggatgcttggagcccccaaatcatcaaattcaaagtggtgaaaagaattggagccgagttaggctagtttaatttttcactttgagtttaggaaaaaccttactattaagaggggtttcaagtgtggttctgagatactctaagtgcccttagctatatccaacagttgaaatatttttaggagctatttttggaaatagcctcctcaagatagcaaagcatgtctggaagctttaggcccccatgtccggaacttccgggccgaggagaaatgaagaaaatttcctaaatgatgaccgaaagttcctggcaccaaggaccggaacttccgggcaacattccggttcaaaaatgtgagtaacagctagatgacatcatctagccgttatatatatcaaactcgaccctaactcactcttttgccatttcacttttgctcttctgttccttagtggtttctagcttttcgcaatgtgattttgctctctccaccccaatcttgagcccttcttgtgtgtgagagtgattttgagggtgaaggtaaggattggagaaggttttgaaggctaggatggtttgagcacttactcttggtgacggagcgtggggctcctcaccgggagaccgcgcaggcccccctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggatttacagagagccggagagccagagagttcaggctccagaacccctctcgcttcccctccctcctctctttttggtgggcaaggtcctccttttatatctcaaggggatactacatgcaccacttctacctacttttcttctgggtggggacctaccctatcttgaccaaaacttggcttgcaccttcgcctggaagctaaatcacaacttgtccttgagtgaggctcagcgccgtctctcgcctgacaccggggatctccctgttactccctcattaatgggcggagatttgccatggctgctttccaaatgaccatccgacgagatgggtcatacctacctccactccatcggaggcagatgcatcgcgggagcacggttgtctgccgatgacgtgaccggcgtcagaccagtcacagaccggtcattcttgtccaccacgtgtcagttcagcatgctacacgtctgcccttcttcatacaatgacttccttgcaatggttgccatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccacgatctgaccggtctgtgaccggtcacacactgtgacctgtcacggaccgaacgagtgtgctgcgctgcattaaatgcgacatggggcgctcgtccaacccgcaataaacgcggttaggtgagcgccgctgtgctcacctaacccacacacgtggcgccaaacccacagggggccggggcgccccagccctcggggccgaaacgggagcggcccgacccctcggggagacagagggaggggcggccacatcaccctcgggcccgacccccccccgagggggtcaggccacgtgggtgactgcagctgccccaaacctctagtcaagatacccccggtcccatgtcaccgacagtagcccccggcgttacgctagggcgatcgcccccccgagggaagcgctcgggcgtgacgccactccttagacctggtgacaggtggggccggtctccacaggcggcagaaacccagcggtcgcaaatcgcgcacatcgtcaaggaaaaaaccgaccgacaataatgagcggcttccttcaagaccgctacattacttaagtagcgcgcgaaccgggacgagctggttcgtttcgcctggagatgtgatgacggtgcatcggtcggcgagcgtagttaacgcgcgcacgatatgtcccatctcgactgccatggccgcacatccgcctcgtgcgccgcaaacgggcgagcgggattagtggaggcgtgggcgcgagagacgagggggcgaggtagtgggcgcggggatcgaggagccgggcatagcgttggcaagggtactaagacatcaaggaagggatttgtttccttcctctcgtcactcttccctttgcctttgccacttgtgctctgactctccgtttccggcgccctacccttgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccaccggccgggaggtggtcgcgctgggcgagggacgcccggcgccgcattacccggggcggtccgtcttcttcctctctttcgcaatggcagggctggtcccgccattctcttctttcttcatggatgttctggagctttatgatctccagatggcgcacctcacccccaacgcggtaatgacgttggccatcttcgcgcacctatgcgagatgttcatcggggtgcgcccatctctccggctgttccggtggttcttcaccgtacagccggtgtcgccaccgtcggtagtcggtggctgctacttccagccgcgggggccggtgctgaactgctacattccctgcgtccttcgcaagaagtgggacgactggaagagcgactggttctacacccctctcgccgacgaagcgcgcctccgacttccgagccagcccccagcgcaggcctccagctggcgggcgccggtagatctgggagatggctacgacgccgttcttgactgcctggcgggtctgcgatcccaggggctcacgggggccatggtgttcggtgactaccttcatcgccggatcgcgccactccagcggcgcgcccggggcgcctgggagtacaccgggtctaaggactacatgaggacccaccaggggggcagatgggactgggcccctgaggacttcaagatggtggtccaacgggtgctgaatctcagctccgtggaggcatccctcatcccccaaggtgtcctccccctctgcagcgatccagagcgcgccaacatcctgaccatcatgcaggcggtcggggcgtcaggggagtgggctcctcgaggccacgatggcacgggcgggagccgcaggggggaacaatctaccccgggagggggtcatgcttctgggccccgtgacgggggcccggggggcagccgccctgccgacgcccgggggaagaggaaacaggaggataccccctctccatctcctccccgagggggcggggcggtgcgtgccagcagcaggcgcccggagggtgctgtgccgacgtcgcagcccgagagggagcgaaaaaagaagcggctccgcaagatgggggggaccgaaccatgccggggaaacctcatctcccccccaaggtggtcgtttagccgacctcctcgcaggttcgtccccgcgcccactgcggccgtattcattctcccaaggcgagttttcacttacccgtttccttttgtcttctggtttttcttccgctttcagcgagattccgtcgcgcccccctcgccattccaagtccggccggtctgaggccaaggagacagcgaccgcggaggcccggaggcgggaagctatccggcgagaagccgcggaccgccttcgggaagctgaggaggctgcccacgaagccgtccgggtttgccaggctgaggaggccgctcgggaggaggccagactccaccgggccgggaagtcagcccgggaggcagaggcgacgtgcgcacgccaggcggcctgccaagcccccgacccgactccgcccgaggcgacgacgacttccgaggccacccacgacgaggccgcgggcgcaccgctcggacccgacccttcgggcgatgttcgggacgagccagcctcgggggacgcccctgagtccggcacgtcgattggcgggccgagccgcacagcgcccacaccgaggcggctctcccctctgccttccgccgccccattgaacacagagcccctcctgcaggccctggccgccgcgaacacgacggtgctggacgggttaggtgcccagatggaggtcctgcaagcagagcgggcggagctcgacgcggcgtgggcgcgcgtcgaagaggggcggcgctcggtggaggccatggtggaggcgggccgcaaggcataccgccggcacgcctcagagctcgaggcccgtcggagggagctggcggagatcgccagggaggtggaggaggagcgggagactgccc

SEQ ID NO: 44280 - DNA, 2703 bp, Oryza sativa
gtggggcggccgcgggcgacagcgatctagccgcccgcctcgtagctgccgaacacaccatcgccgatctgcagggcgcgctggactcgtccgccggggaggtcgaggccctccgcttggcgggcgaggtagggcccggcatgcttcgggacgccgtctcccgtctagaccgcgccgggcggcaagcgggcctctggggcgagcggaccgcgaagtacgccgccaaccaggggggcctcgcccagcgcctctcagagatggccgggactctccagcggctccccgaggagctcgaggagacgatcaagtcatcctcgagagacctcgcccggggagtagtggagcttgtactggcaagctaccaggccagggacccggacttctccccgtgggcagcgctggacgagttccctcccggaaccgaggacgacgcgcgcgcgcgcaggtccgggacgccgccgaccacatcgtccacagcttcgagggtacggcccctcagctcgcgttcgccctcgactccgacgaggagggcggcgacggtggtgtggacgacagcgaccacgaggccggtgacccgggagcctcgaagtgagcccccaggcccccgccaatcttaaatagtttttcctttcttcttccgaggccttcgggcctccttcttgtataaactaatttaatctgcaatcaaataaagaagaaatttctgtgtcaattttatttgttgtgtgtatgagacgaggatggtctgtgccgcggtccttctgtgtcttggcttgaacaagggctcgtgcccaggtcccagcctcaaacggcgcgggtcggggctagtgcctggggagatgcacatgtcgagactggctaggccgggagcgcggtgaccgaaggttatggggacccgattgtgggcctttgccgattcccccccggagttcaccacgccccggggcacggctcggttctgggccccctttggcgatttccgccggcccgggccaccgagggcagggtcgagcacgagcgtgctaattcaagccaaaactcttcaaaaggaaacaatggcacagacacaatccttagaaaatcgaaaaagcttttattgaaatacggaagagaaaaaagataagtatatgcatatgtggtagcccccggccaaccctgcacgcccgaggggggtgcggggttggcccgagcccgagacctgacacccgacccccactaggggtagaagcgacgaaagtgttcgatattctatgggttaggcagctctgtgccgtcgcccgtggccagccgaacggagcccggccgggggacgccgatcactcgatacggaccctcccacattggtgagagcttgctcagtccagcacgcgtttggacgcggcgtaagacgaggtcgtcgacgcagagtgatcgggcccggacgtgacgctgatggtagcgccgcaggctctgctggtagcgcgcggctcgaagggccgcgcgccgccttcgttcttccaagaagtcgaggtcatctctgcgatgctgatcttgatcagcctcgcagtacatggtggcccgaggggacctcagggtgagctcggatgggagaaccgcctccgcgccgtagacgaggaagaaaggcgtttccccggttgctcggcttggcgtggttcggttcgcccagagcaccgctggcagctcctcgatccacgagtcgccatgcttcttgaggatgttgaaggtcttggttttgaggcccttgaggatttctgcgttggcgcgctccacttggccattgcttctagggtgggcgggagaggcgaagcagagcttaatgcccatgtcttcgcagtagtcaccgaagagctcactagtgaactgggtgccgttatccgtaatgatacggttaggcaccccaaaccgagcagtgatacccctgatgaatttaagtgcggagtgcttatcgatcttgatgaccggataagcctcgggccacttagtgaacttgtcgaaagcgacatacagatactcgaacccgcccggggcccgtctaaacggacccaggatatcgagcccccagacagcaaacggccatgaaagaggtatggtctgcagggcctgggccggctgatgggtttgcttggcatggaactggcacgccctgcaccgccagaccaggtcgatcgcatcgttgagagccgtcggccaatagaaaccctggcgaaaggccttgccaaccaaggtgcgtgaggcagagtgggctccgcactcgccttcatggatatcggcaagaagctcgacgccttgttcccgaggaatgcacttcaggaggactccgttagccgcgtgccgatagagggtcccttccaccagcacgtagcgcttggagatgcgctggacgcgttcactcccttcgcggtcctcgggtagagtcttatctgcgaggtacgcctggatctcagcgatccaagcaatcaatctaagggagctgggagcgcccccctcgggtcccgaggcctggactccgacgggcctcgggggccgttcaggctcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcaaaatggcgctc

SEQ ID NO: 44281 - DNA, 887 bp, Oryza sativa
  unsure (1)..(887): unsure at all n locations
nnnnnnnnnnnnnnnnnnnnnnnnnnnnnnnnnnnnnnnnnnnnnnnnnnnnnnnnnnnnaattgcttgtttaccgtctaggaaccagagtaaaaataattcggagaggtgacatacatacctcgctatttacacataaagagaagatccctcctctaatacaactgtaggagaaaagaactccaacacagaatttcaaagctgcaaaaggcttcagcagctcaaagattctataaaggacttatatttttcagggagaaacctatgatattcttgatattttcccccagacaaaagatctaaaaacaaggaagcagtggatgcttcgagggagaagtgcttctcatcaatcatgaacaggtaagtgccagccctggttatatcacccctctgtaacagtttcctaacaatggaatttagcatgcgggagttggcagtacagccattctcctccattgaaagaaatagatcatccaattcttctagcaacccctgctctataagattttctgccattaaactgtaggtcctaacatctggcactaaaccgttagccgagagagctgcaaacaaatccttggcttcatcatttctgccaactttaagcaatgcaccaatcataatgttaaaagtcctagtctccagctgtaaatccgtcaaacataggttctgaaacattcgaagtgcctcgtcagtgagattgtttttgcaaagcccatgaaggattatgttgtatgtgctaagttcaagctgcgttccactttcggtaatcccgacatagagttcttttgcagcagcagttcttctggtttgaaataaaccttgcagaattatattatacgtaataatatcaggactaacaccactgctttccatttccctaaaaa

SEQ ID NO: 44282 - DNA, 2178 bp, Oryza sativa; identical to SEQ ID NO: 41358

SEQ ID NO: 44283 - DNA, 826 bp, Oryza sativa
gcacttgtgcgtgggaatcatctcgcgcggccggggagaagaccgcatctgaatcctcacagcgacgtcgtggtcagtcagccgagccgttgtctggcggtggtagtggactcgtgcaaggtccaactgatcgatcatcgcgtgacttgactagacttcacttttgagagggagacttgcctggcaatggtagctattgacttagacttcatatttcgtcaactgagatgcaaaagcgctctgtagaattgaattgcagatggagcagttaagcaggtccatctctgtctctgatttggagccctgctttgtataagtttaagggtttattccacgtaaattgttcaatagatctaatagctagttttaatgttagatttgttgattctttggtcttctcattctctttggtgatcggtggctatcgcatttgtaaggtctttgatgtcgggttgcccattattcaattggcagcatcggctttatcgttcagatcaccggtgtgtttgatgacgttgtttgaggatttataagatggtgatcgatttcgtttgtatacttctatatttttgtttgtacaggagttgatcaaaactgtggctacgctcatcagctcgtatctcttatgttattctagcaagcagactatctttatttcgttttggtagttgttcttatttgactattacgtgtaaaaacactaataatctctatacaaatgtaatgtacattgtttcaatgagaaaaaaaaaagatccaaagtagtaccaaagcgcaatgctaagctggttaggtagcaggttacaagttagctataaacacgtgg

SEQ ID NO: 44284 - DNA, 1248 bp, Oryza sativa
  unsure (1)..(1248): unsure at all n locations
ccgatccatcacctaatgaactacggaacatgtgggtatggtcggtgaatattttttttagacaggatgcctagtaaattaacggtcgatgaatataattgtaatgaaaaattaacgtcattctaacatgttagttttgaagttatggtgcatagttttttcgtgcagtagcgtgtgtgtacttgcattgcatggactaatatggatcatgtcgtagaaaatattgttatggcagtctattgatttctaggaggcatgtagcaacttagtcaatagcgaggactcaagagtcaagactatacaaggtaagagctgaaatagacatggtaaattgacaatgtgtggaagggtaacaactgatttattagtgatgtacgagcacaaaaatcaagaaaaaactatttttccaaaattgaaagagaagatgtggagaaaaaaacatttctaacaatcatcaaaggataaattttaactcagctaatgttcatcacatgatttgtgaagagcgtggctggctgcatccactaatgtgggccgtgatcggtcaatgtaacccgctggcccttgtggggatggtggaaaaagggcctgccagaccagggagaagcaagactctagcttcatgtattggaacgggagaacacacaacgcgtgcgcggggtgtacaaaaccgatattgtaacggagtagaaccgatattgtaacggagtagagaacgtatggaaatttttgaagaaacatcttcaatttttataatagtagatattaagacaagatatacaatgtactagatttatttcacccaagaacagtgcagatccaccgctcggctatcctgtatggtcactcgggcttgttggcgattacgacgttgtatatctatgttgttgaaggattgaagattaaagttttgcgaacaaatattaccatcatatttaaatatatgacattgttgagtttattcgacattcattgagaaattttggcaactatttttctatattataataataattctaacaaaattataatatttttcttttttacattttataattttttgtgtttttttatttcttctttaactagaaaaaatgcccgtgcattgcaacgggtgaagtctattttaatcttattattgttatatggttcagttaaaataaaattcactgtgggggatcggggatnnnnnnnnnnnnnnnnnnnnnnnnnnnnnnnnnnnnnnnnnnnnnnnnnnnnnnnnnnngg

SEQ ID NO: 44285 - DNA, 864 bp, Oryza sativa; identical to SEQ ID NO: 41359

SEQ ID NO: 44286 - DNA, 1796 bp, Oryza sativa; identical to SEQ ID NO: 41360

SEQ ID NO: 44287 - DNA, 868 bp, Oryza sativa; identical to SEQ ID NO: 41361

SEQ ID NO: 44288 - DNA, 743 bp, Oryza sativa
tttttaccaaagtgatcatatccttttttttagaacaagatttattgatttttagaacaatagtagtcatatcctagagatctagaacacctgaagactgctaatgcagagaaaacatggcaacaatccaatttcttcaatgagtaagagtgaaagcacagtacaataggttatttgggtgaaaaaggttagcattacagcaagaaacccatcgcatatacaacagtatgattgaaatctacagagagtagagataccttggacgagtagggataccttgaacggtccatttcgccctatcaacccacaaagagaatattcctgacacttggtccagagtgccttcaagatcggtggaagtctctaccatagtcctcagtcctcgcgaccataaacatcgatgatacctgacaccacagtcagacggactcctaaagaagtataatgtatgaagcatgctcagattgagaaaaaattaataaaaaaactaaatgatgatgcaaggtcactaccatccagactgtttttggaaagcaatatagttcctatgtgttgagtgtccatggagtcttcctctttgacagtatcggtaaagaacacaattattttctgtaacaacatatgcccacaactcaagttaaaatcatttttaaaactgcacgatcataatgggaatagtgcaaaagaggaaatacaccagctgatactagttagaagaatacatcactaaataattctaaagc

SEQ ID NO: 44289 - DNA, 727 bp, Oryza sativa; identical to SEQ ID NO: 41363

SEQ ID NO: 44290 - DNA, 942 bp, Oryza sativa; identical to SEQ ID NO: 41364

SEQ ID NO: 44291 - DNA, 1496 bp, Oryza sativa
  unsure (1)..(1496): unsure at all n locations
aagttgagaaagaattcaagcttcttgctcctgtgtcaaagaaaagaaaagtgggtagccaaagaaagaataggatcccatctgctcttgagagggcaaagggaaaggctcaaagccaaattaagtgtccagaatgtggtgtctttggcccaaggaaggaaagtgctagatgtgaactaactggcaccaaaaagaggtgtgctgtattttcatctcaattattattcattttcttgctgttatatgctaactgtttttcttttggcaggaagaggaacaagaaancaccancaaaggtgggaaggaagaaatcaaagggtgttagtgatgaacaagtaactacaccaagaacaagagcagttacagctagagaaggagctgcagaaacacaagtgcagccatcacaaacaagcagccctggaccagtcactaggaggtaagcaccattatgctcttttcatttttctctagctttcattacttattatacactgaactaaacttcttttattatttacaccatcacaaacaccaggaggttggcattggagcttgaccaaagctctcaagtagctccagctatagtggagccacccaagaagcttacacccagaaaaaagctcgcaagcaagaagaaaagtgcaacaccacctaaacttttggattgaaatttgtcaacctgctagtgaaattggttatttgtggtctactatggcatgatattttggaaaaactaattgcaagtaatgtgcgatgatatgtgcactttggtatggcatattttgctatgtggtgtgaatatcttaagtgtatggcctaacgaacttaagtgtatggcctggcctgatgttgctatttctattattgtgcttttgtaatgatgtatggccttgcgtaatggcatgtaacttgttatgtatggccttcacagtaactctgaacttgatagtggttatgaacttggtagtactatttctaacgatgaagaagttattatgggataaaaattgatttttgttgcgcatgtgtgttaatgatgcagtatgttatgtgttgagttgttctcaagttattatgttttatcatttattcatgtgtgcgtagttgatttaattgtattatgttggctattaaccacttgagaatggaggggtaaaattgtcatttcactaggccggtccatgctggcatgctgatgtggtgctccaacccaacgaaagtggcaaaaaattagggcgtaatctctctctagtggtaaatatgttaggccaaatctaatagtggcatatggagagttgacactcgtaagagtggcaaatagttaaatttcccgtccacaccaccctagtagatgaaggctgtgttagttgagcgcaaaatttagattttggttgaaattagaaatgatgtgactgaaagttattatgtgtatgacatattgatgtgatagaaaatgacggaagtttgaatccatctaaacacagccgaaaagagga

SEQ ID NO: 44292 - DNA, 1148 bp, Oryza sativa
tgatcagccgtcgttgacttttcattacaaatctctcacattaggtgcggaaaagtctgaaaagaatggtgaaggttatccttggtggaagaaatgaaaagaagttctttaccaagatgaatggaggtaaattattagcatgcaaattcatttttttaatgatactagctccttgcttaaataatacaaaaatacataatctccactgaattttaactaattttgtcaccaaaaataagtttactgttctttgtttctgcctgctgaagaaaacaattgtttggggagggggggggggaagcacaattgttgaccccttggttatacttctgtgaacaaagaactttgattgtgttaagcgcttggcgcttgcaatttcttgttgtctgtttggaacaattttgtttgaccatatatccatgctctatttacttatatttgaaatttagcacattattgactgttattaccagacatggctatacacttcaacttggacttttggacacatcatatgtgcaccaattatcgattagcatgcattattttcttattcctcttatggccttctagtacctttgtttgaaggaaacttgttctgtgggctcaactgctttaggattgttcaatttagtttgaacaataactgtctagaaccaaaacagcataagctctcctgtggattgggatatttgacacgaatatccagtgaaaatcacagtgctgattcataaattatcctgttcagagagtagttctaatttctaaacatactgggcacataatatatttctggcttagtgttatgatcataatgatctgtacttttgagtaaaggtcctgaattctctttaagatagggaaattaaagcaaactaggtgataccccgcgctttggtgcgggattcacgaatgagtatatgttaaatattgtcgaaatgatgaaagttgaaatgttaaaaaaataatatgaggaagatgatttgatacatacttgttgatctctataatataatattatagatgatatgtcatgcttgcatgggatttaaaataggctagaatagtaattgctagtgagtgaaaatgtggcatgcttgcatgggattttaaatgggttagaatagtaatggctagtggatgatgat

SEQ ID NO: 44293 - DNA, 741 bp, Oryza sativa
gggcatgtaacaaagtagtacactccgattgtaaacatgtacacaatctgcatttcttggttatgtgcgttgttttctacccaaataagtggccatgaaataacgaagcattccatgtagatgtgaaattgcatttatagcttctgcctttctatgaacagtaacacaaatgccttcttcaattcaaatctttgcatgcttgtgtacgtccaattaatactctctacgtataaactgcctttaagcacgttacagtgcttcatttagtctcccacagttgttgacaataacaaaccaagcgaaaggaataaaacaatgtcacgatactgttctctcatatgcgcgcgcatatgatatatagctcgggacaaaaccagatgaaccatttctgtcagcataagaacaaaacgcacagctaaacttttagaagaaacaaagaagcaatagcagtacttatgcaagtgtacaaacaattggtaccttggcgtttaattcaaatccaatgttcgacaaatcacacggccggttcccataccgattcacaaatgcaaagcttacaatacttgagcaaatctttaatttgctctctggtgtgttcagaaacgaggtactaccacttgtgatgaatatgaactcataaatggtactcgatctactataattcctggagcgaagtgcatatgcatgtatagctattactcctatatcatggatgatgaagatcatatatatgcaacctgt

SEQ ID NO: 44294 - DNA, 964 bp, Oryza sativa
ttaacagggccttagtttagcctacgtaccatgcgcacgctcgtgttgaagtcacatgattggtactgacaccgtgacacggtgacaccgagtaatcgtggcaaaatcatgaaactcggcgacgcgtaatgttgcttgcaatcattggtttcacggggacctccattgggagtttctggagatgcgtagatggataagcttaaggtctcggtcacaaactcacaatcacagcccacttcattcccatccttgtcggtccatttgatgatccaaataatctcggcctgatttaacgattagcatttacatctaacgggccaatctagtgaaattctgtaatgtgcaaggcccaatcacatatattttctcgtggcctagcacctccgtaaatagtggagtaatgtccttgttatgtcaaagccatagcggcatagcgcgcgccctgtacttttgaagcagggcgagaatacttaagctaggagtctcttttccttctgcccctctccccgaaacgacttgcatatgttaagcaagctagcgttccttctgagccaggatcataacttgttaggactggttcattctgtagagaccatcagcaattatgtacttcagcgcagtgcctaaggcctagtacaagctttcttttatgaatcttagtagcatcaagtattggtttgggcttgtttaaaattttcattatgtggttctggactcactgtgtgagtttgctattttgtgaactatgtaataattggttgtagctcgtttgagtaaaggccgggatatttgattctattatctaaaaaaaatcaaaaaaagaaattctaccgcagttagcctattgggtgtgtttggataatggaaaataggaggtgggattgagattgagaaatgaatatagggttaggattaaatggaagaggaataatgaatgggtaagatttaaagatatcttttgggt

SEQ ID NO: 44295 - DNA, 1176 bp, Oryza sativa; identical to SEQ ID NO: 41366

SEQ ID NO: 44296 - DNA, 867 bp, Oryza sativa
  unsure (1)..(867): unsure at all n locations
ttcatcatgactacagaaatgaacaatgttgctacatcttgtaataatttgtggttttcaattgaacaaaacatccatcaaatgatatctacagcaatatattttgcacttctgagcacacaataggtttgagtgtattcgagtcatggtcattgatttaagctttttatttcactacataaccattgatttgagtgtatctaaggagttctgtttccacaagtactttatgttaatggtgtctccttatgctttggccatccaaactcattactgttgtttaatatttttagtggttagtggtgtccaaatctttctttgtgtacatcatactatgtttttgtagtctattaaacttccatcctatcatctgacttgttatattccaggatgcttgtatacgaatatgtgaataacgggaacttagaacagtggcttcatggtgccatgcgccaacatggtgttcttacctgggaagcccgaatgaaagttgttcttggaattgctaaagcgtaagaaacaaaccatcgtccccgtcaaaaagaaaagaattgttcttcactttagctcttttatatgtatatgtttagttgcataacccattttccataactgaattggtatacaggcttgcttatttacatgaagcaatagagccaaaagttgtacaccgggatatcaaatcaagcaacatactaatcgatgaagaattcaatggcaaactttctgattttggcttggctaagatgctgggtgcagggaagagccatatcacaactcgagttatgggaacttttgggtatgttgatattnnnnnnnnnnnnnnnnnnnnnnnnnnnnnnnnnnnnnnnnnnnnnnnnnnnnnnn

SEQ ID NO: 44297 - DNA, 848 bp, Oryza sativa
atttatgttttatacagactcatggttacatttaaaataaaacggagggagtattggataatttacatggatcctatgaccccgggatgttgaacatgagatcgtcactggccattgctgatcgttgcatgtctccatggatggatcgtacgtgcagggcggtacataagaggccaagccggaaggacgcgaggttcgaggtgccggtgctgatggtgattggggagaaggactacgcgttcaagttcccggggttcgaggcccccgtgcgggcggagccaatggaaaggttcgcgccggagctgaagatcgagttcctcccggaggggagccacttcgcgcaggagcagctcccggagcaggtcaaccggctcctcctcggcttcttcaccgagcacccggttgccgccgattgagatcctctctctaccttcgaagtgatcacgcgtttatcactgacatgtgaatctagagtttactggactcactcacatgttagtaataaagtcacgtaacttacaagatagactatcttaacgtaataaaatagggacgtctagaagcaaagtgtaatattgggatcaagtattgtactcgcacacaatttataatccacgtgtaatagtgggagtgaatgtgaccgtgggaataatttgtaatttaataattttaaagtttaaaattagtactacctctattttatattgtaagtcattttaattttttgggttaaacttctttagatttaactaactttgcagaaaaatatagtaatattttcgaaaaaactatcaagttcaatgttaaatttaaggaaacttatttagtgttataggttgttaaattta

SEQ ID NO: 44298 - DNA, 799 bp, Oryza sativa
actatagggcgaattcgagctcggtacccatcaatggcttcttcaaggagggggatctggacaaaatgcttgaccagaggatttcgccaaatgttgtgacctacaactctattattgctgcgctatgcaaggctcaaactgtggacaaggccatggaggtacttaccaccatggttaagagtggtgtcatgcctgattgcatgacatataatagtattgtgcatgggttttgctcttcagggcagccgaaagaggctattgtatttctcaaaaagatgcgcagtgatggtgtcgaaccagatgttgttacttataactcgctcatggattatctttgcaagaacggaagatgcacggaagcaagaaagatttttgattctatgaccaagaggggcctaaagcctgatattactacctatggtaccctgcttcaggggtatgctaccaaaggagcccttgttgagatgcatggtctcttggatttgatggtacgaaacggtatccaccctaatcattatgttttcagcattctaatatgtgcatacgctaaacaagggaaagtagatcaggcaatgcttgtgttcagcaaaatgaggcagcaaggattgaatccggatacagtgacctatggaacagttataggcatactttgcaagtcaggcagagtagaagatgctatgcgttattttgagcagatgatcgatgaaagactaagccctgacaacattgttataactccctaattcatagtctctgtatctttgacaaatgggacaaggctaaagagttaattcttgaa

SEQ ID NO: 44299 - DNA, 13923 bp, Oryza sativa
  unsure (1)..(13923): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttttttgggggnggaaaaaagggggggnccggaaattttcccgggngggttggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcgagggaatggagaacctgccaccgaatagtagccctgctgtctatgttgcgaaccatcagagtttcttggatatctatacccttctaactctaggaaggtgtttcaagtttataagcaagacaagtatatttatgttcccaattattggatgggcaatgtatctcttaggagtaattcctttgcggcgtatggacagcaggagccagctggtatggctgtagtctcatccctgctttcttaagtagacatatatacatttacagtatttggtaaataaacaagattttatgaatcatatatgattttggggaaaacacaaaactctctttgttggctgccttgaacatagttctgttcacacagttatagcaccttctttaaaatgaagaactttgttgcatacacataaggccaaaccacataatgaattttgtttatttctatctttgaatgttagcatcgtttttgtttaatgcatgatcgccttcctatatatttgtagtatgtcaacattgtattccatgctgagcataacaaatggtttgttaaaattcaggactgtcttaaacggtgtgtggatttggtgaaaaaaggagcatctgtatttttctttccagaggggactagaagcaaagatggaaagctaggtgcatttaaggttcagtaaccaaacttaggttacattacatctaatgagatttttatattcagtatataatgttaaccttctcatggtgtactgacgtggttataaatgtccccagagaggtgcattcagtgtggctacaaagaccggtgctcctgtgatacctattactcttctcgggacagggaaactgatgccttctggaatggaaggcatccttaattcaggttcagtaaagctcattattcaccatccaattgaagggaatgatgctgagaaattatgttctgaagcaaggaaggtgatagctgacactcttattctaaacggttatggagtgcactaaagaaagatggtgtttttttttattatatggaacctattcaaaggcacagacaggctttcaaggctaagcttgttacaggtactgatactagttactaattactttcgtaatcagtataaataagcttgtgtagtgtaatggcattgtacatttctgcacttggtaaatttacagaagaggcaagtaatattttagaggattgagtttattcacccagtcatatagttgaagaggcaagtaacctgtaagagaggactgaacattaacacctcttgttcgattaaaaatgaccaaagagcatcaaacatgtattcgaggctgttactttagatatggcccattaatttgtttagttgtctatgtacatcctagttggtgtaaatgccagttaccatttctatgatctaaaacaatcaactcttttagtatattttcaaaaacgaaaattcagtacacatgtatgaatcttaatattcttctctagctcgttacaaaagcaacaaaggcaccgtgtcagctggttcacattagctagtttgtacttagcattatccactagcaccttattttcatgcatatcatgctaatttgcttgcccacgttgagtgggaatttttttcatgttttataatttatatatgttttagacttctagtccacaatttatgtacttcatgttcctgagcctctagtatggctgatagcagactaggtgctgagtgctgtccttttttgcagactgaagagagaagaaatacaagactgtccattgttagtcagatttgtaaaaatagactctgatgtagtttacttttgcccctattttatttttaacaatacaaatatataacagatcctaagaacttatcttaatttaggagaagttgctcgtttcattaaattaaattgtgaagtaaaaatgtgtgctcgagtctgtcaatgcaatcctgtgttcttgtttgaagatatggtgtagggcaggccaggattgaacactgaatggtaagactgcttctgccttcagacgttattgctaaatttttagctacttgcagttagtgctgccacgccgattaagcagtagaacaaagtagttttgtcgtgcacaaatgagttatatttcattggaaatcgaagcgaaaacgaatcaaaagttagaagaaaaggggaaacttggtaattactccataaagagagtgcattttattggtaagatggtatccggaagctgtgagctccgggctgtatgtattctggcaaatttgatatgagatgctcgattattggcttaagttagcgatatcaaatttggggaagcaccaaaggaattattgtgaaggagttatgggtgcgtgacgttatctgctaggttcaaatccttgtggctatgaatatttatctgctaggttcaaatcctagtgactatgaatattaatgggtaaggtaagggatttattgttaattttagtttctttaagattgtgccatcggacgccattcggtaactgtaataatgctttgtattggattcacttgtgttacatgcacgcactaaacatgtgctttaccttttcatctgtttttgcgttctgggctagaaactcaaacgttgaattttccatggtctgctcaacttgacaattactgcgtgtcaagcgatcttatacgcatactatgcgcacaagtgattgtatacggatatgatgacagtataacgtgtgatattgatttttttaataaaaaaatgatgttcctttccttgatgaaggaacaaagactttttttaaaagaagggtattactaaaaacaaaaatgacaaaaacaaaatatcagtgcacatggcaagtgtgctcggcaattttttctctgtactttaaacaaaaatacttctatatgttcttttttataagggtggcacaaatcttttaaatgagccaaatatctacattggatttattaaaaactgtataaattataatttatactctgaaaggttgtgtgcatctctcttggagaaaatgtataagttgcaaacaaacattaatccacgttatgtaactttttttcgccggaaaggccgaaggaggcctgacggagcgtggggctcctcaccgggagaccgcgcaggcccccctttgccggttcggccggggactcagggtgaaattctaagctctctgtatgtggaaggttcgcgaccgtcgaaagagcataagacacgggcgatgtatacaggttcgggccgctgagaagcgtaataccctactcctgtgttttggggggatctgtgtatgaaggagctacaaagtatgagccagcctctcccttgttctgggttccgaatctggaaaagtccagtccagtccccccctctaagtgggcaaggtcctccttttatatcttaaggggataccacatgcaccatctccctcctttctgtggggacttaccctaccttttcataaatggacggagatttgtatagttgccgtccgaatgaccttctgataggacggcccatacctacctccacttccgccgaaagcaggtgcgacgtgggattatggctgtctgctgacgacatgaccagtgtcagactggtcacaaattgctcattcctgtccaccacgcgtcagtttagcaatctacatgttggcccttcttcacacaacatcttgcctgtaatggttaggatgaagcctggcatatatctaaccaggactaacgtgccatctctaggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcacttcgttacatgccgcgtgacacgctcagccaaaccgcaataaatgtggttaggtgagccccggtgtgctcacctaacccatacacgcggagcaaaaacccacgaggggtcggggcgcctcggccctcggggccgaggcgggtgcggtccgaccccctcggggggactaagaggagggcgaacacatcaccctcgggcccgacgtcccccgagggtgccaggccacgtgggcgattgtgtctgcctcaaacctctagtcatgatactcctgatcccatgtcaccgacagtagcccccggcgttatgccagggcgatcgccctctttaagggaagcggtcgggcgtgacgccactcctaaggcctggtgacaggtgggaccggtctccacaattgggcagaaacccaacggtcacaaatcacgcacatcggcaatggtaactctactatcaataatgagcggtctcttcaagactgccacattactcgagtagcacacgaatctggacatggcgattcgtttcgtctggagatatggtaacgtcgctttggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaaaggatctgtttccttcctttcgccatcatttcccttgtcttcgccgcttgcgccctaactccttctttcctgtgctctactttcgccacacgcgctcgctctcaatcttctcttcctccggcgccatggcacggggctccgctctgctcgatggtagcgtgctgccgccttcccgcatcgtgagcgagaggcaggctgggctgccgcgccgcttcatgccggaatctgccaccggccgggagatagtcacgctgggtgagggacgcccggcgccagactacccggggcggtccgtcttctttctcccctttgcaatggcagggctggttccgccattttcttctttcttcatggatgttctgaagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagttggtggctgctacttccagccatgggggccggtgctgaatcgctacatcccctgcgccctccgcaagaagtgggacgactggaagagcgactggttctacacccccctcgccgacgaagcgcgcctctgacttccgagccagcccccggcgcaggcctccagctggcgggcgccggtagatctgggggatggctatgacgccgtcctcgaccgcctggcgggcctacgatcccaggggctcacaggggccatggtgtacggcgactacctccgtcgtcggattgcgccgctccagcggcgcgctcggggcgcctgggagtacaccgggtccgaagactacatgaggacccaccagggagtcagatgggactgggctcctgaggatttcaagatagtggtccaacgggtgctgaatctcaactccatggaggcgtccctcattccccaaggaatcctccctctctgcagcgatccagaccgcgcctccatcctgaccattatgacggcggtcggggcctcagaggagtgagctccaaagggccacgacggcgcaggcgggagccgtaggggggatcaatctaccccgggagggggtcgtgcttctgggtctcgcgacggaggcccgaggagcagccgccctgccgacgcccgggggaagaggaagcagggaggaacacctcccccatctcctccccgagggggcggggcggtgcgtgccaacagcaggcgcccggagggggccgcgccgacatcgcagcccgagggggagcgcaagaagaagcggctccgcaagatgggggagacagaaccatctcggggaaaccttatttcccctccaaagtggtcgtttaaccgaccccctcgcaggttcgtctctcacccatcgtggctgtattcattctctcaacgcgagttttcactcacccatcttgttcgtcttctggtcttttcttctgtttcagcgagatcccgtcgcgtccctcccgccattccaagtccggccagtctgaggccgaggatccggcggccgcagaggcccggaggcgggaatctgaccggcgagaggccgcggatcgcctacgggaagccgaggaggccgcccaggaggccgcccgggctcgccagggcgaggaaaccgctcgggaggaggccgcccgggcccgccaggccgaggaagccgctcgggaggaggccgcccgagcccaccaggccgaggaagccgctcgggagaaagccggatttcgccaggacgaggcaatggcgacttccgaggcagctcgcgatgaggtcgcgggcgcgtcgcttgagcccgcttcctcgggcgacgctcaggcgacaacttccggggcagctggcgacgaggctgcgggcgcgtcgcttgggcccactccctcaggcgacgcccaggaccaaccaggtctgagggacatccccgagtccggcacttccatcggcggcccgagccgcgtggcatcctctccaaggcggctcttccccacgccttctatcgccccgctgagcgcagagccccttctgcaggccttggccgccgcaaacatcgcggtgttggacgggcttagtgcccaggtggaggccctgcaagcagagtgggcggagctcgacgccgcgtgggcgcgtgtcgaggaggggcggcgctcagtggaggccatggtggaggtgggccgcaaggcacaccgccggcatgtctcggagcttgaagcccgtaagaaggtgttggcggaaatcgccaaggaagtggaggaggagcggggggctgccctcattgccaccagcgtgatgaacgaggcgcaggacaccctccgccttcaatacgggagctgggaggcggagctagggaaaaagctcgacgccgcccagggggtgcttgacgttgccgctgcccgagaacagcgggcgggggagaccgaagcggcgtcccgacggcgcgaagagacccttgaggcgcgcgccatggcgctggaagagcgcgcctgcgtcgtggagagggatctggcggaccgcgaggccgccgtcactatccgggaggcaacactggcggcgcacgagtccgcctgtgccgaagaggagtccgcactccgcctccacgaggacgcgctcaccgagcgggagcgagctctcgaggaggccgaggccgcggcgcaacggctggcggacagcctgtccctccgcgaggcagcgcaggaggagcaggcgcgccgcactctggaatgtgtccgcgccgagaggaccgcactaaaccagcgggccgctgacctcgaggcgcgggagaaggagctggacgcgagggcgcgcagcggcggggcggctgcgggcgaaaacgacttagccgcccgcctcgctgctgccgaacataccatcgccgatctgcagggcacgctaaactcgtccgccggggaggtcgaggccctccgcttggcaggcgaggtagggcccggcatgctttgggacgccgtctcccgcctagatcgcgccggtcggcaggtgggcctctggagagggcggaccgtaaagtacgccgccaaccatggaggcctcgcccagcgcctctcgaagatggccggggctctccaacggctccccgaggagctcgagaagacaattaagtcatcctcgagggacctcgcccaaggagcggtggagctcgtactggcgagttaccaggccagggaccccaatttctccatggatggcgctggatgagttccctcctgggaccgaggacagcgcgcgcgcaggtccgggatgccgccgaccatatcgtccacagcttcgagggctcagcccctcggctcgcgttcgcccccaactccgacgaggaggacaatgccggtggtgcagacgacagtgacgatgaggccggcgacccgggcgtatcggattgatcccccaagcccccgccattcttcagttttttcttcttttccttcttctaaggccttcgggcctcttttttgtatagatcaacttaatctgtaatcaaaaatgaagaaatttttgtgtcaatttcatcttgctgtgtgtatgagatgaggatgatctgtgacgtggtccttttgcgtcttagcttgattaagggctcgtgcccaggtcccagtcctcaaaaggcgtgggtcggggctagtgcctggggagatccacatgtcgagactggccaggccgggaacgtggtgaccgagggttatgggtgacccgattgtgggtttttgccgattcccccccggagttcaccacgccccggggcacggctcggttctgggccccgtttggcgattttagccgacccgagcccccgagggcaggattgagcacgagtgacctatttcaagtcaagattcttcaaaaggaaaaaaaaacacagatacagcctttaggaaattgaaactgcttttattgaaatactgaaataagagaaataagaatgtgcatgtgtggcagcccccggccaaccctgcacgcccgagggggtgcggggttggcccgagcccgaaacctgacacccgacccccccctcaggggtagaagcgacgaaggtgttcgatgttccacgggttaggcagctcaatgccgtcgcccgtggccagccgtatggagcccggccgggggacgccgaccactcgatacggaccctcccacattggtgagagcttgctcaatccagcacgcgtttggacgcggcgtaggacgaggtcgtcgacgcagagtgatcgggcccggacgtgacgctgatggtagcgccgcaggctctgctggtagcgcgcggctctgagggccgcgcgtcgccttcgctcttccaagtagtcgaggtcatctctgcgaagctgatcttgatcagcctcgcagtacatggtggcccgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttctgaattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccacgaaagtggtatggtctgcagggcctgggccggctgatggatttgcttggcgtggaattgacacgctctacatcgccggaccaggtcgaccgcatcattgagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtaaagtcttatctgtgaggtatgcttggatctcggcaatccaagcaatcaatctaagggagctgggagcgctcccctcgggtcccgaggcctggacttcaacgggcctcgggggccggtcaggcgcgtccgtctcccctaaggggtcgggtcgcgccgacggctgggcaagcctttcttcaaaggcgcccggtggggtctgggctcgcgtggacgcgagccgtgagagttcgtcggcaatcatgttatcccgtctgggcacatgccgaagctcaatcccgtcaaaatggcgctccatacgccgtacttggcgcacgtaggcgtccatctgcgggtcagagcaccggtactccttacagacttggttaacgaccagctgggagtcgcctaacaccaggaggcggcggatccccagtccagctgccactctgagtccggcaaggagtccctcgtactctgccatattgttggtcgctcgaaagtcgaggcggaccaagtatctgaggacgtctccgctcggagaggtcaacgtgacccccgcaccggcgccctgaagagacagggagccgtcgaactgcattacccagtgggcggtgtgaggcagctgcgaggggtccgtgctggcctcggggattgagacgggctcgggagccggggtccactctgccacaaaatcggcgagagcctggctcttgatagcgtggcgtggttcaaagtgcaaatcgaactcagaaagttcgattgcccatttcaccacccgtcctgtaccgtctcgattatgcaagatttgaccgagggggtaagacgtaaccacagtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttgtcttctgtgctgatgacctcggggtcggaggataacaggggcggccttcccacagtggctttggggccgtcctgggggtcaggggctcctggcgtcgtcggacaagcgggcaaagggccaactccggtcgtcaggggccttaggcctccgttcggctcgggggcctcttctccctgctctttcccgggtcgagtcagcacagggttagcctcggggtcaaagggcgataggtgcggccttcccacagtggcctcagggccttcctgggggtcgggggctcctagcaccgtctgacaagcgggcagagggccaactccggtcgtcgggggcctcgggccaccgttcggctcgggggcctctcctccctgctctctcccgggccaagtcggcacagggtggggaagcgcgaaatgagaattgtcctcatcgcgctccacaaccaatgccgcactaactacttgcggggtcgccgctaagtagagtagcaagggctcgtctggctccggggcgaccagaactgggggagagcttagatacgccttcaactgggtgagggcattttcagcttccttcgtccaggtaaacggtccggagcgtttgagaagcttaaataagggtaacgccttctctcccagcctcgatatgaaccgacttagggcggccatgcaaccggtgacgtattgcacatccctaagtttgctgggggggcgcatccgctctatagcccgtatcttctcggggttggcctcaatgccccgggcagagaccaagaacccgagaagcttgcccgcaggtacaccgaacacacacttatcggggtttaattttatgcgggcggagcggagactctcaaaagtttccgctagatctatgagtaacgtttcctggttgcgcgtctttacaaccaagtcatcgacataagcttcaatattacgtcctaattggctacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgctagccactcggcggggttgacgctgccatcatatttttcggcgatggtgggccggaaccttgggggccaacggacattccgaagactcgccacaaaggctctacagccgacaccaccaaccgggggcacggagggctgattcccgcgtccgtgttgaggtgacactctggacgaggaagcgccctccgttgcgtgggcagcacttcggtcattacgccggcgctcgatgctggtgcgggcgtccggccccccacgcagatctttctgggtcgaaggagtcgacgaaggagtggcggccgaatggcgaacagcggctgccgctcgtcgtgccctccgtcttgacgacgcggagccggtggtagcagcaccagaggccttggtggcggaggaccgcccaccagcatctaggcgctgccgtaccgtcatgactaatttggccacgtcgtccagccatcgttgggctggagactccgggtcagggacgacaggcgggtgacgtaagagcgcgcccgcagcttggagcgcgccctggggcgtgctgccgtcgccgtagacgaggaggcgacgctccccatctcgccgttcttctccatcgcccgcgatcggtgaagtcgcggatctttcgaccctctcgagcgcctccccccgcttaggactttggcgtggagggagcggtggagtacgagctcgacggcgtgggttcggctccccgtcgtcgccactcacactcggagagaggtcgtgcgcctttgcttgctcggccatcaggctgaacaggaaaagcttggcgcacacggaagagtacgagagctcagaaaaacacacactgagtcccctacctggcgcgccagatgacggagcgtggggctcctcaccgggagaccgcgcaggcccccctttgccggttcggccggggactcagggtgaaattctaagctctctgtatgtggaaggttcgcgaccgtcgaaagagcataagacacgggcgatgtatacaggttcgggccgctgagaagcgtaataccctactcctgtgttttggggggatctgtgtatgaaggagctacaaagtatgagccagcctctcccttgttctgggttccgaatctggaaaagtccagtccagtccccccctctaagtgggcaaggtcctccttttatatcttaaggggataccacatgcaccatctccctctttttggggggacttaccctaccttttataaagggccgg

SEQ ID NO: 44300 - DNA, 25206 bp, Oryza sativa
  unsure (1)..(25206): unsure at all n locations
cctaacccatacacgcggagcaaaaacccacgaggggtcggggcgcctcggccctcggggccgaggcgggtgcggtccgaccccctcggggggactaagaggagggcgaacacatcaccctcgggcccgacgtcccccgagggtgccaggccacgtgggcgattgtgtctgcctcaaacctctagtcatgatactcctgatcccatgtcatcgacaaggccatccgaatgtattaaggagtaaaagttacaagaaaaaacaccacaatgcaccaaggtgcatgaccacacaccatacactacccccaagcacaaaccactgagggtgaagcctagcaccaaacgaccgccactaagtgtgaccaaacgccgctaggcctacggcagcaacacatagatgagacttcgaaaacgatgccaccaaggtggtcacgacatgtaggatgctgccatcgtccatctaaaaagatgtggttttcacccagagaaactcatcaagaaggggagagggtaacccttgacagcgccccaaggaggttacgacgcccgaaggcgtagccgctgccggtccggtgaaccaccggactaggcttccgcctaggaccctatagccttgatcgcagatcaccgtccaccactcagaaccaccacacagacaaaaggtagcacgtagcttccaccgcaccgcaccgacgccccttcgtcggccgactccatcgaaccaccatccctgagagctggcccaggacccctccgttccaccacccgccggccgccttgccagttttggccaaaggagaacccgggactgggtgacattgcttcggcagcctgagcttcccccgctggcgagctgctgtctcaatccaacctagaaactccccgcaaaagaaggggatgagctctaggaagggcgagggtgccgaccggcaacgaggaagacaacccatcgactccagctccctttgcactaccatctgggcctgcgccaatgccggatacgctgtcgctccggctccggcgccacccacctgcaccccctttgcctggtctccgcgcccctcctggctgcgtcgcgccgcccagctggccgctaagggcaccacgacggccgcccggctaccgaggcctggccgcgccatgggacagctcgcgctggcaccagcgagccacggccgtcgcgctgttgccggcgccagcgagcacaaccgccagctccaagggccgagcatgccactgagccgccgccgctgccgcccgggccggctgcacgtcaccggcgcacacgaccgcacgccgccacgctccgcctccgcgcccgaggcagccccatgccattgccgcgcacctcgcccgcccgctgccgagccgccaccgcgcaccttgctgagccgccaccgccgtccctagccgcctcgtgccgccgccacgccagatccaggcgcgggatggccggatccggccttgggggcgccggatccgccgcctccccacaccgccacggcgtcaccacctccgaccgcagtgagggcttcgtcgtttgccccatcctcatcgcgtcgaggaggaagacgccaagaaaaaagggcctcgccgctgccttccttgctcgctgccggcttcgccgccggcgagctccggcggcggcgaggtgggggagaagaagtggggagtgggcagctagggttttttcgccccccaagccgcccgtgcgagagcgacggtggggggggggggggggactttccaacctcttccagtgttctagttctccacgttatgtaactcaatttgtttaaccatagaaagtaagaaacctaccagcgtgttaagctctctttcattccctttcttcttcctggttttgcttccatcacatgtcaagtgaagggttcttaactaccattactcctacacatctaatttttttctcagatctttcgcaggtatatattgatgctacattttatgatcttaagataatctccttcacattaccctctgctgaaactttagcttgaaccgtcatcttcaccacaatttgagcccaatttgcacagagcacaacgagcaatagcttgcccttacgttcattatttagcatgaactactactaactacccaagaatcaatacaccggtttaataacgccattttatcacgttaatatatgtttcattcaacacaccggttttggcacagttgcaaacttgcaataaattctttcctacttctccatcccataatataacaaattggtatgtctcgtctggtactaagttgctatattatgagatggagggagcacttcttttcttccaaaatataagaatatagtattggattagatattatctagattcacgaattcgattaggttgtctagatttatagttgtatgtaatgtataattcggtaataggttattacctctcgggatggagggagtagttttgactttttttttcttataaatcgctttgatttttatattagtcaaattttatcgagtttaactaagtttatagaaaaaaattagcaacatttaagcaccacactagtttcattaaatttagcatggaatatattttgataatatatttgttctgtgttaaaaatgctgctatatttttctataaacgtagtcaaatttaaataagttagactaaaaaaaatcaaaacgacttataatatgaaatggaggaagtagtagactataacaaatttaaaccgtgctttgattttagagcatcactaatatgttagcaataatctatccctaaaatttattttttttcctaaactgaaaataggaagtggaaatactcctccatctaagagagagcctaaattcaataaaaaactaaaaaactaaaggtggatccctctattaaactaccgcaaaaaatttatgttttttttctcttccacgcgcgcagaacagatatctcgatcaagttagcatgtaaaatttttaaagagataccttatacgactccttccgtatttccaaaagcaaacggatttaaaatctgactcaaataaagatctatatatccaatttacatgacacatgtttcgccgaatttttatattaataataattaatatttttaaaattaaattattagcaatttgtttggaggatttatcaaaacaggatggacgttgtttataacagcgtctagacctagacgcgcttgcaaactgcggccacccttttatcacacaaatttttgacaatttgacactttccaaaaattaattttataaattaaccgtgaccaaaacttatttaaaaataatctttttgttgagcgcaaaatcgtatacttcagcgccaaatagcacggcgccgacctcccccttcccctcccctctatcctccactgctgccgcccacctctccgtatcagctgcgtcgcgttggtttccgccggcgctgctgctgctgcaccagtccgctagggcgggcgggcatggcgcgccgcgccgcttcccgcgtccgcgccggcgctgttggcgcccttcgctcggagggctcgacccaagggcgagggggccgcacggggggcagtggcgccgaggacgcacgccacgtgttcgacgaattgctccggcgtggcaggggcgcctcgatctacggcttgaactgcgccctcgccgacgtcgcgcgtcacagccccgcggccgccgtgtcccgctacaaccgcatggcccgagccggcgccgacgaggtaactcccaacttgtgcacctacggcattctcatcggttcctgctgctgcgcgggccgcttggacctcggtttcgcggccttgggcaatgtcattaagaagggatttagagtggacgccatcgccttcactcctctgctcaagggcctctgtgctgacaagaggacgagcgacgcaatggacatagtgctccgcagaatgacccagcttggctgcataccaaatgtcttctcctacaatattcttctcaaggggctgtgtgatgagaacagaagccaagaagctctcgagctgctccaaatgatgcctgatgatggaggtgactgcccacctgatgtggtgtcgtataccactgtcatcaatggcttcttcaaggagggggatctggacaaagcttacggtacataccatgaaatgctggaccgggggattttaccaaatgttgttacctacagctctattattgctgcgttatgcaaggctcaagctatggacaaagccatggaggtacttaccagcatggttaagaatggtgtcatgcctaattgcatgacatataatagtattgtgcatgggttttgctcttcagggcagccgaaagaggctattgtatttctcaaaaagatgcgcagtgatggtgtcgaaccagatgttgttacttataactcgctcatggattatctttgcaagaacggaagatgcacggaagctagaaagatgtttgattctatgaccaagaggggcctaaagcctgaaattactacctatggtaccctgcttcaggggtatgctaccaaaggagcccttgttgagatgcatggtctcttggatttgatggtacgaaacggtatccaccctaatcattatgttttcagcattctaatatgtgcatacgctaaacaagggaaagtagatcaggcaatgcttgtgttcagcaaaatgaggcagcaaggattgaatccggatacagtgacctatggaacagttataggcatactttgcaagtcaggcagagtagaagatgctatgcgttattttgagcagatgatcgatgaaagactaagccctggcaacattgtttataactccctaattcatagtctctgtatctttgacaaatgggacaaggctaaagagttaattcttgaaatgttggatcgaggcatctgtctggacactattttctttaattcaataattgacagtcattgcaaagaagggagggttatagaatctgaaaaactctttgacctgatggtacgtattggtgtgaagcccgatatcattacgtacagtactctcatcgatggatattgcttggcaggtaagatggatgaagcaacgaagttacttgccagcatggtctcagttggaatgaaacctgattgtgttacatataatactttgattaatggctactgtaaaattagcaggatggaagatgcgttagttctttttagggagatggagagcagtggtgttagtcctgatattattacgtataatataattctgcaaggtttatttcaaaccagaagaactgctgctgcaaaagaactctatgtcgggattaccgaaagtggaacgcagcttgaacttagcacatacaacataatccttcatgggctttgcaaaaacaatctcactgacgaggcacttcgaatgtttcagaacctatgtttgacggatttacagctggagactaggacttttaacattatgattggtgcattgcttaaagttggcagaaatgatgaagccaaggatttgtttgcagctctctcggctaacggtttagtgccagatgttaggacctacagtttaatggcagaaaatcttatagagcaggggttgctagaagaattggatgatctatttctttcaatggaggagaatggctgtactgccaactcccgcatgctaaattccattgttaggaaactgttacagaggggtgatataaccagggctggcacttacctgttcatgattgatgagaagcacttctccctcgaagcatccactgcttccttgtttttagatcttttgtctgggggaaaatatcaagaatatcataggtttctccctgaaaaatataagtcctttatagaatctttgagctgctgaagccttttgcagctttgaaattctgtgttggagttcttttctcctacagttgtattagaggagggatcttctctttatgtgtaaatagcgaggtatgtatgtcacctctccgaattatttttactctggttcctagacggtaaacaagcaattatgttctgcctttgatgccagaaaaaacacaaaagtttgtcgttatctctactaacggatcataaaggaatttgtaactggagtttcaaacttaatttgtctaggcagtagttttggcattagatccaacattgtgtaggattcatttgtgtgtatcaatctatagggtttcattaaatttcgttaatgtgtactgtttaggtgttgaatagtttgacttgttttttaactgaacaaaagatactgaaatcgttccattcaacaaacacatgttccgttaatgaaattattgtacgttaccttttgttttcttactcacaagtgtcctcttttcttatatcctatagattggtacaacaaattattgattcaattttggttttgaacattgatgatcctccctgcactattggtgcagctgctcttctattcattttgtgaagtgatgtgagtacctctcaatcccatccttatgcttctgtgcatgcttcattccaattttttacgcatatcgattgttttcttttatataacagtccataaagataatcacatcatgacaaagttatttatttctacagtatagttatataagtattcaccagttttccatgaatattttggcatgtgattacaaagaagattatttgagaaaatccatgcttttatttcatcattttgtttgaagttgaactttaatttatggtgtaaatttcagttattattgctagcagctcgtactctttaatggtataacttcacttgtgcttattctccaatatctcccttcttgttgttcaggttcaagaaaatcatttgttggattcagaatctggtgtccattttcttcttaaattattaaatcctccagtgaatcttgttgattccaaagcaccatcgataggttccaaacttcttggaatcagtaaagttcaaatgcttaatggatcaaataaggattctgactgcatttcagaggaaatcctttcaaaagttgaagagattctcttaagctgtcaagtgatcaagtcgctcgacaaagatgacaagaaaacaacaaggccagaactgtgtccaaagtggcttgctttgttgacaatggaaaatgcatgcttgtctgctgtttcagtagagggtaagttttaatcaaatttcttggtcatgatttccctttatgaccattatatttatttatatgagccaaataagcagttgtcaacttgtcataagttacatagcacctatttgcaatattcatgggtggtttgcttagcccttttcttcacctgcttttgattgatgacttccatctgtgttgcagaattgaattggagtagtggactgcactagaagcacctatggccattgtcatactaggaaggttttcccttatcaaatatttgattgttacagagacttctgacacagtgtccagagttggaggaaattttaaagagacattaagggagatgggaggtcttgatagtatttttgacgttatggtggattttcattcaacattggaggtgagatctcgctaacatcgcatattttacatttcctttgttcaactctaatggattgtgcaggcttgttccttttcgccattttagctttaatgtgcttgaagccacatgaaagtaatgcttgtccagatacatagccaaaggttgttatattttggggcatggaaaatgcttgaggtagtaactattttcatcaggacatggaaaattggctgcaacacaaattatgttgttttatgttgcaaaaatagttttttaatacttttttattctgcatgtggtgttagtatcttacagttcctctgatgattatatcccccacgataataacacttgaaacgataataacacttgacatatctacaccaagtgaacattattcatttggatgttacttttccagctatacttgctgttcttgcatgtgtaagcaagtttggagtaaattgcgcattaatttaaatgcttggtgttcctatctgtgtactttttattccccaactaataatgcaatcatattacgctgataaactgaataaataaattaacaatatacttctggtggcaaaccttgtgtatcagaatctcataaaggatacatccacttcagctttggaccgaaatgaaggaacatctttgcaaagtgctgctctcctcttgaaatgtttgaaaatattggaaaatgccatatttctaagcgatgataacaaggtaatgctccttatatgttctgtttcagtttagtacccatttccttcttctgtactatcttctctcctgatttgttctgtgcaaaatgtgcaaacagtgcgactttgtatgtctgcttaacaattttcttttcttcctgaaaaagcaatatgaactcttacattcattttgcttcttgcagacccatttgcttaatatgagtagaaaattgaacccgaaacgctccttgctttcttttgttggtgtcattatcaatactattgagttattatcaggtatttttcttaataatacaatgtgttcgctaacacaataaaatgttttaaacatccagtatgttaaagttgcagtctgacgcctattttgttttgctgcagctctttcaatacttcagaattcttctgttgtttccagctctacatatccgaaatcgtctaaagtctctcaacagagttactctggtaataacaaacaccaattttgtttgatcagttgatctcgttggcttttctatgcactgtctcaatatagtttggtcgccattcaagtctcactacagatgttgaacttggcctgacaccaaatatttataaaatgctacctgatatttttaatatttcatgtttcctgacccagattatcttgttggttcctcgtataagtttaattagtgacattcttgaagctttgttatgcagcagatgtcatggggggaacttcatttaatgatggaaagagcaagaactcgaaaaaaaaaaacttttgtcgaaccagacacgtcattgttgcttatcttcaaaatcagaagtttctcatattactatatcttctggtagtgatgctggtctgtcacagaaggcattcaattgttctccatttatatcaagcaatggggcatcaagtggttcattaggcgagaggcacagcaatggtagtggtttgaagttgaatataaaaaaggatcgtggcaatgcaaatccaattagaggctcaactggatggatttcaataagagcgcacagttctgatgggaactccagagaaatggcaaaaagactccgtctatcttaaaatgtaatcaccgacagtggtggtggtgatgacccttttgcatttgaccgccgcgtcggcgtcgccaccacgtaatcgcccacgtcgctgcccccgctgccacgtcgtcgaccgcgcacggtaatcacacgcatctcgaggccgccgctagctgatatcttctcatccggttgatttgtgattttggcgtttttgcagtggtgatggcggggggcgaccgtggccgaggcgtggagtgccatccgcatcagggtgtatcggccgcgctgctccgccctggtccgcaggctttggcggcgagctggcggcggagggagactgtggtgagatcggatttcgccgctggtggtgtcgctaccatgggggattcgccgcaggcgctctcaggtttgcagcctcctccactctcttcccttttttatttttttttctcgcaaaatgtgttgtgatgttcgtctcgctgggcaggcctcatagccattaatgtagtttgctggaacatttacatttggaacgttgttggcaattgcttgacaaaatgtggaattgtggaggggagaaaaatcatttgaacctgcagtgacaaaattgccatctctaattttaaaactgaaggtgtggaaatcaaacataatcattgccagcgcatcattcttgttaaccaccatgatatattgttggttataacagttagctccacaccaaccttgaaggtgtcaatagaatgtttagtataaattgaggagaacaggcagttgttaagactttctaaagaacttgtagcagctaatactagctattgtgcatttgtgtttcatggaatttgagcagcaatggatatttcttactaagatgtatgatgcaaaacaaaaaactatgtctatacagtttacatgtaatgtgcggatgcaaataaaatcatgtacatggacaaactcatgggattcataccgaattccagaattgcatttcttatgtggttacttttgttgttgatttggttaccagacatcgatgtgatttcaagggtcagaggggtttgcttctacgcggtggctgcagttgcagcaatctttttgtttgtcgccatggttgtggttcatccacttgtgctcctatttgaccgataccggaggagagttcaggaaaaaaatttgaaaatacccattttttgaaaaagatttacgtttatatacactagtatgaagaatttgcgaaaatataactaatccgcagatcggttatgcgggagcgcaacaaaagtatggcgtggcggcgcggagtggacggccgaggcgttcgcgcggaatggggctgcgggaccgagccagtctcgcttgccggtaacgcggaaccggtacgctcccgcagcgccagtgtgcggaaccgcggcgccaacatttttttactgcatggcactgtgtttaatactgtttgacactgtttctggtactgttttacacagttcccgggtcagttccgcacaatggaggcgcggcaccgaccatgaacaatgtgtgaacagtgctgcacagggttaaaacagtgtataaactgcgctgcacagtgctggagtcgctggccactgcggttccgcgttttggaaccgcgggaccgtcgcgattccgcgttttggagctgccggaccatgacggttccgcgcaggatcgtcggtcccgtattttgaatctgcggaaccgtcgctgtcccgcgtttccgtttcgcgggatgcgtatatttttataaaacctctccatgcatgtatataaacataaattattgaaaaaataagtatatttgcaaatttttttcgagagctcagcactacattgcaaagatttgggcaactctgacaatttccatgttctacaagcttgacgtcgagggaatggagaacctgccaccgaatagtagccctgctatctatgttgcgaaccatcagagttttttggatatctatacccttctaactctaggaaggtgtttcaagtttataagcaagacaagtatatttatgttccgaattatttgatgggcaatgtatctcttaggagtaattcctttgcggcgtatggacagcaggagccagctggtatggctgtagtctcatccctgctttcttaagtagacatatatgcaattacagaatttggtaaacaaacaagattttatgaatcatatatgattttggggaaaacaccaaactctctttggtggctgccttgaacatagttctattcacacagttatagcaccttctttaaaatgaagaactttgttgcatacacatatggccaaaccacataatgaattttgtttatttctatctttgaatgttagcaccttattttcatgcatatcatgctaatttgcttgcccacgttgagtgggaatttttttccatgttttataatttatatatgttctagacttctagtccacaatttatctacttcatgttcctgagcctctagtatggctggtagcagactaggtgctgagtgctgtccatttttgcagactgaagagaggagaaatacaggactgtccgttgttagtcagatttgtaaaaatagactctgatgtagtttattttagcccctattttatatttaacaatacaaatatataacgtatcctaagaacttatcgtaatttaggagaagttgctcgtttcattaaattaaactgtgaagtaaaaatgtgtgctcgagtctgtcaatgcaatcctgtgttcttgtttgaagatatggtgtagggcaggctaggatcgaacactgaatggtaagactgcttctgccttcatttgtgcacttggtgctgccacgccgattaagcagtagaacaaagtaattttgtcgtgcacaaatgagttatatttcattgaaaatcgaagtgaaaatgaaccaaaagatagaagaaaaggggaaacttggtaattatatactccacaaatttattggtaagatttgatattagacgctcgattacttggcttaagttaaggatatcaaatttggggaagcaccaaaggaattattgtgaaggagttgtgggtgcataacgttatctactaggttcaaatcctagtgactatgaatattaatgagtaaggtaagggatttattgttaattttagtttctttaagattgtgtccgggtacaccattcggtaagtgtaataatgttttgtattggattcacttgtgttacgtgcatgtgatttaccttttcatttgtttctgcgttctgggtatgaatttgacgagattccatggtcagctcaacatatcagttactgcgtgtcaagcgatcttatatggtatgcgcacaagcgattgtatacggatatgacagtataacgtgtgatattgatacgatgttcctttcctttataaaggaacaaagacttttttaaaaaaaagaaggggtattactaaaaaccaaaatgtcaaaaacaaaatatcagtgcacatggcaagtgtgcacgagcaatagcttgcccttacgttcattatttagcatgtactactactaactacgcaaaaatcaattcaccgattattaaactgttaacatcattttagcacgttaacatatgtttcattcaacacaccggttttggcacatttacaaacttgcaaagttgcaatactcccttcgttacatagcataagagattttaggtgaatgtgacacatctatccaaattcattatactagaatgtatcaccgcctccacgccgggagggagagcgccgccggtggagaaagggggagggagtggtcgaggggaaccagtagggtgccctccccgtcgccgcctccccgtggccgcgccggcgagacaggaggaagagggggatatggagcggcgccgccggtgagggcgcgcgcgcgggggggagcggcgacgccggtgaggaagggaaggggagtggtggctttgagagagataggggggaggaaaaatgattttagagttagggtttgggctgctgagtttttatatagatcgggatcaatcaggaccgtccatcagatcggacaactacggcttctcccgcgttgggccgggtgccactcctaggttgcccacactattgggccacatgtacgctccgcgtgaaataagttcactttaggtcctttaagttgcctctgaattgttcccaggccggccgcactattgggccaccccataggccatgtgtacgctccgcacagaataatttcgctttagctcccttaatttgtcccctcaaactcctaaaaccagtgcaaatctttaatttttagttcacccattgcaactcacgggcatatttgctagtgacatataatatgaaacgaaggatgtagcagactatagaatttaaactgtgctttcattttagagcatcactaactgttatttagatttttatttaaataaatgctgaaatgatgtttttattatgaaaattagcaataaagctcccaaaatttcaaaaaaaaattaaaagagatttattaatcatggttaatttaattaaaaattaaatctaaccatatcatattatttcacggtccgtgatgaggaaatggcagctgctatcacttacggtgggagagaaggggcattgtttatttttataactatctcttataactcccatgaaactataaaataaatataatcattatcataacattagttttttttccattgcaacgcaagggtaatttttcagtacaataaaaaaaataaaagtgggccattctgaacggaaatttctggttttttttcccaagagcgccgcacacaactgcgcaagagatcgatcgcgatcaccctgctcgtcgccgatctcctacaccatccctgccatctccttcccctccactggctgctgctgcacctgtcagctagggcgggcatggcgcgccgcgccgcttcccgcgctgctggcgcccttcgctcggagggctcgatccaagggcgagggggccgcgcggggggcagtggcggtggcgcggaggacgcacgccacgtgttcgacgaattgctccgtcgtggcataccagatgtcttctcctacaatattcttctcaacgggctgtgtgatgagaacagaagccaagaagctctcgagttactgcacataatggctgatgatggaggtgactgcccacctgatgtggtgtcgtacagcaccgtcatcaatggcttcttcaaggagggggatctggacaaaatgcttgaccagaggatttcgccaaatgttgtgacctacaactctattattgctgcgctatgcaaggctcaaactgtggacaaggccatggaggtacttaccaccatggttaagagtggtgtcatgcctgattgcatgacatataatagtattgtgcatgggttttgctcttcagggcagccgaaagaggctattgtatttctcaaaaagatgcgcagtgatggtgtcgaaccagatgttgttacttataactcgctcatggattatctttgcaagaacggaagatgcacggaagcaagaaagatttttgattctatgaccaagaggggcctaaagcctgatattactacctatggtaccctgcttcaggggtatgctaccaaaggagcccttgttgagatgcatggtctcttggatttgatggtacgaaacggtatccaccctaatcattatgttttcagcattctagtatgtgcatacgctaaacaagagaaagtagaagaggcaatgcttgtattcagcaaaatgaggcagcaaggattgaatccgaatgcagtgacctatggaacagttatagatgtactttgcaagtcaggtagagtagaagatgctatgctttattttgagcagatgatcgatgaaggactaagacctgacagcattgtttataactccctaattcatagtctctgtatctttgacaaatgggagaaggctgaagagttatttcttgaaatgttggatcgaggcatctgtcttagcactattttctttaattcaataattgacagtcattgcaaagaagggagggttatagaatctggaaaactctttgacttgatggtacgaattggtgtgaagcccgatatcattacccttggcaggtaagatggatgaagcaatgaagttactttctggcatggtctcagttgggttgaaacctaatactgttacttatagcactttgattaatggctactgcaaaattagtaggatggaagacgcgttagttctttttaaggagatggagagcagtggtgttagtcctgatattattacgtataacataattctgcaaggtttatttcaaaccagaagaactgctgctgcaaaagaactctatgtcaggattaccgaaagtggaatgcagattgaactttgttagatttaattggataattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattaatcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgagaatggatttgatctcccgcgagaagaagaagacacactttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacaaacttagcacatacaacataatccttcatggactttgcaaaaacaaactcactgatgatgcacttcgaatgtttcagaacctatgtttgatggatttgaagcttgaggctaggactttcaacattatgattgatgcattgcttaaagttggcagaaatgatgaagccaaggatttgtttgttgctttctcgtctaacggtttagtgccgaattattggacgtacagattgatggctgaaaatattataggacaggggttgctagaagaattggatcaactctttctttcaatggaggacaatggctgtactgttgactctggcatgctaaatttcattgttagggaactgttgcagagaggtgagataaccagggctggcacttacctttccatgattgatgagaagcacttttccctcgaagcatccactgcttccttgtttatagatcttttgtctgggggaaaatatcaagaatatcatatatttctccctgaaaaatacaagtcctttatagaatctttgagctgctgaagcattttgcagctttgaaattctgtgttggaattcttttctcctacagtccgattagaggagggatcttctctgtatgtgtaaatagcgaggtatgtatgtcacctctccgaattattttgactgtggttcctggactgtaaacaagctattatcttctggtgttgatgccagaaaaaacacaaaagtttgtcgttatctctactaacggatcataaaggggtttgtaactggagtttcaaacttaaggtatctaggcagtaggtatatattgatcctacatcttatgatcttaagatgatatccttctcattatcctctgctgaaactttagcttgaaccgtcatctacaccacaatttgagccccttagcacagagcacaacgagcaatagcttgcccttacgttcattatttagcatgcactactactaactacccaataatcaatacatcggttattaaactgtttgtacagtttaataatgtcattttatcacgttaacatatgtttcattcaacaccacaccggttttggcacagttgcaaacttgcaataacatttttactacttctccgccccataatataacaatctcgttccatactatattgctatattacgggacggatgaagtacttctttccttccaaaatataagaatctagtactagattagatattatttggattcacgaatttgattaggctatctagatttgtagtcgtatgtaatgtctaattcggtaataggttattacctctttggatggagggagtagtttttatttcgtactccctctgtttcatattataagttgttttgacttttttcttagtcaaattttattgagtttgactaaatttatagaaaaaaaattagcaacatttaagcaccacattagtttcattaaatgtagcatggaatatatttttataatatgtttgtttttttattaaaatgctactatatttttctataaatgtagccaaatttaaagaagtttgattacgaaaaaaaatcaaaatgacatataatatgaaactgaggatgtagcagactatagcaaatttaaactatgcttttattttagagcatcaccaaaagagatagcctaaatcttatcttaactaattaaaatattcataattttcctttcgtcacattaaattttcgtccgtaaatccgattgaaatccaactagacaatccaaaaaatagagaaaaagaacagaaaaaataataaaaagcacacaaatcttatctcaatcccgcgggaagctgccgatgccgccgaatccgctcgagcgccgccgccgccgctcacggggaacgatgtcgctgctatcgcacgtggtatgggagggcgccgccgccgctgcttgggagataggatatggagagagaaggaaatgtgagggagggttaggtttttccccattcgtatcttcagcgacacggaggcgatccaagctgtccatcagatcagacggctcagaacgcctccatcttcaggccgcgcatgcttgatgggccgagggaaggccggagggtcgaacaaacgtagtcagaggaggagttggaggaggtaaagtagaatttatttgcgggctgagatagtaaatggactgaaaatggcccatagagaaattgggaattttatttaaataaatgttgaaaaggtgtttatattatcaaaattagaaattaagctccgaaaattttaaaaaatattcaaagagcattattaatcatgattaatttaataaaaattaaatccaaccatatcatattatttcacggcgcgcagtaggaaaatgcgcagctgttgtcgcttacggtgggagagaagggacattgtttattttcagaactatcttttataactcccatggaactttaaaataaatataatcattattatagcattagtttttttctgtcttttttttccccaagagcgccgcgcagaagagatcgatcgcgatctccctgccccgacgtcgccggccgatctctcattctctccacgccctgctcgtcgccgatctcctacaccatccctgccatctcctccttcccctcccctctatcctccactggtgccgcccacctctccgtataagacaaactgcgttgcggcgttggtttccgccggcgctgctgctgcacctgtcagctagggcgggcatggcgcgccgcgccgcttcccgcgctgttggcgcccttcgctcggacggctcgatccaagggcgaggaggccgcgcggggggcagtggcgccgaggacgcacgccacgtgttcgacgaattgctccggcgtggcaggggcgcctcgatctacggcttgaaccgcgccctcgccgacgtcgcgcgtcacagccccgcggccgccgtgtcccgctacaaccgcatggcccgagctggcgccgacgaggtaactcccgacttgtgcacctacggcattctcatcggttgctgctgccgcgcgggccgcttggacctcggtttcgcggccttgggcaatgtcattaagaagggatttagagtggaagccatcaccttcactcctctgctcaagggcctctgtgccgacaagaggacgagcgacgcaatggacatagtgctccgcagaatgaccgagctcggttgcataccaaatgtcttctcctacaataatcttctcaacgggctgtgtgatgagaacagaagccaagaagctctcgagttgctgcacatgatggctgatgatcgaggaggaggtagcccacctgatgtggtgtcgtataccactgtcatcaatggcttcttcaaagagggggattcagacaaagcttacagtacataccatgaaatgctggaccgggggattttacctgatgttgtgacctacagctctattattgctgcgttatgcaagggtcaagctatggacaagccatggaggtacttaccacgatggttaagaatggtgtcatgcctgattgcatgacatataatagttatttcttgaaatgttggatcgaggcatttgtctggacactattttctttaattcaataattgacagtcattgcaaagaagggagggttatagaatctgaaaaactctttgacctgatggtacgtattggtgtgaagcctgatatcattacatacagtacactcatcgatggatattgcttggcaggtaagatggatgaagcaatgaagttactttctggcatggtctcagttgggttgaaacctaatactgttacttatagcactttgattaatggctactgcaaaattagtaggatggaagacgcgttagttctttttaaggagatggagagcagtggtgttagtcctgatattattacgtataacataattctgcaaggtttatttcaaaccagaagaactgctgctgcaaaagaactctatgtcaggattaccgaaagtggaacgcagattgaacttagcacatacaacataatccttcatggactttgcaaaaacaaactcactgatgatgcacttcagatgtttcagaacctatgtttgatggatttgaagcttgaggctaggactttcaacattatgattgatgcattgcttaaagttggcagaaatgatgaagccaaggatttgtttgttgctttctcgtctaacggtttagtgccgaattattggacgtacaggttgatggctgaaaatattataggacaggggttgctagaagaattggatcaactctttctttcaatggaggacaatggctgtactgttgactctggcatgctaaatttcattgttagggaactgttgcagagaggtgagataaccagggctggcacttacctttccatgattgatgagaagcacttttccctcgaagcatccactgcttccttgtttatagatcttttgtctgggggaaaatatcaagaatattataggtttctccctgaaaaatacaagtcctttatagaatctttgagctgctgaagcattttgcagctttgaaattctgtgttggaattcttttctcctacagtcctattagaggagggatcttctctgtatgtgtaaatagcgaggtatgtatgccacctctccgaattatttttactgtggttcctagactgtaaacaagcaattatgttatgctgttgatgccagaaaaaacataaaagtttgtcgttatctctactaacggatcataaagggatttgtgactggagtttcaaacttaatgtgtctaggcagtaattttgacattagatccaaaacaatttatagggtttcattaaatttcatctatgtgtactgtttaggtgttgaatagtttgacttgttttttaactgaacaaaagatatgtctgaagctttgttctttaccaaatgcagtactgatcatcacaatatattttttatggaacaagattggattgtatagaatggtttccgatctgattatcttatctcaacgtattattatgcacatgtactaatcatgaaatatctgatggaatgatgtttctatttacctgtgtgaggcagcaaggagtgagatggataacaccacatactccctctatcctagaatataagaagttttagagttggacacgattattaagaaagtaggtagaagtgagtagtggagggttgtgattgcatgagtagtggaggtaggtgggaaaagtgaatggtggagggttgtgattggttgggaagagaatgttggtagagaagttgttatattttggggagtacattattattctagaacaatactgttgtgctcaagaagcgttccaaagatgtttcacaacctgtgctcgatgggttttgagcttaatcctgggacattcagtatcatgatctgtctcattcttaaacatggaataaaggatgacagcatgatttctttgtctctataatcttttggctacccacagataatagctgtaaatctatactactttaaaaggagtagtggtggtggtnannnnnnaatntnnnnnnnnnnnnnnnnnantntnannntnntnacntnttnaatcantgtnaatnccttttccaatacatntttaatcactgtcaatcccttctccaaaccaattgtatgatagaacagtggaaatcacggacagaccatggagctctcaaccataatcatccttgcgagttaataacaaatggagcgtaaacttggcaagcaaaaaactcaaattaattctaaaattaagctctaggattcaaaatagatttcctctctgcattgtgctgttatgatttttaattccgtaacaacgcaaatgcattttgctagtcttataaagaagggttaatgcaaatattctgattaaatgattgtatctatgaagtttgaatgctagtggaagctcctttgaccatgttttgttgtgcgagcatttaagagagtgaagagaatgcttctttggtgctgttctggtatggaaggatccacagataaaattcaggttctactgcttctctgcttgtaattttcatgaagctgcagtgaataccttgttgaccacttgatctgttgctttgaaggagaatatagtagtggccaaggttggtgacggtgatggtggcatgtgatcccccagatcttcagtgacccagagaggaggggacggcgcgtggtgagctacaaggcatactcagtggagggcaagatcaaggcctcccgtccgtaggggactccgctgcatcaaggccaactgctccgaactgatcaatttctggtacggatcacttctcctttccttttttttttcaccttaagcactctcttgattcttcgctgctacctcccttaatttctttcaatatattgtggcacttgatcatggcggagacccaccttccagtgtgaatggattttgtcaaagaactaaatttattccattagcttattttctgattacatggaagacattcttttctggaataaatacagaactaaatcctgtttcctgaataaaagttgttagtgtgtggcatggtgcatttccgcgcttctaaattttataaaacctgttcattcaatttgaacctgcatccaatccaatattttaggtgcagacaggtgcttgcggtcaggttaaagaagttggcaaaaatgcttctgaagaaaggttaattgttgtttcatctcaggaggtaatatgcagatgattattccaattggcattgccttgccatttttatcacgagtctttacaattttatatcctcctacatattctttccagattccagatgatccagtgtctccaacaattgaggcgcttattttgctccatagtaaagcaagtacacttgctgagaaccaccagttgacaacacggcttgttgtaccatcaaacaaagttggttgtattcttggggaaggtggaaaggtaattactgaaatgagaagacggactggggctgaaatccgagtctactcaaaagcagataaacctaagtacctgtcttttgatgaggagcttgtgcaggtaatttatttggccatacctacaccagagatccatatattacttttataactgcagtttttacttgttaacatttcattgtgcttttacatttgttccaagctttcaggttgctgggcttccagctattgaaagaggagccctgacagagattgcttcgaggctttgaactaggacactcagagatggaagttcttccaataatccgacaccttttgcccctgttgatggtcctcctgttgatatcttgcctaacaaggaattcatgctatatggacgatctgctaatagtcccccatatggagggcctgctaatgatccaccatatggaagacctgccattgatccaccatatggaagaccaatatccacaatatggaagacctgccaatgatccaccatatagaagacctgtcaatgatacatcatattgagggttggacaatgatgggcctcgtgatcaggcccggtcctgaggggggtcgaatggggcgatcgctccgggcccccgattcccagggcccccacctatctgtgcaacgagtagtagcgatcttccagcgcgcaacgtgaggcgatgtttctccgtgatttcgccggcctgcaactgcgagatcgcgagtataacgatcagccgatcgatctcatctgccgactgccatgctgatgccacacgcaagcgcagcatatcagccttatcttggttgatcggcatgctggacgagcacatctgttgtcgcatcaactgctgactgctatatatgtgctggtgctgaatcgatcgattgtcgtcgcggaagtgaagaacaaccacggcactgctgcctgctgggctctagccgccatcagtaagtacgctatactgcctatctagatctagatcgagattacatagtggaattatctgtttataacaaaattacaaggtatcaattgataatttaaggttataaccgtacaaacttcagtgatttgctggtttcacattggttagatttgtttcaactaatttggtacttctgtagccttgtaatttacgaatctagtattaatattttcttaagtattagcctgttccttgatattatgctgttgagaaagtatgcaatagataacaaaaacaagtaggtgtgttgaggatgctcaagagtaatacagccacttcaataattctgatattatcaggacatcatcaataattctgcgcctacaaatcttcaaagaaaattttaatataatgcgtatgattttttaaatacgaatattgattgctatttaaagatatttatattatatggtaattattatttgaaggtttataataaaggcctccgtttttagtttcacgctgggccttcagaatctcaggaccggccctgctcatgatccttacaccgtgtatcctgtagagtacttctctaaaagagagtaccctagtggaagtagcaaagctgcaccatctgctt

SEQ ID NO: 44301 - DNA, 24487 bp, Oryza sativa
  unsure (1)..(24487): unsure at all n locations
cagtgatttgctggtttcacattggttagatttgtttcaactaatttggtacttctgtagccttgtaatttacgaatctagtattaatattttcttaagtattagcctgttccttgatattatgctgttgagaaagtatgcaatagataacaaaaacaagtaggtgtgttgaggatgctcaagagtaatacagccacttcaataattctgatattatcaggacatcatcaataattctgcgcctacaaatcttcaaagaaaattttaatataatgcgtatgattttttaaatacgaatattgattgctatttaaagatatttatattatatggtaattattatttgaaggtttataataaaggcctccgtttttagtttcacgctgggccttcagaatctcaggaccggccctgctcatgatccttacaccgtgtatcctgtagagtacttctctaaaagagagtaccctagtggaagtagcaaagttgcaccatctgcttcatacgaaagatatgcagcaactactcgcttgcctaatggagaactgccctcatctattagtcctggtgccgattatatgtcctgccgttcttatcttgaccaagtacctactgataggtactctaatagggttacactacaattaggcctctcgagagccgggaatagtaatgtgcaacaattaggaatcaccagagctggaaattccaatgcttatgattatactgaggtacatttccaatgcgttagcttgcctcttctttgcaaatggccctcgcctgatatgtttccattagaaacatgaaaccatatatttgactgttgcattatgtctattttcttccatgatggttcagacgtctgaaaaaaggacaaaaatattctagaatatgtcatggtgatccaaatatatccttctgtcttgtgcccactctaatatctatcattggtaacactattcaattgttacgatgttgttgcaaaccctagattcagttattcagctgttctctgctgctgttgcttaccagttttcttagttgggtgttgatcttttctcattttttatttccttgtttcctggttcacctgatgcctctctgatgcatctgaatgtatatttttgttctcttcagtgcttaatagatttgaatttcattcttttcaggctgctgagcagatccatggacgtgaggattaccgaagactgtcaggtctcactgggtatggcttacgcagactgaatttttacaggacacaaacatgaattttgtcctcataatcattgagtgatgatctctttgcaggtatccaggtggctcttcgaattgtggattccaaatagttaactggagtctgtcattggtgttggtggtgtcaatctagctgagatccgtctggtatagcgtaagagaaacattatgcactatccccagtcataaccatgccccaatggccaccaatagttttcctcgtgaaaatctccccttgatcccagatctctggtgcgagagtgaagttgcacgaagcccatcctggttcttccgagtccattgtggagatccagggcattccggatcaagtgaaagccgcacagagccttctgcaaggcttcatcggcgcaagcagcaacagcaggcaggcgccccagtcctctcgcatggcccattatttttagtaagctggaggacattcgcaacaggggggtcagtggtcactgcaaagctgagtttgttcttcagttcaactgcagaaaattgcagatcggttgccgtagttgctagaacggtacatagttgccacctaactgtagcgagtggcataacttattgtgtgttactgcccaatgttgtctctccttgtgttcatggattcagacttgtgattgtagtatttctggatcagactggagtaaaagaaaaaaaaaaggaagacatgggtttaacagtaagctcaaaacgttgacagtagtaaaataaaaggggtttgttcactttatttccaatatcaaccttaccaacatttggcgttgaatcatttataccacatcgcttgtgcagctgaatttggggctgtttaaaagatggtctcttggattgctaattgcctcgcggcaagcgtggtaccttgtacaatataaatataattataactatttaatttcataattaaacatgttgttacaaatctctactattataaaaattgaagatgttttttgccggtattttggtacgtcatccgtgtatgaatccgtttttaagttcgtttgcttttggaaatacatatctgtatttgattcagtttataagatcgttcacttttggtaatacagaaggaatcatataagaattctgtttaaaaacactcgtatagtaacttgagacgatcagacgcctaactacagctcatgattttctaaatatatatatatatatatatatactagaaaaaatatatgtgtgttaaaagctatcttaatcttattattgttatatattttagttaacaagaaatctattgtgggaacttgtttggatatatattttttttaaaaaaatcatgagctgcaattaggaatccaatcgtctcaagttagcaggagggcgagtttttttaaagatatttcttatacgatttcttctatatttctaaaagcaaacgaacttaaaaaccgactcaaacatggatctgtatttccaaaaacgaataaacttaaaaaccgactcatgcacagatgattaatttttataatagtagagataaacgaactcccacagtgaattttattttaactgaaccatataacaataataagattaaaatagacttcacccgttgcaatgcacgggcattttttctagttaaagaagaaataaaaaaacacaaaaaattataaaatgtaaaaaagaaaaatattataattttgttagaattattattataatatagaaaaatagttgccaaaatttctcaatgaatgtcgaataaactcaacaatgtcatatatttaaatatgatggtaatatttgttcgcaaaactttaatcttcaatccttcaacaacatagatatacaacgtcgtaatcgccaacaagcccgagtgaccatacaggatagccgagcggtggatctgcactgttcttgggtgaaataaatctagtacattgtatatcttgtcttaatatctactattataaaaattgaagatgtttcttcaaaaatttccatacgttctctactccgttacaatatcggttctactccgttacaatatcggttttgtacaccccgcgcacgcgttgtgtgttctcccgttccaatacatgaagctagagtcttgcttctccctggtctggcaggccctttttccaccatccccaccagggccagcgggttacattgaccgatcacggcccacattagtggatgcagccagccacgctcttcacaaatcatgtgatgaacattagctgagttaaaatttatcctttgatgattgttagaaatgtttttttctccacatcttctctttcaattttggaaaaatagttttttcttgatttttgtgctcgtacatcactaataaatcagttgttacccttccacacattgtcaatttaccatgtctatttcagctcttaccttgtatagtcttgactcttgagtcctcgctattgactaagttgctacatgcctcctagaaatcaatagactgccataacaatattttctacgacatgatccatattagtccatgcaatgcaagtacacacacgctactgcacgaaaaaactatgcaccataacttcaaaactaacatgttagaatgacgttaatttttcattacaattatattcatcgaccgttaatttactaggcatcctgtctaaaaaaaatattcaccgaccatacccacatgttccgtagttcattaggtgatggatcggtagttacagcagctggatttttatattttggtcattttgaaaaatttatttcgcaaatagacccctgaaaaaacttatcccagaaatagtcctttttggggcgtcagagtggctggcgccgtggtccaacgggacggcgccaacctctctggcgccgcccccgcctctattcttgtttctctatatagagttgcaaactttttatttttgttttatttttttggatgttttttcacacttagaatcacgatacaaccaactacaaaaaaaaaattaaactcgaacggaatatatcacatagctagaagtctgaaaatatagcataccacttacctactttgcaccttcaccaaaattagaccataacttctttagtaaaaccctttgatcagcatattaaacataatgcactctaccactaggtgaaattacttaatctaattcaaaatataactacatgaaatgatagccttgaaaaattctacatgccacatatttcgtccgtttgagtttattatttttatggttcgttcatgtgagttcccaagtgtgaaaaaaaaataaaataaaaataaaaaagttgcacatcctctcctctgcactagagaggagaggagaggaaaaattctacaggtcacatatttcgtccatttgagttcattttttctatggttggttcttgtgtgttcctaagcgtgaaaaaaatatcaaaaaaataataataaataaaaaaattcgggggggggcgccagccactcttaggggtgaaaacgatcagataatatccgatccaatctgctccgaatccatccgaaataaggatatggtatgggtttttagaaatccggcggatatggatgcggatgaggatatggtatctccgaaatacgacggattatccgacatttttgtccgataggccctttaccggataatccgaaattatgaacacaagttggtccatccaatgacctaattcatcaattaccctagatttcttactatgtggttttcaccatttcatgtcacacttgcgtagctgtatttttataaaatggacatcatgtatttatgttgtttagcacttaagcacataattattacaatgggtcgtttattgacattgtattatttttacttgcattgctaactcaatgttgtattgattgcatacacacgtaacatctgataaatttaatccgtttctgaaccgattccgcaccgactccgcaccatttccgacatctgcatccgtacactatccgcacccactccgaatccgcttaaaaatatggtttaagatatggtatgaccactatccgtccgaatccgctctattttcacccctagccactctggcgcgcttcccctgccacctcagcatcgccccaccacgtcggcagaaggacggcggcgccagccactctggcgccacaaaaaaggaccatttctagcataattttttttaggggtctatttgcgaaataagttttttaaaagaaccaaaatgtgaaaaatccaggttacagcagactgtgataagcaatagctatattgcctatatatacacgtatatgcattgctaatccttcaattttgtccaattcttttaaattgtattcacatgttgcaacgcatgtttttttttctagtcttaaccttaactaatcttaataactaactaaaagattcgtatctttccgatcgtcaccttgtccatacgctaatttttcgtccgtcccccctccccctcaaaaaaaaagggaaaatccattttacaccctcgaacttttatgcttgtctaaaatacacccccgaactataaaaccgggtataatacaccctcgagctatcaataccggacagttcaagggtgtattatacccggttttgtagtttgggggtgtattttagataagcataagagttcaagggcgtaaaatggacttttccccaaaaaaaaatcccagtcgttactttccatcctgagaatcggagacagggaaaactgaagcatacacgcaaatagaatcaaagatagggaaaactaagcatatacacacaaatatatccaaaaattcccatgcagctagatcgggtgccaccgttgttgccaaaccaccgcattgcaatgtaaatctaagactaaagcctaaatcctatgctaattcatcaaattagactcggttctaccaatttggtaatatatcaaattagacttgatttttactgatttgaggttctcgaggtgtcacactatgaaacggaagtttttcccgttgcaacgcacgggcactatgcaatatcttaactaattaaaagattcgtatttttcctttcgtcacaccgatctttcgtccgtctgtaacatcacgcgcacctcctctccaaatcccacatcatcataatccgacccaaaaacaaaatctcaatctcaatccaatcagaatcatcgcaaaatcatccaaaatatcaagagatgattataggagatggaggggtgaacaggagcaacatcatcatcgcataaaaaccccaaaatcaatcacaacaacgacatcattatcacataagaaaaacaatacaaacaacatacacaatcaacaacaccggcggatccagccgaggggacagcggcgtggcagcgggcagatcctctcggtcggatccacccacgggtgccactgacgtcgccgccgccaccggatccaagggagaagcttcggacagagggagagggggggagaggaccgctaaatccgcccaccggaaatgccgctgccaccacctccgccggatctgcccgagggagcgccgatgccgccgccgccatcgcgggagaagcttgggcacggagggtgaggaggagggggtagagaatcgccggatccatccgctggaaaagcctccgccggatccgcctgccggaaacaccggtgtcaccgcctccgccggattcggtagcgggagccgccgatgccaccaccgccgccggatccggtcggtgggagccactgacgccatcgccgccgcctcctctgctaccggcaagggagagacgagaggggcgggggcgagggcgggggacgagagggttagagggagggaccgagtgggagagagagggacgagtgagaggagggggacgagtgaataaggatgcgtgaccttatccactcgcgcggtcgcaccccggctctttctcttgctcagctgttgcgcttgtggagaggatgcgagatttttttttgagtaaaatgcacgggcagtccttaaacttgtagcggtctgtcatctaggttcccaaactctcaaaaggcatatccaggtcctagaatttgtcaaagtgtatcatctagatcccaaaccgacgcatcctctcttggatcctacatggcgctaatgtgacttgtcacatggacgtgacaagtctctttttttttcatcttttctttttcttttccgttttcttctcattcttctttttttccatcttctgctcgggtcgcaaagaaaggaaaagaaaggaaaatactagagaagaaaaaaagaaaaaagaaaatttttaaatgggtcccatttgtcagtcaaaattatgccacatcatatccctgtgacatgccacatcagcgccacgtagcatcctgaaggggttgtggcgatttgggacctaaatgacacactatgacaagttctaggacttggatatgtattttgagagtttaaggatttagatgacacactactttactttttattttttttacacggagaggatgcgaatttgttggttagttgcggctgagggtttctcgcacggagaaatttgcggtgggagaattttttttccgaggttctttctattgggagaagacgggattatagggattattactggtgtggtggcccctgttttctttctttttcgagcttctttccgttaaattcacttttctctcttcaaggagcgtaggacatgactgaatgcagctgctgtaaattagaaataaaaaagaaacatattctgtttttcatttttttcaataggtaaatataaagatttttaagtaatatttaaaaatatatagtgctgatcaacgacattgttaagtgagattttgctgttactatcacttttttttccattgggctcacgtacggcattaaaagttttagttttggttctctccttttgagtttgggcatataccaatattgagataggtatactaaagttcatttggattttattcgattcaacttttttgggttttgttcagttcttttttacatgtttctcatctgaaattaggaaattaggtttggtaaagtcttgaatagataacgctgttgacgtttgaacatatatttatctatttatttatttaaaaatatatgaataatttttattttgttatgactttggcttataattaaaaatactctaaggatattttttatattttattttcttatgtctatatgaaattttaaataagatagatggttaaacatatattggaaaaacatatatccaaaagtccactatcacaaaagcgtagcatagatacgattacaatacgtttccgcgaagactgtttatacctactctattccctgttccttgtgcggttgtgccatttggggcctgttttttcatctcggattaactcgcctggaaaccgcgagacgaatgttttgagcctaattaatccgtcattagcatatgtgggttattatagcacttatggctaatcatggcctaattagacttaaaagattcgtctcaagatttacatgcaaactatgcaattagtttttctttttatctatatttaatgcttcatatatgtgtcgaaagattcgatgcgatgtttgggaaaagctttttttaactaaacatgccccaaggtgtttctccaattaagttgacccaaaatcattcggcgtcacctttgtctttcactttccttccactacaaggtgatgacactgacaaaaggtccaaaagctacaggatctgatttttgttcatccatctgtgatgtgtcggcaagccatccatggagatccactcaactcctctctctgagagagagagagagagacagacagacagacacatgcatgatagattgtgctagtacggtagtaacattttattgcctctttttctaaaattctaggttgtttggaaaacaaaaattctagattgttcaataaattaataatattaggtatttattttaagtcactttaggtgttaattttcgaattttaaactgcttaaactctctttcgacgcatctgagagcaggtacaatagcagactataagccagctataaatatattttaagtagataaaagaggaaaaataagagtagcgggctatagatttgtagacagctgcagcgcgagctccaagatacatatgtgtatgacatgtgagaccaaacattaattatatagtatatgtttatatctatctattgtatgaattggctattaaattgactatgggtgtgttcggaggtgggtgttgggaaccatctcccaagcacggaaaacggagcggtccattatggcgtgattaattaagtattagctattttttaaaaaaataaatcaatatgatttttttaaacaacttttgtatagaaactttttgcaaaaactcaccgtttagtaatttgaaaagcgtgcgcgcggaatatgagggagaggggttgggaacctcctcatccgaacgcagcctatacatgatttggagccaatagttggctataatattaaacttgctctgagtggctctggaatcatcgaagtgatagaaatcatatgcagaaatgtttatatttgtgatgtaaaatttgaatctaaaattatttatattttaaaatggaggaagtactacctaaaacaagtatgagaaagagacatgaaaaacacaaaatctagatttaaaaataattggaattactagcaggaggtcgaagtcaatcaagacggcgaagaaaagcacaggggacagcagacacgttaacacgtaagtaaacaaacaagtggttaattaattagggggccctcaagtctcccctaaagccactaaacatgacaggtttgtgtaccatggaaaaaagggtgaagcaaaactttattctctctctcattagattaccagttggaaagcaatcctgggacctctagctaatctcattattctagaacaacgttttcttagagagagagagagagagaaataagtcaataaaaattactactaatccacttgaaccagttctgtcggtgtcggatgatttaccacatttgacgaaacggactatttattcgacgtttcgaaaaacacacttttttagaaaaaaaaactttcctctattagccactcgttttagttatatacctatccgagtatctgttaagtttatttatcaaaatatttaatttatctctataattaaatatacaatccgtaaaaacaatcacgcagtaattcgtttcaaactgagcctcagctagaaaatcaaaatggaaatgaataacaatagcaacagtagagtttgtttttcggcttatcatccgcaacccaaatgcgaattttaaacttagccttagagttaatttttaaggcttgtttaccatacttcattttcccagcattagtttcttttgtcactaaaaattgtttttttaagttgtttcgttcattttctcacggtttatcagcagtagagcgaagccattcttggagcctgtttggcacagctctagctccagttctagctccactctttctggagctggagctcagcccaacagtttcaggtccaccaaaattgggagtgtagttgggtggaactctctcacaaaaagttgtagagctggatttagacagctccacaactccactccaaacctaactcctgaagttaaattgataagttgaagctctatctatcaagccctttttcttgatcatgcttctacctactccatttttgtttcttggccctcacaggaattggaaaggaaaggcgtttatgcatcaatgcatgcatgcgcacatcaacctcgtccatcaaccatcataatcatcatcatctcgccagctgacgaaaatgacctgcatccatccatcacggacaatccaagcgaacaccgctaccaacatcacagccaacctgtttatcactagctcttgataccactcctacataaacactacgcgcaggttaattaattaagcgtgattactgaagtaacatctaatcacgtcctggttagcctttaataagacaacagttagagcaggtacaatagcagcaggatataagccagctataaaaaaagagagaaaagagcaacgggctacagatctatagccagctgtagcatggacttcaagacgcaacgtgtgtataacaggtgggaccagataataatagagtagtatagtaagtaactattatatacattggctatagatgatttggagctattagtgtgctatagtattaaacttgctcatagagcaggtacaatagtaggatattagccagttataaacatattataatgagataaacattgatagagaagagcagcgggctacagatctgtagccagctacaacacggactccaagacacaacgtgtgtatgacagatgggaccagatattagtagtatagtaagcaactattgtataaattgactattatattggctatagatgatttagagttagtagtgggctatactattaaactttttctcttagcaaaaatcaagcgcctaatcacattagaggagtagctttgagacaaaccaattagcggcgaatcaagcgatctgcgtggtcgtacagtgatgggccgggccgggcccacagcccgacagtgacagggggcctgacgcatgtcagcctcagccctggacgggagctagccgttgtgtccccgggggaggggaggggagcattcccatcatttcgcccctcctccgggcccacatctcagtgggggtaaaggtgtaaattactgcgaccgcgagtccagcgagcctagatttggaccttgtgtccgtttgactgtgaaccggagctactccccaacacggggggattgcgtagtgtgcatgccatgtgggcccgagcgccctttgttcgtggctttgggttggaaaggtgaccgtgtgagctgtgcggtgttgtactacgtattagtataaatcatttttgggtactactccctccgtccaaagctcatttataatttgttgtactccaaccgtccgtcttatttaaaaaaattataaaaaaaaattaaaaaaataagtcacacataaagtattaatcatgttttatcatctaacaacaataaaaatactaattataaaaaaatttcatataaaacggacagtcaaacattgtcacgaaaatctaatgtttatctttttttagaccgagggagtatctacgaacaaagataatacatgttataatcatgaagcccatgatgtgattagcccggccgtttgactaacctcacgagctacgtggctgacaagtttaacttgttaactccatcatttcggatacttagagcatgtacaatagcggactattagccagctataaacatattttaatgggataaaagataagagagaagagcagcgggctacagatttatagccagctgcagcacggactccaagacgcaatgtgtgtatgacaggtgagaccatatgttaatagtatagtaagcaactattgtatgaattggctattagatcggctatagataaattggagctagtagtggactatactattcaacttgctcttatatgatataaatattgatataactatatgattttgttaatgacatgtttgtttatggatggactatgtggggtcagtcgcctccgtagctgaccaaaatacaaacttaaaacccctatctataaaaatctaacttttgtttataaatatagatataaaagttcataattagagcctcatcttttaaacgaaaagagtactatgaaaacaactcgtaatacaaagactaattacgacgaaaagaaaatagtactaacaagaggaaagcagtgaacttgcatactccctccgtaaaaaaaaccaacctagacacggatataacactatatctagattcgttcgttgtactgaagtgtcacctccgtatctaggttggtttttttcgtacgaaagaagtatgagtaaatctaaagctatgtacacccttcgtcaaaaaaaaaaaaagtaaaccttgtactggtgcgtgtcacatcctaatataatatttgttttttttatggagggtgtacagttgaaaaaaattgatgtgttttaaggatgaaaaatattggtaatgttggctatgtaactctagaaaaaaaatgcagtaataataaaatgctaatttgctggagtactagattatagacaatccagtccaggacacgacaccctccctactctctccacttccactctcaccggccaccgcgcgctctctctctctctctcccccttctcccgcaagattcttcccccaaatcccacccgatccaccgccgccgcccgctcgccggagtcccatcgctgccaccgccgccggagccgcggcccgacgcccgccgggcctgcttgctgtgtgtgtgaggaggtggagttgctcgcgctcgttcccgcggccacctccgcctgctgctgcttctgcttccgctggcattgcggggaggtcgtgtgccgggggacgtgggggctcgtgttggagcgcggctgccggtgaggtggggggtgcggcgcggcgcggctcgcgcttgtgcgccggtggcgcgggcgcggggggaagcgtacgggggagggggagtgtggcggcggcggcgcgcggggtagggacgggcgccgccaccaccaccggctcgttcgctggcaggcgctacgcgtccagatccgtacgccggtatgcttcgtctcgccgcaactctctccatttgattagtatcccctcgccgaaacgaggcctgtgaggcgcccgcttgctggctggcttccctgtactcgctgcttgctcctgcctgttgggttaacccgtttccatcgaatttgggtaagcgaaacatcgcctcatatgggcatttggggttctggcagccttaggctcgccatccgtcgccgagcttccaagtgaccggcgcttgttggtatatttgcttgcttgttcctgtttggtggctgcgctaaatcttttgtgctgcattgaatttatgccacccatatacagcaaattgctgagctgaaataattcggctaattaggtccagcaatatgacatctcgtggattgaatgctaagctgacattgtatcactgatgctggcttatatataggttgttgagaagtgaagatgtcgacaggtgaaaccctgcgtgcagagctatcatccaggacgccgcctttcggtttgaggctatggattgtgattggaatcagtatttgggtggtgatcttctttatactaggtttcatgtgcctctggtccatataccgaaggaagccgaagaagtcctttgataagattccagtatctcaaatcccggatgtttccaaggagattgcagtagatgaagttcgtgagcatgctgttgtcgaaaacttccgtgtgcaagaaagccacgcgatatcggtgcaggagaaacattacgagaaagattcagggaaaatgctggcacacttggttaggagtaaatcgagtgatgccgataatttgagccaatgcagctcggtgtaccaatgtgatagggctggtagctcgtattctggtgatgaaggcagctcgggcaatgctaggaggcacttttctcaatatgcaactgtctcagcatcccctctggttggtctcccagaattctctcatctgggctggggtcattggtttactctgagagatttggagcatgcaacaaatcggttttccaaggagaatgtcattggagagggtggatatggggtagtttaccgtggtcgactcataaatggaactgacgtcgcaataaagaagcttcttaataatatgtaagagatcctgaaatctattctgcgttttacagaacttgtgactccttctgatgccatcatattaattttcttttgatatggtgctgcaggggccaggcagaaaaggagttcagggttgaagttgaggctattggccacgtcaggcataagaatcttgtccgccttctaggatattgtgttgagggaatcnnnnnnnnnnnnnnnnnnnnnatcacctttgctgatggatggctagcttttgtttctactggcacattatttacttgcatagggatgtaggattgctcttggtctatgtccacctactcaccagattatctcaagggataggttattcctgactgcactccttatgctatcgattttttcccttccaaatctgatggtgggattcagcatgcccagtgacagattatgctcagtccacagaaaccttctttggaccaccattcttttaccatgaaaatgtggccatagctctgaaagctaggattcactagaagcgcacaactgcttattggtttgttagttggctataacaaggtcttactgaaatgtacttccatagttcattactttgtgaatgcctgttcttgttcttcacgtttcttctcatgcatgttcaattctaaatttgtattcatgatatgtccaagctactgtattctccaaagaaaatcagaagtccattcacctatgtattttccagttttccgccattttggatactgctctagaaacaagttaataatatagatatttatatggtttggccagtgctgcttaagtgaccatcgagatagaaattgcttaagaaatatactaagatgttgagtgtcaggtgttttcggataatctagttaccaacaaataggtcctatgaatataatggtgtctgcttcacgtaattcaaaatccacactcagccaaaataatctgcaatagggtgttgaaaatatgattatgtttctcccttgttttcatcatgactacagaaatgaacaatgttgctacatcttgtaataatttgtggttttcaattgaacaaaacatccatcaaatgatatctacagcaatatattttgcacttctgagcacacaataggtttgagtgtattcgagtcatggtcattgatttaagctttttatttcactacataaccattgatttgagtgtatctaaggagttctgtttccacaagtactttatgttaatggtgtctccttatgctttggccatccaaactcattactgttgtttaatatttttagtggttagtggtgtccaaatctttctttgtgtacatcatactatgtttttgtagtctattaaacttccatcctatcatctgacttgttatattccaggatgcttgtatacgaatatgtgaataacgggaacttagaacagtggcttcatggtgccatgcgccaacatggtgttcttacctgggaagcccgaatgaaagttgttcttggaattgctaaagcgtaagaaacaaaccatcgtccccgtcaaaaagaaaagaattgttcttcactttagctcttttatatgtatatgtttagttgcataacccattttccataactgaattggtatacaggcttgcttatttacatgaagcaatagagccaaaagttgtacaccgggatatcaaatcaagcaacatactaatcgatgaagaattcaatggcaaactttctgattttggcttggctaagatgctgggtgcagggaagagccatatcacaactcgagttatgggaacttttgggtatgttgatatttttttggagttagtattaatctttcctatgcttagcttttactgttggaatgtgcagtacttcgcttattcatacaatataaaattttacatgctgcgaactttgtccttcgtatattataacaggtagctttctcattgctatcattgattcatttcaggtatgtggcccctgagtatgccaacacaggtctgttaaacgagaagagtgatgtctacagttttggtgtgctattactggaagcagtgactggtagagatccagttgattatggccggcctgctaatgaggtgagcatatatcctacaatctcatgcgtattatgtatgttacaaaagtccgtactattggaaattattttacggcaaaataacgtctatactaggagagacgaatttgcttcaggtgtatggctgtctggcagttgtctactgtctagttacccttgtctcacttttacagtctattgttttatttttcaggagctgactagctgtataccttgtcatatataacaacattgtaacgtggatgccttgcaggtgcatctagtggagtggctcaaaatgatggttggcacaagaagatctgaagaggtagttgaccctgacatggaggtcaaaccgaccattcgggctcttaagcgtgctctcctagtggcactgaggtgcgtcgacccagactctgagaaaagacctactatgggtcatgttgttcggatgctcgaggcagaagatgtcccatcccgtgaggtggtaacgctttctcctttcctgcaataacattcatcatattatatcattgcaataaatctgaagcttttgctgtaatcctactgaaggaccggaggagccggaggggcaacactgccaatgcagataccgagtccaagacaagctcaagcgaattcgagataagtggcgatagaagggactcagggccatcagcaaggtttcaaccctaagaagacggtgatcatagtcaagaacaatggcttcaaaactctatgcagtaacatggtggttggcagagaaaaaggggtatttctggagggcattgcattttgtattgtaggtctgcatggcggtagagactggagagagcacagtgtctgatgatggatacccggagacctgtaattcccattcagtattctgtttgctagtcaagcagcttgtacagatcgttgtctgttccattttttcattcttctggtttttttgtttaggaggctcttggattaccagtacgaaccgctgtctcttttctagaatcaccaacatggaacctatcaatatttactactagtactacgacttgctttcttcttgctgagatctatcatgtactgtacataactgacgtgttcagctgcacttggacaagtagatgctcgttctgtatgtcgaatttacttgatgaggtcgagcattaagtaccatggctgcagccggcttctgtttagttgtgctgacatgcggcggcgacctcacgctgtgtggcccattcttgatcttgggccgaaactgtagcaacgggcgtacggcccatctatatcgggattgttcggcccgttgtagatgggccggatcgggattgcgacttacgtgcgacccatttcggttgggccggtggtccgctacttcatctagcagtggtcggcggcagggttcacaattccaatagaatccaaacattattggattgagttaaaaacacaaaccaatcggctttttgtcaggttcagaaaattttaaactgaattttaattttttgacaaaaatctatttagatttcgtctgtgtttttaggtttgtcaacggattcagcgaaatccgatgatatcgctcgtgagtggatttttgatccggtatcgagattgtgaacccttgtcgcgcattgcctgacaaagacaaccagtgaagcgccgtgcgcgccgcgtgcgcgccgcgtgacgcgaagatgcgcaggaaggaacaagctggcaagcggcgcgcccatgacggcggcggcgacgacgacccgcgcgcgtgcgtgcgtcaacgcacgcgaccggccgagatccgtcggtggccgcggctatatataatacatcgtcgcctcacaccccccacacaccgagtcatcgctcgccggagttagagttcgtagcggcgaaggatatagccatatattatagatggcgattggtgttggtggctgctgcgccgtgctgctcgcggcggcgctgctcttctcctctccggccaccacatgtaagcacgcccatcttcttcttcttctttttttctttctttgtttttttttggaaatgagccgcagctgacaaaaagatcactcacacatggatacactgtcgtgacactaaccaatgcctaagccattttgttttcttgttttggatttttctttttatgtgtatcacttttgcttgttgctcttgcagatgcttatgattccctggatccaaacggcaacatcacgataaaatgggatgtgatgcaatggactcctgatggctatgctgtaagtagcggtggcagtacaccaacatctctacctttattttcgtctcaacctgtacatttacactatcttgttctactacctctaataaaaaaatatatttgatgttttaaaatctattaagttctagagattaggaaagctacacatggttttatgttttgatactattaagtagtatattttataagttatattgaaggctggggtttcaaaagtttgactacactagatcttattcaaagcgtctaatgattactgaacggaggaagtatgaacttatagacttgaagttaaacagcatagccacatctcttcatgtatacttcatccgtttcatcttataagattttctagcattatccacattcatatatatgttaatgaatctagacatatatgtacgtctagatttattaatatctatatgaattgggcaatgctataaaatcttataacctgaaaaacggagggagtatgtcgcaaacaacaacaacaataacaacgagcaaaatctatatcgaatccggtttccctcttgtaactgtatcaaagatctgtcctctgaaacgtcccctgttcatcaggccgttgtcacactgtccaactaccagcaattccggcacatccagccaccggggtggcagctggggtggacatggcagcagaaggaggtgatctggtccatgtacggcgcgcaggccatcgagcagggcgactgctccatgtccaaggagggcagcaatgtcccccacagctgcaagaagcatcccaccgtcgtcgacctcctcccgggcgccccaatcgacctgcagatcgccaactgctgcaaggctggatcactgagcgcattcagccaggacccggcaaattctgccgcgtcgtttcagatcattgtaggccattctgggaacagcaatgagactgttagggtgccgaagaacttcagtcttatggcgcctggtccggggtatacctgtagccgtgctatgattgtgaagcctagtaggtttttaagtccggatgggaggagggcgactcaagttctgagtaagtagtccatctgttgttctttttctgaattgctgcttgatgcccaattgcttgtatgtcatgtggaaatgcattaggaacatagactcagttgtgatttcttaatgctaagttggattaggcataggtttagtgaggaagggacaggagttggtcacctaagactggttgatctgatattagttgaaaacaagttacagcatgctaggctttacaaggctgagcctacttaacaaatgttgtcatcttttttttaatcaattttgttatctagcaactaatacatgtcaaattcagacagacatccccatgattacatataggacttgttgtttgttttgagttctatagtagaaaaaattcctatattcagtactactagtagtacttcttaacaaaaaggaaatctctattcacagtgacatggaatgtgatctgcacatactcccaatttcttgcacaaaaggttccatcctgctgtgtttctctctcgtcgttcgacaatgacaaaactgttgactgcccaacatgctcttgtggctgccgaaatgaaaaatctactacaggaaaatgtgtaaagtgagttaatataactgttactgatcttaactacaatttccactgggatcctagcttcttgttttcaccaaaaaattgtaacaatttcctttgcatttgacaggaagaatgcacctgatttgcaatccatcattcacggccctggcagatggacctggcagcctcttctccagtgcacttcacacatgtgcccagtgaaaattaactggcacttgatgctcaaagacaaggaacactacagagtgaaaatcactgtcactaacttgaactaccgcatgaatttcaccgaatggaacctggttgttcagtatcatcccatcctcgatatcacccagatatctggcttcaattacaagtcaatccaagtcggcaaaataagtaagtcaatctggaaccatccttttttgataaaaaaaaatgcatgtgtatgtgtgtgtatatatacttctgacctatgtctagattcgtagccaaaatttattttttttaaggacagaaggtgtatataccatctctctatcttttgctcacgaagttttttttttctccttgtatgttagatgatactacgatgctatggggagtaaagccctactatgatttgctcatgcaagctggtccgcttggaaatgtgcaaggagaactgattgtgagaaaggatttcagggcttcttccactactaacaataacaagggaagggccttcccagtccgtgtgtacttcaacggtgataactgtgtgatgccgcctccggatgcatatccagttagtattacggcttagaggcgatcgtcaagatgattgtatcgcattactatatttatggggtcatgaataaagtgtattgtcttgcctattgaagattagaagtaactataattaaattgaatctccaactagtattaagattgtcagaggtctgttattttgcttgtagataaaattctgcctatgttaacttcgatggtgtcaaagatatcaaatccatagcagattcgtggcaggggccaaaaaaaaaaaaaggaaacgacagtgtaagaccgacagaatatgtaactcgaaaattagagaaacaacctaactaatccctctgtttttttaatgtttaccgccgttgattttgaagacattcgtctctaattttaaacaaacaacatgattcatatttttccatgcttgaagtttttttgaataaagcgaaggacataaaaagaaaccccgaaggagtacagcggaaagtacagtttagcaaattgattttgcaaattcatgcaagaacaaatgtttttgctttgaagtctgaaccaagcttcatgggagtgggactgatgctgctactctgaactctaagcattcagggatcagtttttcagaggacaaaatgtactaccatccataatacccataagatgaaaaacatacagtggcttgaaataaatacacacaaaatgaaaaacccgcaaaaaaataatgtaggtcatggacttatggttcgcctttaactgttggttttgttggtcagttgcagctcgaagcaagccccagcttgaagctcagtattcagcaacctcaccaccttccaaatgtatcagatcaaacaatgatttctgaaaagaaaaaaaaatcaatatgcttggtcgtcggtctccaaaaaaaaaaaaatatctgcttggtcaggcctgtcctgcacggcgaaaatttggcattgaagcatgtgactgaagatttggcagctaacacatgaaccttctttggtttttatttgggacaatttatactactttctccgtttcacaatgtaagtcgtctagcatttcccacattcatattgatgttaatgaatatagacaatatctatctagattcattaatattaatatgaatgtgagaaatggtagaacgacttatattgtgaaacagagagagtatataagtacactaagactttttcatataatactccgttagcttctctttaaatatgacgctgtagcattcagtggtcagtactgtaatgtactccctccgtacttataaaggaagtataaaggaagtcgttttggacagtgacacggtttccaaaacacaactttgatttcttatttctataaaaatatttattgaaaagtgatatgtgtatacttttatgaaaattatttttcaaaacaaatatatttcatataatttttatattttcaaactcaacaacataagagttatttatgatttatattctcaatgtttgacttaaacattatcctaaacgatctcctttacgagtacaaaggagtacagaggaagtacatgataattaaacgaagcagaaggctaaacattttcttgcttcgaaggtcagcacttccatcgttgatcacacaacgaaactaataaaggattccttttcattagtatttatattaaaaaagttactgctaccgttcaagttttagacttggctcaatgctcacatctataactaatcattgattcggcatactcattgacaacgagtcatttataatgattctgacaatcccaacatatgccggcccaatctcacgagagtttattgggataggatacgtctatgtgcatttgcataggtgaatgtgtagcgttgtttttttctaaaaaatatttcccaaggtaaaaagttaaaagaaaaatcaaaaaacgaatttgctagaaaatttccacaagtcttttttgcctccaaaactttcagatttatgaccatcggatcaccttgagatttatgtataaagaaaaaatttgctagaaagaaatttttacacatgtcacgcgtgatatctcagtgctagctaaccaaaccatcgttgaatacaagtttcatataaattatatcgtaggtacaataaagttatattacaattacaatgcatttaaaatatagttacaatgtaattacactcctattatacttcaatgtaattacatcttaaatttattttttactagaaaatttcggcgcatgtaaatcgagaaacctcgttagtgcataattaattaagtattagttattataaaattaaaaaatagatttatttgaattttgcaaacaacttttacatagaaacttttcataaaaactcaccatttaacaattcgaaaaaacgtgctaaccaaaaatgaaattaaagtttagagatgtgaaaaaaaaaaccgggcccacatctccccccggcggacacgtcacgcagagacgcagcggtttccgtacaactaccacaccgacccgagccagctcccttcattcatctccccatctccgacgactccatcctccacaggtcacaaagagagagaaagcgctaaacccaaaccggtctcgacctcgtcggcgccgccgcggcgaggcgtcacgtcagggaccaggagatggcggggagcaaggcggcggggcggggagggaggccgctgctggggggaggggg

SEQ ID NO: 44302 - DNA, 8867 bp, Oryza sativa
  unsure (1)..(8867): unsure at all n locations
gctgctgctggcgtcggtggcgctgctcctcctcgtggcgctcggcgcgctctcgctgccctcgggcggcggcgtcggcgtcggccacgccggcatcggcctcccccgcccgcgcccgcgcttccgcagatccgccgcgttcgagtcgtgcgtcgtctctcgcgcgttccttttgaattcctcccccgcccgcccccccgtgattgattgatcccctctctccgtgggatcccccgcgtgtggctgacgtgcgtgcgtgcgtgcgtgtgtgcagggggctggagatgcgcgggggcgagaagggggagccgtggacggaggtgctgtcgtgggagccccgggcgttcttgtatcacaatttcctcgtgagttttttctttgccttgttccttgttctcttttggtttttggggggaacaaaccgcgcatgttggatgatatgttcattctacgacgccatttcactccattgcttgatgagatcttcagttttttttcaggttcaaataaccctctaattaggtgtttttcttttctttttttggttgatatgatcgatttccgtccgtcctttgggagattcgcttgttccttattggagtaaagaatctggatggggtgggtaaatttggaaattgtcttgctttagatgtaggaatgccaggtgagatttagtggtgttgtgaatcagagacgggcagagtgggattgctttccagatctgagcagctgcaccattggcattgcactttttacagagggagttgttgtacatggatgtgttgttcttgtctcgatgtttgagctgcgccgaataatttgtcgtcttctatttatttctttttgaggttagagagtattcttgtagcaatactcactggcattcttagtcagtttcaatctttgtttttttaagtttcaagcaataaaattgaagttcatgttgattgttgatgagcttgcgtggagcccaacttttgttttactgcaactactcatatactcttgtttggtttattactgatcaagaaatgactaacttctcttccttctcagtcgaaggaagaatgtgagtatctgatttcattggcaaagcctcacatgaagaaatctactgttgttgatgcatcaactggagggagtaaagatagcaggtttggatatcgtagattattctcttgaaaacatgttacctcaattacaactcgtttaggcttaatggcatgtcacatgttcagggttcgaacgagttcaggaatgttccttggaagagggcaggacaaaattatccgtacgatcgagaaaaggatatcagactacaccttcatacctgtaggtatggcacctttaacacagtcaacttatcgacctcctgaaaaatagaataagtagtgcagttttccttttgctaaagtgcagaactttagtcattgtagaaaccatacatttaaacttcgttccttggccctaatacagataattgatatccctatatcatgaaacagtgcaaggttttgaatctttctttatcttgcaataccttatgtcactgaatcaccaaaacttacactttatagtgatgcatttgaacacttagctacctgctgtggaaccaaatatgaaaaagcattgcctttacagagtgcaattgtactgctcttgctctctccttttgatctgatattagcagagcaacgcccatagagaaatgttaaatccagatcacttgccagtaatggtttaacactttaactattgttttataaatccagatcaataagcagaaccaccaagaaaaacacaataagcacaataatccagatttactgagttactatggcctggtttagttcccaacttttccatcacatcaaaactttcctacacacacaaacttccaacttttccatcacatcgttccaatttcaatcaaacttccaattttggtgtgaactaaacacaccctatattgagagcatattagagctagaaagtctctgttatcagatttttttattacccctgagccctgtcattccttgaattctgttcggcagctgacatttgtgaccaataacacaaggcctttgcaagtacaatggtacataatgagcatgttgtagtacatgtgaaagtcaaacttctcatatttacaaaaaagggccagtgcatacttgaacagaaacccagaaagatctacacaccaatttctgaaatgtcctgtacttattatgtactcaaatttctttaggcttttcaaacattacatataccttttgagttattaaacgtgggtggtttgacactggcgcacttcaataaatagtcagtaaggtacacaaccaacaagatgcaatgtacatggccggtattgattttttttttcttttttgcagtcaggaataataatattattattacaaccaaatctgatggatagtcctaataattcctaaatatattcaactatcatcaagtgcaacaaattttttatcatagaaatcacattatttttttatttcaagtttgttgcaaatgttgttgttgttcctttctgttcatactcataatttcgcagagaacggagagggtcttcaagtcctccactatgaagttggacagaagtatgaacctcacttcgattacttccatgatgaattcaacaccaaaaacggggggcagcgtatagcaactcttcttatgtatctgtatgtactataatattggtaattcttatataatgcaacgccgctgattcatttgacatttgtttttgtcttatttgaaatttattagttctgatgttgaagagggtggtgagactattttcccctcttctaaagctaacagcagctcatcaccattttataatgagctgtctgaatgtgctaagaagggtttggctgtcaaacccaagatgggagatgctttgcttttctggagcatgaggcctgatgggtctttggatgccacaagccttcatggtgagattccaatactttggtacaatgtcaaattgttttgtagtgaatggttatgccacaacatgatgacatttctatttaccttcaacttcctctaggtggatgtccagtgataaaaggtaacaaatggtcatcgacaaagtggatgcgtgttcatgagtacaagatatagacatcagaaactagagattcagaggtacgagtgagctgctctgcaatttcctccacgtagcactgtctgttcacttggtttttttcttcacgcaattcaaatgtctgtgatcaacccttctgattcatttaaaatttgtttgatttatatttattttcaactctttgcaggttactcacgaattcaaatttgtcgatgttgttgcttaaagaaagaaaagaaaagcggtcatttttggcgcatgttgaggacttcaatttttccatagagaagcattacaattttttttagctgtaaccaacatgttgtacactaacttcttaggcttatgaacaatgatcatcgctttgcttatgaacaatgatcgtttcaaagcgatggatgtgtcgaatgtataaataataattgccctcctaaagtcgtaatgaaattcatgatataatgcctgatggactcattgacaaaaatagtctcaataatatgtgtaattttttcctaaaaagtaatatgtgcaattcctgcagagatctggtagtactccatctatcctaaaatatagcaatctacttcttccgtttcatattataaaactttctaacatgtccacatttatatatatatatatatatatatatatatatatatatatatatatatatatatatatatatatatatatatatatatatatatatatatatatattaatgaatctagatatatatgtgtgcttagattcattagcatctactatatgaatgtggcaatgctagaaagttttgtttcagaggtactccctctgtttcacaatgtaagtcattctagcattttctacattcatattgatgtatatgtctagattcattaacatcaatatgaatgtggaaaatgtctagattcattaacatcaatatgaatgtggaaaatggtagaatgacttatattctgaaacggaggaagtaggggctgtttggatggttgcctcaacctgccaagccacatattaggcatgccacacctgcttagcctaccgtttgtttagagaccagatttttggctgctacaaatagtctgccacaactcagttgctttgccattggttttttgggcaaagacgcggcgagcaaattattcgccacgcttgcggcacgactgttgcgtgcggagagagagcgcgctacactcaccttcgtgaagaacggcgtgaaaatccttttgtgaatagcgcgaaacatttgacgttttggcgcgaacaatctggaaaaaaacgcgcgaagctcggtatctccgaggctcccatgtttattatcctctcttgttcctcttttctctctccaattcattctcccgtgcagctccaagcaacaggcaactattcccctctttattccattagcttttttcatcttctgctccatccctttcagatcctcttttttttctttaaatcacacaagtaatctgtttcactgatgagtgctcaagccatggagcaatctgtttttttcctaaatcatctccatccccttcatcttatttagatccatatgttccttcctttccttcaaatccagattctaattaatttgttcctttcgtcagggcttgagtcatggagtaggctggtgaagaggagtaagtagtgtggctagagcaaagatctggccgtgattcctcgagcgtccgccatcgaatccaacgagccagcaagtttcatcacggtaagcacactgcacacagccgtatttgtttttttgggatttggggtttggatacttgaactttattttgacttctgaaaaaaaaacttatcatccaactgacaaacttaaaattttcgtaaaattatttagtaaaaaaggaagtgtacaagaaaacagtagccgttgaggctacgaactccatgtgttacgtgtagctctcaactctgacatatagtacacgtgcgcgtgccaccgtgtcatcgcccagcgccgcggcgactccagcaaattcgcgagcattttttatacaaagccccagccgcggcggccatgggaaacggtggtggtgggaacaagaaggggaggagagactcgccgtcgccgccgctcgagacccccccgcgcggcgagttgccgtcgacgtcgtcgtcctcctcctcgcgcgccaccaagcgtcaccgcgtggcgggcatggcggaccgctacttccccaacgacctcccggacttcgtcgccgaggcccccgacggcggccgcggcttgctgtcgctcccttactccagcctctccgaaaggctcctccgcgccgcgctccggatcaaggacaaggttaggcatgcgtgtgcctcggtttgggtttgggtttgggtttgggtggcgcgcgcgcgcacgcacgcaaggtgttcggctgatttcccccgaccgctccctgccccccccgcaggtcatggaggagacgtggacagggcgcggcgacaggtgacggactacacgctctacacgggcgcgctcggcacggcgctcctgctgttcaagtccttccaggtcaccggcaaccgcgccgacctcgccctcgccggcgacatcgtcaaggagtgcgacgccgcgtcgcgtggcctgccgtaagacgacgagccttttttttgttttcgttctgtacttctgttggttagataatcttgtactaccagttgatgagttgatacacctgggtgtcatggcctccttggtgttaaattaagacgcaggttcttgacattcatctgtgggagggctggggtttgcgctcttggtgcagtgattgcaaaacattgcaatgaccagctgctactcacacactacctgagctcatttgatgaggtgaggagccaatgcatgtgttcacatttctgtcctaatgtgctccatggctgtaaaacagcagatgttatgtctaaattctaacattgtagactgagctatctttgtttgtacttctgtagataatagtcactgagaaagttcccaatgagttgttatatggaagagcagggtatttgtgggcttgcttgttcttgaatacgcatctcggcgagaagacaattccccatgagcacattgtatgtctgtactgcgattctgttattttctttcatattgtcagttccatagtgctatagaaagcatcttacctaattttgtgaaattactgcaactgtgtagacttctgtggcaaaggacatcatcgatgagggaagaaagctggctaaaaaggggaactgccccctgatgtatgaatggcatggaaagaagtactggggtgctgctcatgggcttgctggcattatgcatgtcctcatgcacactgaactcaagctagatgagaaggatgatgttaagaacactctgctatacatgatcaggaacaggtatcctactggcaactatccatcgagtgaaggcagtgaatctgaccgcttggtgcattggtgccatggtgcccctggtgttgctcttacactcgctaaagcttatcaggtgactgcctacatcacatcattaaagtgtgtacacatgtttatccaaagcatctatgtgtacttatcttggtggttgtgcaatatgcatacatggtgtagctttgttttctgcatcaacaaaaatgtcagcgatttgacatcttgtgaaattcttggttgaagattagattccgcgtgtgatccaacatagataactgaatgtttctacttcaggtcttccatgatgaacatttcaagcagacggctgcagaggctgcagaagttgtctggaaccggggacttctcaagagagttggaatatgccatggtgtaagtgggaacgcctatgtatttctctcactctaccggctaactggcaatgttgagtacctgtaccgggctaaggcttttgcttgctttctgcttgagaaagctgatcagttgattgctgatggggccatgcatgggggtgatcacccattttcattgtttgaagggagggctgggatggcttacctccttctagacatggttagcccatcagaatcaaagttcccggcctatgagctttgaagggcatcataaatatatgtatcctgttaggatcaaatgctcagtgatccatccatccaaagtagctgtattgtgttttcttgcgtacccagtaatgtgtgcattgtaatttgttgtctttgtaaagttcagtatccagatggtgcaagcttgaacctttgtaaaatacatgtttgagggagttccttgaaatatgataatatttatgttggttgttgcctctatttgtttactgaataaaatatagttttgcctccatggataagttcagcaaacaccaaatttttgccatgctaaagtcatgagattaaaaggagtttgtattttcttagcaagtcagtatatggttgatgtttcagtatggtgtttagctgaaaacaatagatgtacatacatgccagagcaggctcacccaggttattagaacctttcatgtatatctagcatggcacaccaattagtttttagtagtttgtggttgaagtttccaggtttttgattttcttttgccccatgcgttgacataatgtacaagagagttattctactggaagttgaaatagctcttgcatcacatcctgctaggtggtacaaatttgtagtattaaacctgaaaaaaagaggataattttcttcagttgcacatttatttatacaacactaaaatagtttgcgataccatcatgagcacgacgttacaacgtcaactctttagtggtgcacatcagtgaacgcagtgctcaactgttaccttttgcagtctggggatttgtcaaattgcaccttgtttttgttgctatctcatgcatgtttactgacgaagtctatcacaagctgattcaccaggtcagggaattgctcctgaacaaaatgggatccttctgggatgtaagtgatcccgtagtctggagcaatttctttcagtttttcacttgacatatattccttcagtgctggaaacttgaggatgtagtctttctgacccataatcacaaacattggcatttcaaaccttggattagcaccttctgcttttgcagccttggtcctattaaatcaacacaagtgttagtaacatccttaggtttgtacaagtatcaaagtaattgtaatagcatcatatcaggacactgagaattgcttgtcatattttgttgtgttttttgcatgtgctcacctatatggaatttggatagcagtcatgagacctgatttctcatacaggtcggtgtaagctgagaggtcttcttcggtgaaccactgaggcatcggtgttgattcatctgcaaggtccatgatctcttgtccttgcttggcaactggaatctcactcctggagaagaggatgtagattgtgcgcaagatcctcctcgtgtcgaatcggccaaaatccgcctctgctctcccaggttcctactcaggtaacatagttgcatcacaacatcaatcagaattgcaaaacctatgttcagtataaatgtattgactgtaaactgtgtttaccaaatagtcagaaagaataaaaacttgatcgatgagtgtttaattaatttaccctccatctgtgtatgtaaaatccctcaggaagtnnnnnnnnnnnnnnnnnnnnnnnnnnnnnnnnnnnnnnnnnnnnnnnnnnnnnnnnnnnnnnnnnnnn

SEQ ID NO: 44303 - DNA, 17701 bp, Oryza sativa
  unsure (1)..(17701): unsure at all n locations
ctgtgtttaccaaatagtcagaaagaataaaaacttgatcgatgagtgtttaattaatttaccctccatctgtgtatgtaaaatccctcaggaagtccactgaaactgaggctttccacaagaggtggcacacctaagctcacaataccacatacgcggtccggatggcagagggcaagatcatatgctggtttgactccaaaatcctttgcaacaaggaacacctttcaaccatgaaatgatcgtcactcgtcaggatacagtacttcttttcaaaaattaagccaatttacaaacttatcaataatcaagtaaaataatgcatggatgaaaccataaccaattttgccaatggggcaagttctaatttacatcagcttctgacttatttcatgtttgccatagttatcaaaatgcgttagagacttggggttcatcttagcatttgcataaacttttattggatctcaatgttttctcctgcctgtactcaccttgggaatcgacagcgagtctagaatggccaagaggtcattcatcaggccctgccatgacgcctgtgttaggtcagccggtggctccgagaggccatagcctgggaaatcaagtgcaatagcacggaacccggctgctgctgctgcaatcatctggtgcctccatgagtaccacacctcagggaagccatgaacgaagagcagagttgcagcttcacctggaataaccaaatcaagaagctgagctgcattctttcggaagagcaaaaaaaagcagagagatgctgatgtcaacaaaaatgaggtaagattcagaccttttccaatgtgagctatgtgaagcttcaggcctctgatgggcaggtaggagtgctcaatcctctgatccattgatatgttctctccaacgtcagtctgatttgcttgagattatataggattatagcaatttatgggccgaacttttggtcaggctagtaacggatggatggcacaaagatgcgcacactttgtgtgaagcatcttctgctgatgtcttctgctgtttttgtcagtttgtggtagccagagacaagatgctgatgtcttctgctgtctgtattttaatactccaagcaacgctgcaaaatgttaactgaaaaagattccctctgtacgttcatcagtcaaataacgttactgaattttcatggtctatattactcgattttgactattacttgttcaaatacagtcattaaattgatttatgttatctttcacatgtgctgaagctttggtttgaagcaattgtttgcataaagaaaccagcagtaacaaatagcaaacagttcgttttactatctgcttcattctgataaagtagggctgtaaaaaaagctcgaagctcgcgagctgcttgagctcggctcgctgtagactcggctcgagctcgattcgtcaacaattcgagccgaactcaagcctagctccaagcttgcgagcttgacgagccgagctcaaatagctcgtcgagcccaaatttccctctgtcaagttcttaaattttcaatacaacagctagtactactcctactcccaatgaaaagctgtatagaaacagagcgtgcagggctgcaccgtgcaggcactagcctactagtactactttactctgcagcactagcctattagtactactagcatgcatgcagctctatttaatagtactactagttgtcatatcatgtttgaaaaagctactagtactagtagtactcgacaagcatgcatgcagcctcctttcatctgtattggttatttgagggcacacgagttaggctcaagaaagctcgaggctcgagcgagccgagctcgagcccatttctaagcttgcagtttaaacaggctcgactcgagctcggcttgagttggtgccgagctcaagcctatataggtaagctcgctcgagctcggctcgttgacagccctatgataaagtctcttttttttggaaggtgataaagtctgtcttttaagatttatcctgatagtcagttgcaaagatagtactaacatgctaagtataatgaaaagtttgagaaattctcaagcaattggcaaattttgattgactgacagttgatggttgcaaacaaatcaagacatttgcaataaaagaaggggagaaggcattcgtgatcctcaccttgactattttaaagatgtaattaccattatcttaaaatagaaaccgagtaataaatgagacacgaccgagtgaatttttgtataggggattgagcgttgtctttaatctgattagtttactatatttagggcatttctaaccctccacctagaatggtgtctatgacattaactacattgtcatgtaggacttttagtttatgtgacactatattaattaagagagagagagtggagagaggaagaaactgggtctcatgcaagacacagcttcaacacgagaacctatgcactagacactatcaagttttacatttggagagaatagtgtcttcataatagatgaagaataaatatgattggtagagaaaagagatgatgtatttattaatggcatactttaagaatccatgggttgtagagtgtagtttctattgtgatgtcttattgacatggcactatagacactgcttatgaatactatgggtttggactgcccttagaattgaaaagtaatagctaatcacaatttcaaaatgtcggaatccagtcatcacaaatgacgatcgaagatggaagcagctgtagaatgtcaacaggttacaggcccctaatgtcattttcgctctaatgttacagttcatcaatgtcaatcaatgaatatggtttaggccatgcttagaaggtgggttttttattgcgagtttgtacggaagtttgagttaggcttttcgagtatgacatatgttgttttaattaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagcagtatatatttaatactctaaattagtgtctaaagacagggacttaagttaagtccctggatgtaaacaccacctaaatgttggcagtttgacattcagtgcatttcaataaatagccggtgtggtatgtaagtacataaccaactagtagaagattttaatgcacatgacgggtctataattcaattttttgcagaccggaaaaacaataacgttacagcaaaatatgatggttagtcctaaatacatctaattattatcaaacgcaataatcttcaaccacatatgctaagttattttaagctataattacccatggttatagtcactaatcacagcgtccaatagtcacaaatgaggataaagaagatggaagcagcaacatgtaacaggcaaagataagcatttcactccactttgcagcaaagtcaatccatgaacatcagtacatcacataggtcatgtttagaaggctggatatttttatgagtttctgtagaagactgagcaggttcaactaaaacctaacttgccaagtgccaactcaggcaacgtaatcatcaacaacaagtcgcatgtggtgatttcatcaatcttaagatatgtcggctctgttttcaaaggtgtttataggggtagcgcgtttataggagtaaatgtgcacgtgcatataggcgtatgcgtttgtgtttcgaaaaaaaaaagttaatccataaatatgatataggtcatgttcgaaaggctagatacttttatgagtttctgcagaagattgagcaagttcaactgaaacctaactcgacaagtgccaaccaaggtaacgtaaccatcgacaacaagtcgcttgtggtgatttcatcaattttaagatacgccggctcggttttcggaggtgttcgtaggggtagcttgtttataggagtgagtgtgcacgtatgtgtaggcgtatgtatttgtgttttgaaaaaaaaaagttaatccataaatatgatgatataggtcatgtttagaagtctggatatttttatgagtttctctagaagattgagcaggttctactgaatcccaacttgcaaggtgccaaaccttgatgattttatttataaaggtatcagttccaggctacttcttggattccagttcataaaccgtttgtcctgaatccctgaccttcagacaaatcagaaggtgccaatgcagaagagacactaaatcttggtttgttttcatcacctccaagaaacagaaaattctcctataaaaccgaagtgatcactctcctcccgagctcgaaggagcaacaatggcggatcagatcgagcacctccacctccccatccgtggcctcaacctccacatcgctcaagtcggcaaaggcgagatctccttgtgtatctacggacattgaactgttccatgtgttcttcacaaattttaggtgagattttgcgttttgggtggtgaattttgattttgattcttttttttttctggatgcagatgagctcgggacggtggtgttcttgcacgggttcccggagatatggtactcgtggcgccaccagatgctcgccgcggcggccgccgggtaccgcgccgtcgcgccggactggcgcgggtacgggctgtcggggcagccgccggagcaggaggaggcgacatgggacgacctcgtcgccgacgtgcttgccatcctcgacgcgctcgccgtgcccggggcgttcctggtgggcaaggacttcggcgccatgcccgcctacgacttcgcgctccgccacccggcgcgcacccgcggcgtggcgtgcctcggcgtccccttcagccccgccccggcctccttcgacgccatgcccgagggcttctacgtcctccgctggcgcgtacgtgctcgccgccgccgccgccattgccgccgtcgccgtctgttcttgctgctgacgcgaacgcgatgtgtgtgtggtggcaggaggcggggagggcggaggcggacttcgggcggcacgatgtgcggcgggtggtgcgcaccatctacatcctcttctccggcgccgacatccccgtcgccaaggaagggcaggagatcatggacctcgccgacgcctccacgccgctgccgccgtggctcaccgaggccgacctcgacgtctacgcctcgctctacgagaactccggcttccgcttccccctccagatgccttacaggtacacaagccgccgccgccgccgccgcggcggcgcagccaccgtgtccaccattgtcagcgacgaacctcgaaaaaaattacctggctccaatagatagtaattatttaattattgacttatatattactccattcgtttctaaatatttgacaccgttaactttctagcacatgtttaaccattcgtcttatttaaaaacttttgtgattgtaagtatatttaacaatgaatcaaatgttaggaaaagaattaataattacttaaatttatttaataaaacgagcagtcaaacatatttaaaaaaatcaacgatgttaaatatttagaaacagagggagtagtaattactattatgcaatttagttagtactcccttgtcccttcgttccattttaagtgcagccatgattttatcatccttcttatttaaaaaatttttgaaaaaaaaattaaaaacataagtcacacataaacaactatttatgttttatacagactcatggttacatttaaaataaaacggagggagtattggataatttacatggatcctatgaccccgggatgttgaacatgagatcgtcactggccattgctgatcgttgcatgtctccatggatggatcgtacgtgcagggcggtacataggaggccaagccggaaggacgcgaggttcgaggtgccggtgctgatggtgattggggagaaggactacgcgttcaagttcccggggttcgaggccgccgtgcggggcggcgccatggagaggttcgcgccggagctgaagatcgagttcctcccggaggggagccacttcgcgcaggagcagctcccggagcaggtcaaccggctcctcctcggcttcttcaccgagcacccggttgccgccgattgagatcctctctctaccttcgaagtgatcacgcgtttatcactgacatgtgaatctagagtttactggactcactcacatgttagtaataaagtcacgtaacttacaagatagactatcttaacgtaataaaatagggacgtctagaagcaaagtgtaatattgggatcaagtattgtactcgcacacaatttataatccacgtgtaatagtgggagtgaatgtgaccgtgggaataatttgtaatttaataattttaaagtttaaaattagtactacctctattttatattgtaagtcattttaatttttttgggttaaacttctttagatttaactaactttgcagaaaaatatagtaatattttcgaaaaaactatcaagttcaatgttaaatttaaggaaacttatttagtgttataggttgttaaatttaaggaaacttatttagtgttataggtgttaccatattcttttttataaatttggataaatttatataatgtttgataagaaaaatttgaaacgagttataatatgaatcgatggagacaaatatatctcaattaaggaagaagaaagatggtgagcaccaaccagggctagcttcctgccagctatctgccgatctatttaatgcaccgttttctattatggaaaaattagtaaatgaactactctcccgtgtgatattaagttcatattttgacttcttccattcattccaaaataaatttattttttaagtaatcattgcatctaaatttgtaaatttagataataattgaattcggagtagataaaatagagaatagttgctttgggatttgataaatagggtattttatctttttatttcgcattggtatgtgtcggtgacatggggccgggggtatcgtgactagaggcttgggtagccgcggtcacccacgtggcctgaccccctcgggggggtcgggcccgagggtgacgtggccacccctccctctgtctccccgaggggtcgggccgctcccgtttcggccccgagggctggggcgccccgaccccctgtggttttggcgccacgtgtgtgggttaggtgagcaccgcatttatagcaggttggacgagcgcgtcacgccgcatttaatgcagcgcagcgcacgcttatccggtccgtgaccggtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccgggaaagcgggcgagcggggcaggaggcgtgcgcactgcttgtcagaggtcacttccggctgtagactagccctcattgtaaaaagcatgtttcccttcttaggcagcgagaggcccatgtggtgacccctgaccagagaaaaaggaggcccaggcttagaaagagagaaaaaaaaggagaggggagttgggactctggcgaatgggttctagagcctgaactctctctcgctctccggctctctgtattccttcacatacagatccaccagaacacaggagtagggtgttacgcttctcagcggcccgaacctgtctacgtcgcccgtgtctcgtgcacttcctctctcgctgacgttcctcagatcgagggcgaagaacctcacttagcgcccccggccgaaccggcaaaggggggcctgcgcggtctcccggtgaggagccccacgctccgtcagtatgtatgggatggatgaaaaataaactcattttagaactaagtgagtataataacaacgtttgatttttaatgtatgaattaatagcgtcaaaaatattaaggatgatggtagtatatgcggtaaaaacgtaaagataattcacacaccacgaacgaaaccttctccaccttctgtccacgagttggacatgcaccagcagctagccagtacaaagaaaaaaaaacgtacagcaggtgcggcatccccatctgaccccgcgcgactcacctcacctcccccgtgagttgggatcctctcctgtaatgtatgtgcggtaagtgccaatgacatgtgggcccggaataggtgggacccacatgccagtgacacgtactgcaggtgcagtacagcagtggatttgcatcccccacctcacactcccaccaccgtcaggtcgcccctctgctctctgcactgctgcggcgaggagctagctcgagccggccggaagccatggccacggcggagcagcggcagatcgagcacgtccacctccccgtgcgggggctcaccctccacgtcgcgcaagccggcaaaggtttgccctgcgcgcgcgcgcctcgccgccgccgccgccgccgacgatcgtcgggtgaatgattgttgggctgctggtggtttgcaggggagctcgggacggtggtgttcctgcacgggttcccggagatatggtactcgtggcgccaccagatgctcgccgtcgccgccgcagggtaccgcgccgtcgcgccggactggcgtgggtacgggctctccgaccagccgccggagccggaggcggcggtgtacgacgacctcatcgaggatctcctcgccatcctcgacgccctcgccgtgcccaaggtgacgatgaagtttgatttttcacagatttttatcctcttttcgtagcttcagattaagaaaaaaaacttcagattttcagttttgagtgcgtggccttttgctatagctcgtaaaatgtaaggtataattcataattggttgaacaaaggttcgagatttcgattttttttgtagtttttttttaatcctggataatttgtaagtagaacgcataaactttcagtgtcgtgatccgtaaggtagaaatttggagaggataatttgtctgctattattttcgtcagttgatactactatcagttccaccgaattgatttgaagctggtaaaaaacccacgttggtagcaccaacaaccaagagtgtattgaaggtcagaaaattcagtgcaacatattaaggtgccatttttctattcattctaatataatcggcaatgcttttgccgcctacctttaaagaaagtgccatttttctgtctaaaagataaggatatcaatttctccctaataaagaaatcagctccttataaatttgaaaataaataatgcctatttggtttcttcttgataatttatatgtttctttgggttaggcattccttgttggaaaggattttggggcaatgccagcttacgactttgctctccgtcacccaaaccgcacatgtggtgtgatgtgtctgggcatccccttaggcactgctggtttgtcctttgacacattgccagaaggattctacattttacgttgggcggtaactccgaaactgtcatgataatttttttagtgcactatttgcttataatgaccatgaaaaagaaaaatatatcttacagcaaccaggaagagcagaagctgactttggcaagtatgatgtaaagagagttgtgcgcaccatctacatactattctctaggagcgagatccccatagctaaggaaaatcaagagatcatggatcttgcagacttatcgacaccccttcccgagtggtttagtgaggaggatcttgatgtctactcatccctctatgagaattctggttttagatatccgctacagatgccatataggtaaaaatattttcttcggatatttgtactcgatggtactaagttcaccaatatttgatagttcgagatttgtgccatgcttgttaggtctctgcaccagagaaaaccaattggagatgcaaaattccaagtcccagtgtttattgtcatgggagaaaaagattatgtctttaagttccctggtatcgagtctgctatgaaagacggaactatggagaagcatgcaccaaacataaagatcacctacatccctgaaggagggcattttgtgcaggagcagttccgtgactatgtgaatgagctccttcttggcttcttgaaagatcatcctgtggttatataaatgctattgtagcctcagttgtgcttcacccgtagttcaagttggcttagaaaacgttgtgctatatcatggtatgaatttgtcaacaaactaaggatcagctatggctagtttgttactttcagtaatgcctatttgagcttgttgtatctaggttgtcctgctggtgttactagcaatgtaaagactaaacccattgctatacttctaccatgacttttgcaagccaatgatgtgaacttataccatgattttagaaagtcttactgtaaaagacggagtacgtagttactatgtatacggatgattaatcataattatataaaaaattaaaaaattaacaatcactgtaataagtacttatcttttatgattgatttagttttagagaaatgtttgtagatcacctatctcatattagagaaattttgacctaatcctcttatattagagaaatattattccggtggccgtgcttcctcccttcctcatccttgtaccaaacacaataactcaaactgtcatccctctttcagcctcatcaacccaataaataaataaatatagacttaagtctactttaacccaaaaattttgtgtgtgcgcgtgcttgtgcgtgtgcgggggagtggtggtgggggttgggggccgtggttgaatctttttttaaatactaaaatgagtactcatattcgttttctttttttctgttaaatactaaaatgagtacgaatagctcgaatacaaaaataatcatggattatctcgaatccagataagggcaaaatataattagacacaaaaagaacaaataattaaaaaaatcatattgttttggtgtaaacatataaaggcaattctgaaatgtcatctactccctctgtttcaggttataagacgttttgacatttggtcaaactcaaactgtttcaagtttaactaagtttatagataaatatagtgatatttataatactaaattagtttcatcaaatcaataattgaatatattttcataataaatttgtcttgagttgaaaatgttactactttttcctataaacttaatcaaacttaaaatagtttgactttgactaaagtaaaaaatatcttataacctaaaacggaaggagtagataactaagagtgccaggtagaaggaaaaccttctctacctggcgtccactagttcgatatgtagcagtacaaaaacgtactctctccagactgataatacttgttgttttagataagggtgaggtcaaactttagaatagttgattagaattatttttaaagtatttgtttttcaaatatcactatagattaataaaatcatatatttgttaacatttatatatatatatatatatatatatatatattataataaaaaataatggtcaaagttgtttttttagaccgtatccttatccaaaacgacaattattatcaacccgtagagatgacgcatccccacctcacactcgcactgtcacgacgtcgcctctgcaatctgaacttctgcggcgaggagggagctcgagccgcccggaagccatggccacggcggagcagcagcagcagatcgagcacgtccacctccccgtgcggggctcaccctccacgtcgcgcaagccggcaaaggtttggccgcctcaatttgcgttgcctgcgcgcgcgcctcgccgccgccggcgatcgtcgggtgaacgattgttcggctgctggtcgttgcaggcgagctcgggacggtggtgttcctgcacgggttcccggagatatggtactcgtggcgccaccagatgctcgccgtcgccgccgccgggtaccgcgccgtcgcgccggactggcgcgggtacgggctctccgaccagccgccggagccggaggcggcggagtacgacgacctcgtcgaggatctcctcgccatcctcgacgccctcgccgtgcccaaggtacgtaagctcctcagtttaatcgatccttttacgaatttttttagcaggtttccagttttgagtcctactcgtgcatgcagactgtgaagctgtgtaaggccttcttgctataaaacttgcaaacggaaggcataattcaaaacagaatttttcacttcttgtgtgcatcctggttagcaatttgtaacgaaacatataaacttccactgtcatacacagcaagggagatatttggagaggataatttgttttctgtcgttaactagtactgtagtctagtattcagttggtaccacgtcggtaagcaccaagccaccaacaatcaagattcaagagtatgttagaggcatgaaaaatgagtgcaagatattaaggtgccctttttctgagtaaaagataaaagataagggtttcaatttctccataatgaaaccagctgcttataaatgtcttgccttcagtaaaaaaatcctttagtttgttgtttgctcctgatagtttatatgtttcttctgtcaggcctttcttgttgggaaggactttggggccatgccagcttatagttttgctctctgtcatccaaatcgtacatgtggtgtgatgtgtttgggcatccctttcggcgttaatagttcatccttaaacaccttaccagaaggattctacattttacgttgggcggtaattctctaactatcatgccaaaatattgtgtgcaagattcgcttatagtgacagtggaagaactcgtcttgcagcaaccaggaagagcagaagctgactttggcaagtatgatatcaggagagtcgtgcgcactatctacatactcttctctaggaacgagatccccatagctaaggaagatcaagagatcatggatcttgcagacttatcgacacccctccccgagtggtttagtgaggaggatcttgatgtctactcatccctctatgagaagtctggttttcgatatccgctacagatgccatataggtaaacatcaattcatcagttgtcagcactcataacactaagtttatcagtgtttgatagtttgggatttgtgctatgctttgttaggtccatgcatcaaaacaaaccaattggagatgcaaaatttcaagtcccggtgtttgttgtcatgggagagaaagattatgtcttcaagatacctggtatcgagtctgttatgaaagacggcagcatggagaagcatgcaccagacctaaagatcacctacattcctgaaggaagccattttgtgcaggagcagttccctgagtttgtgaatgagcttcttcttagcttcttgaaagaccatcctatggctgtttagaaactccacattgtgcctcacccttactacaacttcgctacaagaacactatattgttcgatattatgatgtgaattatcaatgaaggaactggtatggttgatgttactttcagcaacgccagttatgtttgaacttgttataccctgtgtctgcggctagtgttgtcagcaatgggaagattttttttgtttttttctcctggctgttaatgttataccctgatcttagcaaatcaaggcattagtactttgacacaaaaacatgcttagagaatcaccaacggttcccttattccatcccaatcctagttttttggaattttggtgaaaaataatgcctccaatagatgtcctatttgaatcctaattgtttggaaaccctttgccgcatcctttgttctatttacttgagggagagcgacgtcgtgtctgtcgtcccctatctctcattcgcacgagatttttctcaagggtgagcgtcacgagcgcatgtgagcgccaggagcacgtgtgagagggaggaaaacgggaaaattggtgttagtttaacagaagtgcccacctttagttttgggatattttaggctttctcttggagagatcaattttttggctacctattttcacttcaataagccaaaaaagaaatctttgggggaagattatacataatctcctagtgatgttcttagggactctttgaaatacagggttccaataatctaggtgattttagtgccacattttcctgaatttgggttatcccaggatcggatcctatatcccttattaacactcccgataatctgggtgattttagtgccacattttccagaatttgggttatcccaggatccgatcctatatccctaattaacactcccggcgattctacccaactaggattaaaaaaacgcgaatattagggaaggacctaatatcaaataattagaaggggtgaggcttcgaacccaggtcgtctattccaccaccttgtggagctagtcggaagactacttgagtgtttctcaaaagagggatgcaacaaaggacttttaaggaggtcacctatcctagtactctaggattactatatgattcttgaaaatccaactaattaacattctttgaactaaatacaccctataagcgtacatatataaataaaaaacaaatctataaattaaatgttgtgtcgtttaaattccaattatatcttgaaccacatgaaaaactcacgttacctcttgggtcacttgattacatgcaaaaagaacaaattttaagacaataaggcctggtttagttcctaactttttctttaaatttttaacttttccatcacatcaaagctttcctacacatacaaatttccattttttccgtttcatcgttccaatttcaatcaaactttcaattttgtcgtgaactaaacacatcctaattagaaataaatgatgtgaaacccaatgcgtatttcttagtatttattgggaaaagaaaatacttcctccgtcctttaatataagggattttgatatttttgtttttaccatttatcttattaaaaacttgtgtaaatataaaaaaataaaaagttgtacttaaaatactatggttaataaagtaagtcacaaataaaataattaataatttttaaaaaaaattaataagacgaatagttaaaccgtacgaatagttaagaggacagagcctacttttgtcaacgagttggagttcgacgtggagcagcaatgaatagccgcaaagtacggtagcttttcccatccacgtcacacttcacgctgtcacgtcgcgatctgctctctcttcccactgcagtgctgccgcgtgagcgtgaccgcgtcgtcgtccacggcgagctcgacaccatggccgccgccacggagcagccgcagcagatcaccgagatcgagcacgcccacctccccgtgcgtgggctcagcctccacgtcgcgcaggcgggcaaaggtacggccgcctccgcgcgctagccctcctcccccccccccccccccccgaccacttcgttcgattccttggcttgctttgcccgcccgccgcgccgcgccgcgcgcgccgccgtagctagcccaccaggtgtttgtttggctgtcgcatgcaggggagctcgggacggtggtgttcctgcacgggttcccggagatatggtactcgtggcgccaccagatgctcgccgtcgccgccgccgggtaccgcgccgtcgcgcccgactggcgcgggtacgggctctccgaccagccgccggagccggaggcggcggagtacgacgacctcatcgaggatctcctcgccatcctcgacgccctcgccgtgcccaaggtaagcgcctggatcagtttggctttttcacaaattttatcctctttgagttactgagtaaatgagaggcaaaattcataattggttggacaaagtttagaagtttcgatggatttttgtagtgtattgtttgagtcatggataggttgtgaccaaacaaacaaactttcaatatcgtaagggagagatttggagaggataattgataacactatcagttctaccgaattgatctgaagctggtagatgtagcaccaacaatcaagagtatattagaggcctgaaaaatgattacaagatattaaggggcacttttttttctgtataaaggatggaaggatatcaattattccctactaaaccaattcctctttttttttttattttcttgtgataacttatacggttcttcgtgtcaggcattccttgttgcaaaggattttggggccttggtagcttatgattttgctctgtgtcacccaaaccgcacatgtggtgtgatgggtttgggcatccctttcggtaacgatgcttcatccattaacaccttgccagaaggactctacatttttcgttgggcggtaattgtcagactgtcatgataaaacaataagtgcatggtttgcttgtaatgacagtaaaaaaaactcatcttgcagcaaccaggaagagcggaggctgactttggcaggtataatattaagagagttgtgcgcactatctatattctcttttctaagagcgagatccccatggctaaggaagatcaagagatcatggatcttgcagacttgtcaacaccccttcctgagtggtttactgaggaggatcttgatgtatactcatctctctatgagaaatccggttttcgatatccactacagatgccatataggtaaacatcaagtcattaattgtccatactaagtagtactgagcttaacaatatttgatagttcgagattttgtgctatgcttgttaggtctctccataagaggaaaccaattggagatgcaaaattccaagtcccagtgtttgttgtcatgggggagaaagattatgtctacaagttccctggcgtcgagtctgctatcaaagacggcactatggagaggcatgcaccagacatgaagatcacctatatccctgaagggagccattttgtgcaggagcaattccctgactatgtgaatgagctccttcttgcattcttgaaagatcatcccgtggataaatagatgttattgtagactcaattgtgcttcacccgtagtacaagttggcgatggaaacattgtgctatatcatgatatgaattgtcaacaaataaaggatatattatggatggtttgttactttcagtaatgcatgtttgagcttgtgttgcgtttagtttctcctgctaatgttgtcagcaatgcaaaggccaaaatgttattatattttaacctagtattgcacttaaaccatcattttagcaagccaatgatgtgaannnnnnnnnnnnnnnnnnnnnnnnnnnnnnnnnnnnnnnnnnnnnnnnnnnnnnnnnnnnnnnnnnn

SEQ ID NO: 44304 - DNA, 977 bp, Oryza sativa
ggagaggcatgcaccagacatgaagatcacctatatccctgaagggagccattttgtgcaggagcaattccctgactatgtgaatgagctccttcttgcattcttgaaagatcatcccgtggataaatagatgttattgtagactcaattgtgcttcacccgtagtacaagttggcgatggaaacattgtgctatatcatgatatgaattgtcaacaaataaaggatatattatggatggtttgttactttcagtaatgcatgtttgagcttgtgttgcgtttagtttctcctgctaatgttgtcagcaatgcaaaggccaaaatgttattatattttaacctagtattgcacttataccatcattttagcaagccaatgatgtgaacttataccatgatgttagcaagtcaatgatgtaaaagatggagtacggagttatttcttatatgtgtttgtgatgagcccatttgtggccgtgatgaccaagacctctggtcgttgctaggatcggccgagtgtgaagtttaggacgatttttttgtgaagtcgtcaaggatcaatgatggattccctctttatcaccgaatccgtcagggaagtctaaatctagtgttggtagggaagtgataactcgaatttgcttttttttttgtgtcgtattaaaaaggggaaaatttggtaaggtataaacttattgtagtattgcaaaacataacctagtttcttggttagacttatccttcagagcctagcaacttaggttaatgagacaatccattatatgccactgagtttgtcatagctctacgatttaccactgtctttgtcacgttctataatataccatcgacttttacttaacttctatgatttaccatcgccgtccagttagtctccgttagtactgtacaattttgtccaaatgaccaaaatacccctgggataaaacttccaaaatgtggacaaaaattccga

SEQ ID NO: 44305 - DNA, 2667 bp, Oryza sativa
tcggtaccctacccctgggattaaacttccaaaatgtggacaaaaattccgaaataccgtattataaacataagattgtaaacattcaaaatttgtccaaaaacttaaagtctgacatttcagaatttttatccaaaatttgaaagtttttgtctcaggggtattttggtcatttggatgaaagtgtacagtactaacggagactaaccggatggcggtggtaaatcgtagaagttaagcaaaaatcgatggcatattatagaacgtgacaaagtcagtggcaaattgtagacctatgacaaactcagtggcatacaatggattatctctaggttaattataccactacatgggtctgccttcaccagaagatatgctccctacctagctaccctcgatacgatgtcatgcattgaggacctcattttttttttcatgttttagagcatatttcttccacgtgagcaaaatgttcttttctcagggctaggcggctagcaaagttgatggatggaaccttgacgacaatagcatttcttagacaaataagcgtatacgatggcatctcctggaactggtatcaggcacttatcaatggtcagagataattgaggtgtgcttcatgccttttagtggaaatccgcgtagtaataatatcctattatgtgtattaatatacctatctttgtgtgtatatatatatatatggggaaaatatattatatgtattcatatgactttaaattgtatttgtttttgtttttctccagagttgaaaaccatccaagctctgttttcgtccctagtagttgcatgtttgtgaattatcaataaatgatctgctgtggctggtgtttactttcagaagggctagtcatgtttgtttgaacttgttatatctcgtttgtgctgctagttgctgtcaacaacggaaagggcaaattaattgcattggtagttcaattgtagaattggtaagacaacctgcatctctgatcgaggtgagttgtgcattgaagactttaagccataccaagggcattaatataattgtttctgccaatataaaatgcgtagggcttgaagtaaagcagtttaacaaaaggttcaagaaagacagggcaaaatgatcatactggaatttagaacagcaagcacctgcccaacaatctcaggaagacgatttagtcatagagaacagaccagcaattctctgttgcccaatgcataaaatccacaccttccgttctgaagaaatgctcacagcctgtgctgaaaaatggggcattatctcatatattaagccgacattcaggcagatcttacagtcgtagatacagacgccagtgctctgagaataaaccgaacccaagaaaaattacatcatcccaagtcgcggctagcaaatacacccatctaagaatttgtggtatgcatctggaggaataaacatgctcatggtagtacagaagtattgctggcaattagggcatacaaacgatacaggttttaactggtgatcgccgatacaaattgtagtaatcgcatgcctgattcttcttcaggtaaggcttcatggttggaggagtgcagcaatcagttcggtggtacacagaatcacgaggtcgcagctcgagtccatcccagttcactacccaactgtgtttctttctctatatattccattgccagcatgcgcagaagaattagacctgtgaccagactgaggagttgaaagaaaactttagtctggggatatccaagaagacaattataatccaagcacataggaaactaaaaaagatacccgtgaatcagtagacgagcagtaacatatgttatttacttgttttgttacagaaacacaaaattactggtaagaaaaagaaaaattatgcttccaaaggtggtgttttgatccgcatagacattttatcgatcttctattgctctacagttggaatcaggagaggatagaatagggttgcttagcagaattaaatagtctgaccgctattgtggcaaaaaaatgcacattcacaagagttggttggagcagaaagtcagcttgcaactcagtaatcaatgttagcattgacacacttcaacatagaattgccacattccccaaatacttcagtcaaggtgatacagtcaatcaaggagtaaaacaacaccaattcttcaaccaaaacataaatcaagctgaaggcaacaagtatattctttcaatcttaaggccatgacagcatcaacatgattataatttatatgtcatagataactgggcatatgtgcacagcagattaatacagcatgaacagattctgcatagtttacatacagaactcatatttttagactacccatgcacctagtagatttaagctaaggtttacttaatgatacccaacaaaataaatgataatgctgcttgtctcaaaccaaattaattgcaactcaaatattaagaactcttcgcaatatttattacatgatactcaaatattaagatcttatagctgaccaatagaatagacactgaaaagcatttcaatatgagacatcataaagcatggaaatacgggaacaccatagcaaagttctttatcagaagagtataatgataacagattgcaataccttatcaaaagtaaaagtgagaca

SEQ ID NO: 44306 - DNA, 2288 bp, Oryza sativa
  unsure (1)..(2288): unsure at all n locations
nnnnnnnnnnnnnnnnnnnnnnnnnnnnnnnnnnnnnnnnnnnnnnnnnnnnnnnnnnttggttggaaaaagtcagcttgcaactcagtaatcaatgttagcattgacacacttcaacatagaattgccacattccccaaatacttcagtcaaggtgatacagtcaatcaaggagtaaaacaacaccaattcttcaaccaaaacataaatcaagctgaaggcaacaagtatattctttcaatcttaaggccatgacagcatcaacatgattataatttatatgtcatagataactgggcatatgtgcacagcagattaatacagcatgaacagattctgcatagtttacatacagaactcatatttttagactacccatgcacctagtagatttaagctaaggtttacttaatgataaccaacaaaataaatgataatgctgcttgtctcaaacaaattaattgcaactcaaatattaagaactcttcgcaatatttattacatgatactcaaatattaagatcttatagctgaccaatagaatagacactgaaaagcatttcaatatgagacatcataaagcatggaaatacgggaacacaatagcaaagttctttatcagaagagtataatgataacagattgcaataccttatcaaaagttaaaagtgagacaaactagggatctgcagcatttggattttcttcctggccaagagccaacacagctttcttcagaagggcctcaattgacagatgtgagttctcaacagcctttgttattgcttgccatctctctccatgctttggttctgctgcaacacatctttgtaggacatccttttgtgtatcagcatttccatgttgcagttcaaatttgtagtacaaggcccaaaaatctccaatgtctggagcaagagtaacagctctattcaaccaacttctagctttatcaaccttcctatcatgccagaaaagtttggccacagctgcaatgacatggggatcatggtcacatcgttttatagcatctgagctctttgctttacgctggggacgtggcaccatctctatagctgcagcccacaaaataccacttgtcgggcattcctgtaatgccttggctagtagagcatcagcttccttcttgttcccatgtctcaattcagccctaactgctgcaagccagagttcaggtgtagctgggttcttctttcttgccatggtgaggacagcacgtgacttgctcaagccatttatcttctcctctagattagctagagagagccaaagagggatgcaactcgggcagtgcttcagtgcattctcgtaaacctcctttgccttggatccatggccaagccggtcttccatttgtccaagcattaaccacagcttgaagaatgaggggaataacttcagaccttcctccaacagcttcctttcttcgtctacattccctaactccctttcaacaatcgcagatttcatccagaccctctcagtgcctcctctttccctggcctttgacaaaagaattcttgctctctctggttcattgttctcaaactcaagcttgaaggcagctagccagatctcctctgaattggggagagaagcataagcttcctgaagaatggctcgggcagccgggacatctccagccagccatttctcctttgcactcataagccataaaacttctgcacgtggattgtaggtaacagcctttctgaggagattataaagagactccttggttccatggctcttctcaagctgagccgctttcagccaaatactcttcttggaaacgaagacactgagtgcatgcgcatagatggcacgggctgtctcaattgaaccacgcttcttgcattcctcagcatcggcaacccatgtgcgttttctgtcttcctcatcaacaccaatgccaatagtgctcttaacaatagcctggcaagtcaatacagatccagcacgctcagcagcttctgcttcctttagccatgcctccctgtcaatatccaatccttctctctgtaaagtttttatacttctctcaatcaccttgattactgactgggtgtttccattagcttcctccagctttgcagctgtaatccagatggcaggttccttaggaagcttttctcttgcttgttaagtaccttctttgcttggtcatatgtctccagccttgctagggcaagccacagttccacatggagtgggcagcactccacagccctgtgaagcaacagtcttgcatcctcctcatttgcaag

SEQ ID NO: 44307 - DNA, 3414 bp, Oryza sativa
  unsure (1)..(3414): unsure at all n locations
nnnnnnnnnnnnnnnnnnnnnnnnnnnnnnnnnnnnnnnnnnnnnnnnnnnnnnnnnnnnnnnnnacagttccacatggagtgggcagcactccacagccctgtgaagcaacagtcttgcatcctcctcatttgcaagctctactactgctttccacagtctgactgaatcaggaatgtgttccaacccttttctcaaaaccctgctcttattcaaatcactagtttccaactttgctgcctgcaaccacagcttcacagaattgggaattgccttcacgcccctagcaatcactgcctttgcctcgtctgggctggccagccggcatgcctcgacccaaacatcctcatttgtggggcactcctcacagccacgctggataagctgccgagcaacctgaagcttgccagcaacctcttcaagcctagcagcagcaatccatcctggtggatgcttcgggtttgtctgtgtcactgacttaagcaacaatcgcgcctttttaatgtcagaaatctcagcatcactagtaatcttcatacttttcaggtccgtcaagtaaccctttggatcaacaacagtaagaccagataccgaatccgacaacctgtccagcttcaaggagagcacggtgccacgaccttcgcccacagccgtcagatcggtaaccggagtctgcgcccatggcgtctcggtgccaccagctgcacggctcttgggatccagtgccgtgacatgctcctgctcctgccgagccttctcgagcagggtgtccggcacgggaacgaagctctcaaatcgcttcttcttgttgcgcagcgagtagtccccaatttcaggtatgctttcccactcctgcgccgacaaatcgaccaacttacgcttcaaatcagcgaattgctcggtgatcttagggttggaagcacggtacttctcgatctcctgcttcagccgcgcctcccgccgatccttccggcgagagtccatcctctggtcgatgctctcccagaccgcatccgcctcgcggtcgtcgtcgtcgtagtcggcgttggagaacagcccggcgtcgttgccctcgaactcgtcgaacttctggttctcgtcgtaccccttctcctcgtcgccgccatcgtcgtcgccgtcgtcgtccccgggtggcttcccacggccgcgcccgacggcgggggcggcggcggcggcggcggaccggtcaggcagatcgggcgccgcgcgggccggcccgatatccgaacgggtggtgaacccggtggcgccacgccccagaccggccacgtagttcgggggcggcttggagttgaggaagtcgtagcgcgcggggcgggcgggcggctgcgccgacggcggcggcgggggcgggggtgccgcgggggtcgtcgtcgggccggtcatccctccgagcagggggaggtggagtagcagggaggaggaggccgagacccggagggaggacagcagcggggacggctcggccgggaggaggcggcggtgggcgaggtagagccgcagctgctccggcgggacgccgccgcagacgcgggaggcggaggccgtgaggtcggcgagcgtggcggtggaggggtcgaggtcgacgtggtgggtcctcccgtccggcgcgcggacgaacaccatcgcggcggcggcggcggagtagattggtttgggtttttgaggtcgtgaggaagaatacggaatcgtggaattggtttaactattttgtgacggtttgggacctttgggtgaattgagtcggtggcgaggagaggcggtgggctacgtgggccgttccatggtgggctgatcacctgcatatgggccgtacaagggctcatgggcctgtttggctcgtgtttgggcccatcgcctgaccttcccttcttttgggttgggtttctttggatttatttttaagatgggcttgttgttttatcgacttatttgttgcgaataaaatcttaccgtgccgtatcatcaatttcataggtcatgactctgctgcatctattggaaaaaaaacatatttatattgtataaacaaagaaaacatgcgtagttaggatgggctatcgacgatcacgacaacaatgataataacctaaatagagagctagagattcttataaagattcttataagacgcttgtgattagtcggctgatgataatctgaaagggttaagtttcaagtttctagctccaagttcataatctcaatttttatgtacatatatgtgctagcacactacaatttctatatgtacataaaaatcgagacaatgatgtaatgaaagttgtggcctagagagatatcatttaaagtaaaatgatggaataatacaatttaattaaagattcgatacataaacaattgatgaaatttgtaaccgagggagataaattttaactgaaattgtcaaactataaatctgacgaaagattcattcaaattcccaaaaaggcatacattcactcattttatctgccttggtgccaaatttaacgaaatttatgtacccagtttcaaataaatagacgactatccccattttcttacaagttacaatccaccgcaagaccacaacaccaagattacccgcctccatgccaatttcaatgaaattcgtgtatccaattttaaatagacagacaacactctttatttcgttacaagttagtacatctaggtactatacaagagtaatattggagtgtgtaaaaaactgccgtagattttttaagtgtaaaacttcgagattaaattatattataattgaagtatagttgtactgtaactgtattgtaactacggtataacttatataaaacatgtatttaaccgtggtttggctgactagcaccgagatcttgcacataacatgtatgatatttttgtagcaatgttatctcttgaatgtacaaatctccagtaacccgatgaccataaatctgaaagttttgagagaaaaagggtgtgtttagttcacgctaaaattagaagtttggttgaaattgaaacgatgtgacagaaaagttagaagtttgtatgtgtaggaaagttttgatgcgatggaaagttaaaaatttttttaaaaaagtttggaactaaactccacggaacttgcaaaagttttctagcaatttcgatccaaaattcaacggaattcgtacatacccagagctcaccactcccgaaacgccaccaaaagaccaaacccactcgtttcccctccccccctccctctgactctctccccgtcgtcgtcatcgtcatcgtcgttcgtcgtcgtcgtctcccctttccacggccgcatcccattccccacccaacctgaaagcgacgccgccgcagcgcacacgcaggaggcagcagcaaagcgaggaggggaggaaacccttcccc

SEQ ID NO: 44308 - DNA, 2701 bp, Oryza sativa
  unsure (1)..(2701): unsure at all n locations
aggaggaggtggaggtggaggtgggcagcaggcgtcgccggcgaccgtgttccggatccggctcaagcagccgccctcgagcctccgccacaagatgcgcgtgcccgagctctgcaggaacttcaggtgcgtttcgagattagttgtggtttttttgggggtgttttttctttctgggatttaaatatgttgggggaagcttaggtgtgatgaatttaaaccctgatctgtttcagcttattcatcgatttattgaaatggtttttttccccccgaaagaaattttcctctactgtattgcttagaccacttgttttaagctatttgttaagtttgtctctcaaaatatctaatttatccctataatatatccatgacaataatccactcaataatctaaatcaaacgatctgggtttactttttttttcctcttcaaatttgggtggcgtttcaatgattgggatgaacaatctagtgactcaaacttgcagaagcattagcgtgggcatggaattgtgattgctttgaatgattgtatcctgtgcaggcttctactatactagatcaaatacagttataacatgtagtgtcattatttcacataactaagtttagtcaggtcaaactggttactttgttcaccagttagaaaataccgaacgtgataactccatttttaaaatccacattatttttttttgtttaaaactgctttgatcttgtaggatgaggttgccttgtctgctttagcctacactatatcgggaacaactagtaactatcttatctatggttttttttttattgcagtgcagttgcttggtgcgggaagctcaatgcaattgcatgcgcatcagagacttgtgcacgcataccaaggtatacatttttccatcctttccctgaaaatttactttcctctgacctttagttatccataaataagtttgttctgttagcttgtcttagtgggatattcaaccatttggtagaattgtttgcttacagtttctggttatgaaggtttctttgccgtaaaacgatctaatgtatattttcagctctaattcaagcccaccattttggattcccatacacattctaaatccagagagaccaacagaatgttctgttttcaatgtgaaagcaggtaatccatggctaaatctcaattgttttggtaatgtgattacgttatgcatgtgcaaatcactgtccattgggcattttatagtcaggtgaagggtgagattcaaactcacttttgtttatatacgagtttttctacctccaatcctaactcactgtaattttgaacagattctccacgcgactttgttcaattcattgaatggtctcctcgatcatgccctcgtgcattactggtggcaaattttcatggaaggattactatatggacacagccaactaaggtacatctctaccttaagcaaatttcggtatgcatatcatttttttttgttagtagtaccattgaacttactttgttaatttgcgaaacactcaggattttcttttttcatttcaagtctatatacatatcatgctgttttgtgttttttctctaatacttgtttctttcttgatatggtgaagggtcctactaatcttgtacgtgatgccagttcctggcaatgtgaacacgaatggcgtcaagatctttcggtggtgactaagtggttgtcaggaatttctccggtttgttgccaatttgcaaacttacagtctgcttctcttgtttttgataattagcactttacacttggaatgcaaatatgcaatacgattgacccagcagtttatacagtccgcttcacaatttaacattcgagatttatatacttttcagtgtcaattgttaatcattatttttttaaaatataatattttataaagcagtgacaatagacttgagtttaaactgttctaagattttttcactggacatttatcataaacaattgcaacaattaggtaaaaaagattctggctcagtttatgtctgagtaagtactttgatctatttcaaatgacactacctgtgtttgattacccttttggcctgaaataagtggatcttagaatcgaaggaatataattactaagctgttgccacggctaaatttgttttgtttctttgactttgcagtatagatggcttcctgcaaactctagtacttcatcaaacttgaaaacctttgaggaaaagttccttacccagcagcctcaaagttcgggttggttaaacacatatattactgagcatatattttttttggaggagaaagcaagcatgcttctttacgctactctgacatattgctgtttactgcagctgggtggccaaacattctatgtgtctgttcagttttttcatcgggttctgttcagcttcattggtcacaatggccttctcaaaactcagcacaacctagatggttttctactagcaaagggcttttaggagcagggccaagcggcataatggctgctgatgctattattactgaaactggagcattacatgttgctggtgttccccttgttaatccatctactgtagtggtttgggaggtgatgccaggccttggcaatggtattcaggcaactgcaaagataaatgcaacaannnnnnnnnnnnnnnnnnnnnnnnnnnnnnnnnnnnnnnnnnnnnnnnn

SEQ ID NO: 44309 - DNA, 3311 bp, Oryza sativa
ttccccttgttaatccatctactgtagtggtttgggaggtgatgccaggccttggcaatggtattcaggcaactgcaaagataaatgcaacaagctctcttcctccatcactaaatcccccactctgggctggttttgctccacttgcatcttacctcttctctttgcaagactaccttgtttccgagggcgcacagacaaaaaaacaggcacaggtagataatgagaccactgaggtagcatcgatccattgttgtccagtttccaacttttcagcttacgtcagtcctgaagctgctgcccagtcagccactaccacaacatggggatctggggttacctcagttgcttttgatcccactcgagggggatcagttattacagttgtaatagttgaaggtgcgtatatgacacctgggaaatgaattagtatgatgcaattgtcacatctcactatgactatttgtttctgatgaatggcatgaacatcaatgccattcataatcaccacactaatcctatgatcatccaacagctttaatagtaggagagttaatctaactatgtatgtccagagcatgcttatacatgttttagctccctttagttgcttttgttgtttctttgatttgctctggtagcttgtgccatggtaataaaagttcttgtctgtaaatgctatatgcatattcttttaaggacttttggggtctctgaaatttattaagtgaatcggttgatcttaggctcttggctaatgcttatttattttttctgacaattgttaaaccacatacttccagggcagtacatgtctccttatgatcctgatgaaggaccttccatcactggatggagagtccagtgctgggaatcttcagtccaacctgttgttcttcatccaatatttggaagccctgcaaactttggtggacagccacctacacagactgtttggtccacaagagttaacaaaagcatcccaccatctgaggaccttaagaaccctcaatcatatgttccaatgccaacaacttcagatgagcggagttcttctgagtgcagtgttgacagggcgaaccgacttagctttgacccttatgatcttccaaatgatgtcagacaattggcccaaatagtttattctgctcatggtggtgaggttgcagttgcattcctgcgtggaggtgtgcacattttttcaggtccaaactttgaacaggttgatagctatcatgtcaatgttggctcagcaattgctccaccagccttctcctccagtggttgttgcttggcatcagtatggcatgacacactcaaagatcgaaccatactaaagataatacgtgtgcttcctcctgcaattcttaatgctcagacaaaggttagctcagctgtttgggaacgagcaatagcagataggtatccacccaagttaacagaggttgattgaaatgatttatttgttgaaaatgtttttttttataactgcgatctttttagcagattttggtggagtctattggctggtgtggattggtgggatgctgttggctgcacacaaagtgctgctgaagatggtattggtaaggatgcttatgcagatgcaatttaaaatttgtgtatagtatttgcatttcaattgtgttctagctgtccacacaattagaaaagtagggattatctgctacacggtagaatttccacaactgtcactcaacctcttaaagtatatacttcctccgtttcataatgtaagtcattctagctttttccacattcatattgatgttaatgaatctagatagatatatatgtctagattcattaacatcaatatgaatgtggaaaatgttagaatgacttacattgtgaaacggagggagtaattaagaacagtgtaaccaagcaaatctctgtttggttgtttataatgttaagactttagagctgattgcacatttatgctcccaatttgaaagcattgtgcatctgcagtatgatgaattgtgttttgcttcatttttcccatttggatgtctcaatatgttaacattatttcctggtgtgagttgcaatacatctttttaagctgatacagaacttttcagtaagtttcatcattttctacatatggttggttaactatttcagcacctgtaacatttatatttgtccatgataaactaaatctcttgcttttccttccagtctcactgaacagtgtgatagctttgctggacgcggacttccattgtcttccaactatacaacagaggcaacaacactgtcctgtaagtgtgctgtgcttttagtacattatgtgcagttttaagcacaggccttcaatttttcatcatctactgcctactgccattactatgtgacatgcatgtcacaatatctttttgggttcttaaagattgtacattcaccaatcaccagtctttattccaccagtagttgaaagggggatacgaatcaaaatataatcaagatgacttttttccttttctttcctggacatagttttttagtattcttgtgacaagtcactagcactgctttgcagttctgaatgaacattttagcatgaagcttgccaaacttttctatgaacataaattatatctctggatgtattggtcagagaccatttacggtagtatgtagtttgctactttattcataatgcaatatattgtaatttgtgagttggacaagatttgtttttctaattgtgtgtttaccttttacttcagattttgaggacttgaagttgcaaggctattgctttcttctgttactgattagtctattttacttattgcagaatcttgataggataaagtgtagattgttggaaggaacaaatgctcaagatgtcagagcacttgtgttggacatgcaagcaagattgcttctggatatgcttggcaagggaattgagtctgccctgataaatccatcaactctgctacctgaaccgtggcaagcttccagtgacatgttatctagcattgggcctgacaaaatgactgttgacccagctctacttttaagcatccaggtatactgtgtttcatgttcttttgatttcctggtccacagtttcagttcaatttgctaatctcgttttcctttttttggctatagacttaatatgggcaaatgatgttgcaaacctttttgaatgataagctatttgtaaaccacaacctattcatgcatgaggatgaggcatgatatgccacagattaaccatgccatgtatggaatttacagtatttacagcagtattttgctgtttt

SEQ ID NO: 44310 - DNA, 9863 bp, Oryza sativa
  unsure (1)..(9863): unsure at all n locations
agacttaatatgggcaaatgatgttgcaaacctttttgaatgataagctatttgtaaaccacaacctattcatgcatgaggatgaggcatgatatgccacagattaaccatgccatgtatggaatttacagtatttacagcagtattttgctgtttttatgttccaaaccgactacgattcaaacagcctccagatagctttcatcataagctttgctcctaggtgtgcaggaattatgctcagcccatcaactgcctccaatgccttagcaatttgtgcacacatttcagcataagcggtctgcatatgaactttcatgttactattttgtggatttaatttttttttgaacatggactgcaggggtacgttgatgctgttctagatttagcgtcacattttatcacacgcttgcgacgctatgcgagcttctgccgaactttggctagccatgcagttggagcatcttctggttcaggcaattctaggaatatggttacaagtccaaccaacagttctccttcaccttcaactaaccaaggttaattttgattccgtctatcttgctaaagcttgtgcttttttttttggtgctaaataaaaccacctatgaattatttgtttctttatttaattttttggaaaatgacaagttgctggcacatttcaaacttagcaatgatgctaatgtttcaggtaatcaaggtggagtagcgtctacaacagggagctcacaaatgcaagagtgggtccaaggtgccattgctaagattagtaacaatactgatggtgctgcaaatgctgcaccaaatccaattagcgggaggtcatcattcatgcctattagcataaatacgggaacattccctggcacaccagctgttagacttattggggactgccatttccttcatagattatgtcagctgttgctattttgtttgctttttcggagaaggcaatctccaaggatacctgcaaatgcacaaaaaagttctgattctagcatgcagaaacaacacttgatgaacagtaagacagaggataatactttggcagtcagatctggtctaggtgctgccaaattggaagatggcacaacttcacgtggacagatggttggagcaaagggtgctgaagaaaatccagtgggcaacaaatctgctaggataggttctggcaatgctggccaaggttatacttcagacgaggtaacaaacaaataacccataaatatggattttctcagcctgaattgttcaataagaaaacttttttcaatctgaaaatagtgatagttatacatataacagtatttttgtatgtgcgcttcgacatcaatatctagcctgtattgtttctgaatcaacatttagattagagctgttatatagtgtggttatatgtctgcatatcatatatcatgtgtgtgtctaaattgtttgcaagtgccatatgattaagggtaattagacatgattggataatttacctagtataatctttgatcggtgatttgcccgacatgtttctcccgattttattagttgcctttctgaaagtattatttgtgtagcactgtaatacatctagtttctgaattatttgtttcatgcttgcaggtgaaagtcctttttctcatattagttgacctatgtaaacggactgcaaccttgcaacatccgttgccttcttctcaggttggttcgagcaatattattataaggctgcattacatcgatggcaattacactgtgctccctgaggtagtggaagcatctcttggccctcatatgcaggtacaatacagatttattgtggaagtttatttctgtattctctgtgtactcattagagcattcaatgttctcttctcagcaatacattatagtaattctcaattgtgttggagaaatagagatatagtattttgcaagttctactctacttacctgggttaacgatggattgatccagcaaaagaatattgttgtccaagttaattatggaaattttcatttatacaagcacacgtgcataattggtttttatgatttcttttgttcatacgttctccatctgcctatataatttattactcatggcctcagcgccctcttgtcaccatttaggagttctcattttcatcagcatgtacatctttggtaagagtagtgagcatgtacatgtccaacaagagctgtgtacacgcatttctgtcgagaatttataccaatgttgcccatttgttccaatatttattgcagaatatgcctcgtccacgtggagctgatgctgctggccttctacttcgagaattagaactgcagccccctgctgaagaatggcatagacgcaacatgtttggtgggccatggtcagaaccagatgatcttggtccattggataatacgcgacagctaaaaatcaatggctctaccaatcgccacttatcggacatggaagaggatggcgacagctcctttgggattcaaaatctttggccaagaaagcgccggttgtctgaaagagatgcagcatttggtctgaaaacatccgtggggctgggatcttttctaggtgtgatgggttctcggagagatgttattacagctgtgtggaaaacaggcctcgaaggtgaatggtacaaggtaagcatacttgatagtagtagtctctaacttcagtattctttcagaattaattatcgacgcactctatccaattcaccatttgccgtgacaccgagacatgctatcttttgcagtgcatacgatgtttgaggcaaacctgtgcatttgctcagcctggtgctctagctccgaacacgtcgaatgagcttgaggcatggtggatcagccgatggacccatgcttgcccaatgtgcggtgggacatgggtgaaagtcgtttgaatttgacgcctccgggcgacaccttcaccgtactaaccactctgccaatagctttctcggccaaatctgtgtaggcgccatcggtttttggacaattttgtatctaactttagattgtttggtctcaggccctccctggtatggtatcatagtttacctgcagcagtcagagcagattgcaccagcagctgtgtaaaacggtaggaaaaaacaggattaggacatgcccaaacactgtcagagtcagcagttgtgttgtgcgatccttttgtacataaatgtagtgtactaatttgcaacattggaaaagaaactccgttagatactgcttgatgtcaataatatttgctggtgattgaaaagaccatgtatgtaatagcatgttcaattgggtgtttctctcataagctatgctatgttcaacttgtggctttagatcatcgttcaacgtggtcgacaaaataaagacgaaatttgaatttctgttcgaatcttttcgaagggtagaaagtattcaaactgcgcttggttctgatatttacagagctacctgtaatactgtcatcctagaacacttgcaaaaatttacaagtgcttaaaaatattatcgagtgtacagaatttgcttaaacttaacaaaatatattctcgaaatatacacactacaaaatttgctaaaaattgggaagtatcagcggtgtggtggtctaatatttaaatcttatacccacgaatattatgtacgcgtaatttggttttcaatataaatatcgtgaaaataggatttgccgctagtttctaattgtgttagagaagcatttgcgagtgtgcaagtgtggtgttgtatgcgtagtgctgtgcgttcgtgcatatggttcagtcgtgtaataaagaaatgctaagggtgtgttggatgctagtgacctagaacttgtccctttcacgcaaaacagagcaacaaattagcgcatagctaataaatatattagtaaataatttaaagaaataaattgatatgattatttaaatcaactttcctactttttaataaaagacagactatttagtacttgtcgacgtttgatgtcgcgattccggtatttgcatagtatggagatcgttggtactaggatatacgcgagaccgaggtaaaagagacgaagacagagatttttatacaggttcgggcccctgaattgtcaggtaataaccctacatcctgttggccgaagcggtcgttgctcttattcaccataatcacaccagtataatatttggagtagcatatctaattgttgtcgacatggcggtctgaagatctgactcatagtcgacgacagggtagtcttcctcctcgaatccatgcccggcgagatcagaaacagcgctagatccctacggccggcctctgtaggtatcggatagggtcgatccagaggacgccgaggtcgtcggtaaggacgtgggaggagccgaggaatagagagagagggatagagagaagggaggaaggagggaggattatgacgtggcgaccctgacatgtggggtccacgtgggttccacgctgattcaaccgccacataggataaaaccggagttaaaaccgtcgagggacctaatttgcactggttttgtaaattgggggatgcattgtatccggttttgcggttcaaggatgattttgtaattcgacgacaagttgagggaccttcggtgtaccttttcctttgtttttagccataacccagttcaatacctccccacgctcggcctatatctctttggcccaacacacaaacaggcccaagccacaagcataagtggagtcataggcccaacttacatagcctactgcgatcttcaaccttcggaagatatcctatgcatgcatgatgccggagccggtcctcgtcatcaaatccaaccaatctttcttgatttggttgagggcttttgatccactcgatctcttctccccgtttccccaatatcagagagaattcacaaaaaaacgggacaaaaaggcaaagctcggtcagccatcttcgatggagattaaatccaacaaattaaaaccaaattgaaagagaaaattatggagaaaataatgagttagaagtagggaatcgatttttgcaataaataataggaggaaacgtacagggaggcagatcgcggcggtgctagggtttggcccgggccctaagagcggtaaaaaaaggagattggatcggactgagtggaaaaatacggtgataaaaaaaccagatgatgaaaaaaaaagaagcctaatcggacataaaaaactggcgagaaaaatagacggacaaaaaaaacatattcaattaaaaccgattcctcaattaaaactgaaaaccgatttaaacacggatgacttactaaaatctcagcaaaaatatcttcaatttttacaatagtagagatttagacaaagaacaataatatcatattgcatgaaaataataattcatgaccgtcaaaaattatatataatcacttcaatatacaatatctcaatataatatacaagatatgagggcaatatatgtctgcaaaaaaaacaatgatccaaagttatttgattaacttgttgggggtataaaggcgggaaacgtgcgtgtggaaaatgagggagagagaagttgggaataagtagtataggacgccctaataatgttacctcgccaagcttttttttttccccattttgtttaaaaaacaacaaactagtctcgaatacatgtcatagatacatatgaacccacatgcagtggcgaacccagaacaaaaattaccggggatgcttgatatgtttataggtttatttttgagtaatataatgcttaatatgacctaaaacacgtccgtggacaccgggtagatacacataggtacgcccctgcccacatgttatagacaacgattgataaatcattagttaacttatcttaaaagtgacaaacaattaaatgtcccaaatacatatacaaaaattgctcaaacttaaccggcaaactgaactacaactagtctcgattaaatgtcccaaatacatatacaaaaattgctcaaacttaaccggcaaactgaactacaactagtctcgactcgactgcccgcgagagcgagccccccagatctccctcgttctccggcgatggcgtcgccctacaccggcgcgcagccgccgtatccggcgggggcgcaccagccgccgccgccggcgcaggcgctgctgcagcagaaccactcgctggcgttccgcgtgatgcggctgtcccgcccctcgctgcagcccgaccaggccgccgcgctccgcttcgacccgcgcgacgtcttcctccccgaggacgccctcacggggcccgacccctccgcctcctccgccgccgacgccgccgccttcctccagggcctcctccacccgctcgactcgccggccaccaccgtccccggcgacttcaccttccgcgaccgcttcctcctccgcgaccccgtcgacgccctcgcgctccccggcctcctcgtcctcccgcaatccttcgggttcgtctctctctctctctcgcttccattccagtagtagattgcagcgaatgattgtgttgatgtgatcgtgcggggacgcatcgatagggcgatctatttgggggagaccttctgcagctacatcagcatcaacaatagctccagcttcgaggccagggacgtcgccattaaggttctcgaaccatcgcatgattaccatcctcttctattatatcgcattagttggaaaacattatttgaaattctggatcgtttaccataaaatattattctggatgttttctggagaacggtattattgcacccagtttgtcattgatgctgttgtttcagtgcatctggttagagtgtgctaggttgatgtttttctcttcttctttttttcagtgttagaatctcacatcaccaagttcttattgttgcagtcatgaactgatgttaaattcgattactcgattgactctctgctgtggaattactggaatagttgcttgttcatctttttttacatttgttgaccaatgtggtgtgttcagtgattagaccaattctattagagcctcattaagaaaaaaatgtaacaaggtgttattaaggcatgcaagaaattatgaggtattataagctaataagtagctttgatgcaaataattataattgaccttgactttatctgtagttcttattggctagttctgtcgatgggttgcatgttgctctatgacaaatttgatactttagacacccctttggtggcatgcatgcaggacttagctgtccttgaagccttcatttcttcatattatgtcataagttttaaccggaagtttatttacattaggcagaaatacaaaccgagagacagaggatacttcttttggatacatctaaggcccctgttgagtcaatcagatctgggggtagatatgatttcattgtggaacatgatgtcaaagaactgggagcacatacgtacactatcctcttttttattttatttacaaattggttgcattagacattagtgaagcacaccttattgttgatttgctcatgtggtgattgaatccaggcttgtctgcactgctttatataatgatggtgatggggagcgtaaatatcttcctcaattctttaagttcactgtttcaaatccattgtctgttagaacgaaggtacttatttctctcattttttatatggctaatctatactccatatgtataatctctatgtccctctatcttagaatgtaatcccagcatattcggattacagagtaggtcacataaataatctgtgttcaccttttgtttcaggttcgcaccatcaaggtatgtaccctcttgtttcacaaatgcaaacaatattgtaagtcttgtaactaaatgttggtttcttttgtggaaacctttaaaactttacgctgtcacatttgcattttttttagaatatgttctgtcatcgcagcagttaccagttagccatttctttctttacttgccattctatctgtgcagaatcatccttttggttccataagaagtttatcagcgtcttgaattccccaaaaataaaatttggggaacctcattatactttatccttggtttattccaaactggttgaacaaacttctatgtaaatgtggttggccttgtttccttcgatattatagtatatattctactgtactactgtttgttataatgttatttatccctttactgtgcatttatttattcatcatggcagtcttgaactctatatagctagtccactttgacaggataccacttatctggaagcctgcatagagaatcatacaaaatctaatctttatatggaccaagttgattttgaaccttcccaacaatgggcagctacaagattagaagccgatgaacatccgtcaacagtgaagtctataatcgggtaagttgagctctgataacaaaccctatttggagaatggaacatagtgtctcgatgcaaggatgttgatatatcatgtcgatgcaaaaggattgctaatgtgagttctatttttcatatagggacttgtgcaagcaaccgattctcatcagagctggaggaggaatatacaattacctatatcaactcagaccatcgtctggtgagtctggtcaaacaaaggcagagggaagcagcatactcgggaaatttcagatcacatggcggacaaatctcggggagcctggccgtttgcaaactcaaaacatacatagcactgtcagtaaagttcctgacttatggtttgaactattttatatgaagtgtcgagggctatacctgttaagttactctatatataagtgttagctataactttggcaactctttcttttgagcagcccactgcaagcaaagatgttgatcttcgtgctgtgaaagttccacctgtgatatttctggaaagaccatttatggtaggtgattcgttggtgaacatctggctcggatatttagcaagaaatttgttcatgttctttttccacaatattttgatgtttatgcttctgtattgtttaacttgtaagataaaatatgttcctgctttggtatctatctgatatttcccttcaatagtttagctaagggaatctctttattagtatctttggacaaaaatgggtcagtcttgcagacttttttgtcaggtcctatggatcccttgtatagtctctgaatatttcaaaaaagaaaaatgcattaaagcattacactagggttatgccctattgttcccataaaaaacgaggttctggctgttcaaaactgttatgctccaggctctctagaatttcctccccatatcactcacccctttcaatttgttaacatgttatgtgtttaactttccacgaagcatgttgtgcaccaagctttcaaaagttcccttcctatatcattctacccctttcaattcattaccacaggagacatgcagtactgagtaaatttgcaggaatcatggtaatacatctcgcatgctttattagtgtcttttcttcatacagtttcatgacttgttgtcaatcgctatgcactaatgcttttcgttgaaccatgcacttagtgcattactgcattgcaaatattaacaacagctgctcttcacattactatcgatatttgattagatttatatcctcaggttaatttatgccttacaaaccaatcagacaagacagttggcccttttgaagtatttttagcaccaagcgtacttgatgaagagaaatatgttctggtcaatggattacagaagttggttagtggtttccctggctattttatgtttgatgttatacaaatnnnnnnnnnnnnnnnnnnnnnnnnnnnnnnnnnnnn

SEQ ID NO: 44311 - DNA, 890 bp, Oryza sativa; identical to SEQ ID NO: 41391

SEQ ID NO: 44312 - DNA, 921 bp, Oryza sativa
  unsure (1)..(921): unsure at all n locations
gcgcaggttttgccactagttgaggcttttgaatccatcaactttgacttggtaagataactttctgggtacatcactttagatatatcggatatcccatatatctgctcttagctttgtatttgtcgaactgtgttgtggatttttttgccactctaaaagtgtgatgcatttttactactaaaaaggtactccctcgtcccaaaatataagggattttgggacgaggggacatatcctaggatgttcagattcatagtactaggacgcgtcccatccggcccaaaatcatttatattttgggacggagggaatggtattaggatgtgtcacatctttttgcttggttttttatctgaccagtgacgctattgatgaatcataacaacaatactgccttgtgaattttcctcaacgatactgattttcctcattcgtgctattatatgaatgttaaccaacagttgaaacaatttagtcttgtgtttgaccatcaaagccagtggcaaattcattgtcttatgaatcagaaagaaatgtatttgactatatctggaatgaatctgtgcagagtatggtagctactcaagtaggcgtgcaaaaaatttctggaattacactgtatgccgtgcaggaaaagaagctttacgaacctttgtcagacatagaggtaaagataagcaaattcggtactatcaattactctttcttgtagtgttctgcatgtttgtttgctaaagctacattctcgtgatagcattatagttctttaaagttctcatgataaatttgttgaacataagtgctcgagcatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44313 - DNA, 1170 bp, Oryza sativa
gtcggacccatcgtctaccttcggccgccgccgcccgaaaccctagcgcgccgccgccgccgttcctttccaaatccggccgttcctttccttctccggccgaattgtttgaggcgaaacaatctccgggatctcctctaccttttctcctttggaatctttggctaaatcgttttggaagttcgtggaatcgagttcgtttcggatcggtttccctctctccaagccgagctttccttcgccgttgccgccgccatgggccttcgccgccgcctctgagcccctttaaaaggacccccggtgtctcctctacccgtcgccaccttcgccttcgcctctcgtcgtccgaaaagccctagcgccgtgtgccctagctttgccgtcgccgccgtcgctccagccgtgcgccgccgtcgttttagccgtcgccgtcgctcgggaagaccaccgtcgtgctcgccaagtcgtcgccgtcctcgtccgccctttcgccgtcgccggagatcgtcggagcttcgtcgccgtcgtcaagccgaagagcttcgccgcttcctcctcgtcgccgtcgccgtccgttgaccttccgccgtcgttttggtcgccggtgagttcgccgtgccgcccgcttcatcttggtgccctccgtttgcgtcctcgcgccgccgttcgccggcgagcgtgcgccgttcgagccgtctcctccaccgagccgccgccgctgtcggtgacgtcaccgctgacgtcatcggggtcgtccgccgtgagccgccgtggacccgatcgatctcggccgtccattttggattggttcgatctcggccgtccgttcgtgtgaaccgccgcccgtgcgcccggtccaccaaaccctagcccgctgacgcaataaaccctcttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttg

SEQ ID NO: 44314 - DNA, 775 bp, Oryza sativa; identical to SEQ ID NO: 41398

SEQ ID NO: 44315 - DNA, 736 bp, Oryza sativa; identical to SEQ ID NO: 41399

SEQ ID NO: 44316 - DNA, 20426 bp, Oryza sativa
  unsure (1)..(20426): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggccaccaaatgcttaattaggtgcagactagctatgctgctattcatccattggcagatcaaaatgtgttcggtcttcctggagagtaaaatagtccgcgatgctgtccattacgtggtaaactgttcttttattggagttctgtttttaactcgtcctattgaggggcgatgcctgtaattaatctggatcgtaaccctcttgcctggtgaatgctccacaaactctcatgtccctcgcatgagtttgttcaagtgtggaagttgtgactgtgctattattttagcattggcttggcagtacttgttctgtttctagcaagagtttcgcatgtgagcacatgcatagcaatatagtatgttctaaattagttcattacattatcctcaaattcagagctgatatatggtagtatttgcttgtgatgttgaaaatttatccatccttcttgtatcgtcagttttggtattcaggacagcgttgccacacctatgtaagtgcagcgttttgaggcacagcagaacaggctacaaactgaaaatgtttcggttaattcccccaaacaataataaatatcttgattatccccaaagaatgaagggactatgcttttacaactcaaaactctacaaacgttttgccatttaacaaggggcaaagataaattgtaacgaactttgttttgtcatacttctatttgacgcagttagatttaccaaccatatgaaacaaaaaaaagggtatgacagatgtactattacaaagtactggaacaaaaccactggcaaactaatcgcatgatgaaatggatcgaacattcgaaattatcacatatttgctgtctacgaaatagcctattctgccttctgttgtccataacgacactgaaccgattccccttcgatgaacttgtccacggcatctggtgggaggccaatcatctctaatgtcttctcccatactagctgcgacgtctcgaggttatgtgattcttcagatgcattcattggattacagtcatatgagatgcaagcacaaacaggccagtcttcagacttgagcatctcgcagtaatctggaacttggggatcagaagctgcgaacagtgtacttcttgaacctgcattagatcagtaacaagatattgtgcatgtcagaaggtggagagttgtcaattgatagatagcaacgtctgaaaggtcctgtacatcaccttcttgagcatcgaatatgaagtacggaatcaaatgatatgcagctacaacaagcttggggagatcccttgcctgcaccatttatgggcattattagatcaacatacaaataataaactaacagaaggaaatgagaataagtttgccaatatattcagagctatagcaggccaaacgggcggcccggcccagcacgacacggcacgccgacggcacggcccactagggcacggcccgttaggcacggctcctatagcgggccgtgccgtgccggcccacgtgccaaggccacggcccaagcacggcccaagaaggtgctgggccgtgccgggccggcacggctactgtagtggcacgtgggctggtagccggcccactagtacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtcaaataggataaaatgtggaaaaaaataaaaaatatgagaaatatatgggaaaaattagaaaatcgtaggaaaataaatgggccggtgggccgtgccatgcctgggccgtgccgtgccggtacgctacagtaaacgtgccgtgccgtgccagcccacgggctgaggcatcggcccaaacacggcacgggataacgggccgtgccggcacggcccacaggctggcgtgccgtgccgggcctgggccggctacagtactgccgtgctcgggccggcccggcttggcacggtccatttggccaggtttattcagagcacagattaatagaggttcattaggatgctcaagagagattctttgctgagttgaactaaaaatagacatgactaatcctctcggaaaatatgtagccttaggttgtggtatttcttttcaactgtccttgcattaagttactacaaaattctttggcttccattttttccccaatagtgcatgtgtttcttttctctttatggtaacacccgaaaggggttggtctggctagaggcatatgcaaaactaataccacaaacttctggttctttaattcctatgaaatagcatgtttcacagggcaaacattggacagggggaaacggaactcacaacatttgtatgaacaatcccaggagaggcacaaataacattaatttcagcctctgccggaatcctcctgtgaagcatgctgctaaattttatctgcaagtgaaacaagaataaatcagacctacatagcatgaaaaaagtgcatggacagtttagatactgattgttcccttgcaataaagcagaatgaaaacaatacaaagtacaataaggaaattaacgttgcaaagggaacaactgctaattagcaatctaacacctctgtgatacctgtgctaacttgctatttgagtatcccatcaaacttgtaaatttccgttttccagatgtcaagttcatatcttcagcatctacaaaacctactgtgtgcatctgaaattgcagacaagcttgttagatggcagaagtgtatctggaggtatttgtaaattttacacagaaatgattcttaattgtcattaaaataatgaattcagacaagtttttcaaaatattgaggttaggattaataaccaattttatacatgataaggaaaccgtggtcactttccaacaattcctaagtaggcagtcacagcacaggtaagagtagagactcacaactgaattaacgtttacaattctgctaggagaaccacgaagaagggaaggtagaagcaacactgccaataaagccggtgcaagatggttcacttgcatgtgttcttcatacccatcctttgagaaacgctggggttctacagaaaatgaaagagttagttatgtctggtacaatttgaattctttaccgagtaaaatgcaagttggattgatttgatagaccaaaaacaaaagaaacagattatcgtcgaagcatacagacctcctatagagaaaatgccagcgttgttgatcaatacgtgtaggggtgccatacgagcattccaggcatcggcaaattttacaactgaatctagagagagtaggtcaagctccatcaccttaaagagtaatatattaaaaaattgtcaaatgatctgcagctaaaccacataaatgttggagaaacatgtctttgtctttaccaattaagatatgcattcgcaacagatatcttccaattgattagaaaagctagatgtgaaggacacactatagtatttacttgaaagttggaattcgatttgagcatataaggccagaaattcaaatttatgtgtgttaaacaagacaaactagtaaaatgccatgagacaacaattgtgtacagcctgtagatagtgtcttcatgattacctcagcattaaggggctttcctatctctgaattatcattctgccatttctgaatgagctcctgcgccaatttggttctcctaacagccatcacaacatgacctcctgccagtgcaagttgtctgaattgaccacaagggcaaatatacacttatattagttatagggaaagatgtgagatttataagaagtttacacgttttcaaatttgtaatacttttcgacattagaagatgcaacaccaaatctattgaaccgaacataagtctttacaaattttacagatacaattacataagaaccaacgatatgactcagctccgataagaaatgccgttgactaaaaagtgaggtctggcaaattagcctgatagatttcatgtttattgattggaatcctatcaaggcactctccaaatagaggaagccaaatgaagacttttgacagttttacttatgaagtaacaagatgaactgcagtcaaggaccaattcagtaacatgtatgagtacccctagtattttgttccagagcacaagggcaaatatacacttgtattagttccagagatgtgaaatttataagaagattaggcattttcaaatttgtaatacttttctacattagaagatgtaacaccaaatctattgaaccaaacaaaagtctttacaaaattcacatatacaattatataggaaccaataatatgactcagcttcccaataagaaatatcgctgaataaaaagtgatatctggcaaattagcttgatagatttcatgtttcttgattggaaacctatcaaagatgctccccaaattgatgaagccagatgaatatttttgacagttttacttgtgaagtaacaagatgaagtgcagtcaaggaccaattcattactgtaacatgtatgagagtacccctattattttgtttcgaaaaatttcgagatatttaaccatttgccacatttagatgtggcaattaactttttgccaggacccacatgtcattgatataggggtggcaaatagttacttgccaaatctaaaagtggcaaatagttaaaagccccaaaaatttcaggttagcacatataaatctattttcaccatagtattgccatcccaaaacgattcatcaaatagtaaaaataagaacttcactaactctaccgtatctgcctactacaaaccaaccagcgaggcttggataaactgacatgacatttaaagtcaggagaagaaaagaagagctaaacctcgtaccagtgggtgcccacattacacacactatattgtcgagaacactacgaattatttggaattcagaaaccaaaaaggctatcgataaatcttgagttgatggcatccatccagagaatcttcgcatgcccgaattgaaccacccatcatctctaagggcaaggcaagagcagcagtagaagtagaagaagtagaagggataagagattggacctggcgatctcgaggccgatgccgctggtggcgccggtgacgacgaaggagacgccgtcgagcgggggaagctcgagcgggttggagaggttgctggcggcgatgcgctggaagaggaactcccccacgattcccatccacccccgcccccactccagccaccccagcgcctccttcctcccctgccccttccccttcacctccgcctcctctccccctgaccccatcttgccgtccccctccccgtcagccgccgccaccgcccggcgctggcgcaggtcaccgccggccatctcgagctccggcgacgaggagaagctggagatgaggggagatctgcaactgctgcactactaaactaaaacagcttagctgtgcacttttgtctctcctctatcaccgcaatatgattcctttcaaattccttccttttttttcctttttatttacaagtatttcatctgaatatgttcgtatctagatttattaactgaaaaatgtcatttcttattttaaattagttttttatgggacgagagagcagtgatacatgtggatttgtagaaaagctttttgtagttcatcttttgttaaggtgaaaaacaaatgacaatgaccaccagtacaccactagccactgctcaattgatttctttggccagtctcgttcagagtgaacaagaaagaaagcaatggattagagccttaaaaaacgaaaacaatggatggtactgtacataggactgaacattaaatttagtggtccatgatggagcatatttggctgttaaaaaaaaagaaaaaaaatacaaattaaatttagtggactttactaatttaatttcgtggtccatgacgaagcatattaaaatctagtggatttggctgttaaaaaataaaagaaaaaaatgtagattaaatttagtggacttcgctacaagaaaaaataggaaaaaatgtttggctgttaaaaaaatgaaaagaaatgcaaactaaatttagtggactttgctaatttaagatttggcaaagaaaaacaaaataaaagaacatcagtaaaaatggtgttacccagactcgaacaggagaccttaagtgcattaggctgcgttctttctctcaacttggagtgaggtttttagctacgtaaaatgagaaagttcattagcacgtaattaattaaatattaataattataaacttgaaaaatagatttacttgaattttttaaacaatttatatatagatttcttttgccaaaacacaaacaatttttttgagggaaatgagtgctttattgattatgtaataatattacaatcttacttcagagcctgcatcacacaagacgaagcatggtcacgccaaaccgcgcaatatgcggtccgtttagcaagttgagtaagttcatcagcaaccctattacatcctcgttttctatgatgaatgcgcactttttaaagacttcttattactaattttatcgaccgatttagaaacgtccatcttgatctttcctctactttggttgacattctttcaatcgccgtagcacaaaaaatttaacagttttaaaaaacgtgttaacggaaaacaagaagttgaagtttgaagttgaagaaaagagaccttagactgacgtaataacctactataccacgacaccaattgatattaaatattttattctatttttttaactctagtacttgattgaaaatcagagtaactctaattccaaagtatcacactgccaaaattagctggcccaaattagccgtctgcaaatggcacgagattgcatgttgcatgacaaccgtccactactcaccccacatcatgaccgcaagaaaaaattccaagttattttttttaaaaaaggaaaaaatgaatgaaagaagaagaaacaacagaataacaaaacatcattactactgatggccattttaatcaatcattttttggcattactctagtatagttgagtaattaacaattttttcaaaaaagtagacactttaattactcacagccactaatcacacaagtttgcgtcatctcccccatctccgggtctccggggccggacagagatcgacccagggaagaagctagccctcgccgccgccgccgccgccatcgtcgtcgaggactcaatcaatcaaccaaccaaccaatcaatcaatcaagatgatggcggcggcggctggggaaggggaggcggaggtgacgcgggaggtgatatcggtgtcgacggagaaggcgttcgaggggaaggcgctgccggcgtggtcggagcagatcacggtgaggtcgctggtggtgagcgcggtgctgggcacgttcctcagcttcatcgtcatgaagctcaacctcacctcgggcatcgtcccctccctcaacgtctccgcggggctcctcgccttcttcctcatgaagacgtggaccagcgcgctcgagcggtgcggcgtgttccccaagccgttcacccggcaggagaacaccgtcgtccagacctgcgtcatctcctgctccagcatcgccttctccggcggattcggcacctacatcctcggcatgagcaagaagatcgccgagggcttcgacgaggcggaggccaagaccagcatcaacgtcgaggagccgtcgctgggccgcctcatcgccttcctcttcctcgtcagcttcgtcggcctcttctccatcgtgccgctccgcaagatcatgattatcagctacaagctcacctatcccagcggctccgccaccgcgcacctcatcaacagcttccacacgccgcagggcgcgatccaggcgaagcaccaggtgtccatcctcttcaagtcgttcgtcgggagcttcctctggtcgctgttccagtggttctacgccgccggccccgggtgcgggttcagctcgttcccgacgttcgggatggtggcgtacagccgccgattctacttcgatttctcggcgacctacgtcggcgtcggcatgatctgcccctacattatcaacttctcgctgctcatcggctccgtggtgtcgtgggggatcatgtggccgtacatcgagagcaagaaggggagctggtacgacgcggggttacccaagagcagcctccatgggctgaacgggtaccaggtgttcatctccatcgccatgatcgtcggagacgggctcttcaacttcttctccatcgtgctccgcaccgcctacgacctctacctgaagcgccgcggcggcgccagcaagcagccgcaggagacgccgttcgccggcgccacggggacggagcggcaggtgctcagcttcgacgaccggaggcggacgcaggtgttcctcaaggaccagatcccgacgacgatcgccgcggcggcgtacgtgctcctcgccgccatctcggtggtcgccatcccgcacatcttccggcagctgcggcccaagcacgtggtgtgggcgtacgtggtggcgccgctcttcgccttctgcaacgcctacggcacgggcctcaccgattggtccctctccagcagctacggcaagctcgccatcttcatcttcggcgcgaacatcggcgccaaggacggcggcgtcgtcgcgggcctcgccgcctgcggcctcatgatgggcatcgtctccaccgcctccgacctcgtccaggacttcaagaccggatacctcacgctcacctcaccccgctccatgttcgtcagccaggtaagtactaccggacaaaattttaattctactcctatatggcacccgttatttgtttgcgacttaaaattactatagattttcttaaaagaatagtaatatcaagtgcaataatgtaagtgtataaataaacatgcaagactaaatttaatttacaactaacgaaatcagataatgaatagtacttatacaatgcaggtaaattttgttatttttgttttttatgtgtagaccgaatcaagacatgtatgtttttgtggtgtcttatactatcataatatatcttgtcaaattctatgacctttttatataaacatttaaaccgcatgtgtacacatttaggtgtaattgcacctagctgtagcaaataattttcatgtaagtgtgtatcatgcattgtcaaatacgaactttattgtatcatgtacaatatattgtgctgcatgtactaatcaattttaagttgtatcataataagttttatgtaagtactatcatgcgttgcaacgaacgaattttatcgtatcctgtacattaagttgcatgcaccaaccaatacttgttttaagtttaaggtgtgtgatgatgattaggtgctggggacggggatgggatgcataataagcccgatggtgttctggatgttctacaaggcgaacaacatcgggatggaggaagggttcccggcgccgtacgccaagatctaccgggggatcgccctcctgggcgtgaacgggtgggaccagctcccccgctactgcctccgcttctgcctcgccttcttcctcctcgccatcgccatctgcgccctcaaggaggtggccaagcagcgcgggtggtggatccaggacttcatccccagcgccctcggcatggccgtccctttcttcctcggctccttcttcaccatcgacatgtgcgtcggcagcctcgtcctcttcctctggtcccgcagcgaccccgtccgcgcccacaccttcgcccccgccgtcgcctccggcctcatctgcggcgacggcatctggtcgctgccctcctccatcctctcgctcgccaacgtcaacccgcccatgtgcatgcgcgtcttctccaccgccaccaacgacaaggtccagctcttcctcaggacgctgcccacgccgccatgatccatccatccacttcaagctcaagctagccttccatcgatcttgccacgcgtacgtgtaggttgattaattagttctttagtgattatacttaattaattaattgtcgattggtttatatatattagccttgtaatgtaagtgtagaagagaagcagctggtgtagcatacatatgtactctctctctctctctttactgattggttcttaaattcatttgttatacttcacatgtacaaattaaggccttggatggatatatgtccatgtaaaagattgatagcatgcgtgctttgcatattcatgatcaattgtgagaccaactgcaatggcaaatggaagtgggacactgacttcactcgtttattgcatgtcaaataaattgttataatctttttaaaagaatgacaagatagattaatatgtaaatagcatattcaaagtcaattttaattttttttacaatataaatagtcgaatttgaatttgtggagtgatatgttacatactctctccgttttacattataagtcattttttttctagtcaaacttctttgagtttgatcaagttatatataaaaaatatagtactattttcaacacaaaacaaatatattgttaaaatatattcaatgttagatttaataaaactaatttaatattttagatgtctactaattttttctataaacttggtcaaacttaataaagtttgattagaaaaaaaatcatactaataatctattttttcaatatttttgaagttttttataactaatgaattgacatgcaatgaatgagtgaacaaccactcaagtgattaaaagtgttttccctcctttgattcttaggccctgtttagatcctccaaaatagcaaaagttttctgttttagaagcacttttggtcaaaatggatctaaatactggtagcaaaagttggtaatttggcatttgtcatttgggagtctagagtagcaaattttgctaaatagtgcgttgggagccgtgctctctctctttactagtaaaatgacacatgcatctaaacaccaactagcaaaacttcaataccaaaatttttgccacaaaaacttttgccaaaaaattctgccacagcaaattgatctaaacatgcccttaaattcattcatttgtttcttgatacaattaaatgtataaataaggcgtttgatgtctgtccatgtaaaaaagatgggtagcatgcgtgcttgcatattcgttgtctgtctgactgactggtcagttgtgaaactctctgcaatgttcctgtactgtagctagaaattaacattttatcaggtttatttaacagttacagtactagtaatctatgtggactccagtttatcaaagcaaacttctgggttctgccaaaatcagtgcacgcattctcatattgaaccatggactcagtgaggcaactgttgatagaggagatcaaactgtgtttatagactgaactgaaacttgattatacagtttgccacgactcctaactcaagcccctatgacgtggatacatatgtacaaaagttttgacacctgagaaaatgatctagtttccctacatggatagctagctagtagctatctcatgtcatggagtgttgccaagaaggcgtccaacttgacattgtcacctcgagacaagaacttgatgcagatgggcgccctggcacccatagtgtcagcatggacagcaagatcgagccgacgccgtcgccgcagatgagccccgacgccagcgccggcgagagcatccgcccgcggccggcgtccatcttctcccacaggtacgccaccaggctgccgatgcacatgccgacgggcacgcgcggcggcatgaagaaggtgatggccatgccgatggtgctcgggatgtagcgccggatgcgccactccttccggctcgccacctcccggaacacgctgagcgccagggcgagcacgaagaagaccttgaagaggagcatgctgtgcctgggcaggccttgctcgccgtcgccgacgctgagcatggcgaagccgcggtagagcttggcgtagggcatgtcgcccatgtcgccgctgcccatcttgtacaccctgtagaacacccagaacacggtggggttgacgacgcatcccagcgccgtgccgatcgcctcgctgatgaacacggcgcgcggcgacgtcagcgtcaggtagcccgtcttgaggtcctgcgcgacgtcggccgcgttgcccaggatcgacatggtgatcccgccggcgaccagggcggcgaccacgccgccgctcttgatgccgacccacgagccgaacgcgaacatggcgatcttgcaataggtgctagccaggttcatgtcggtgacgccgaagccgtaggcgttgcagaaggcgaagacgggcgcggcgaggtagatgagcgcaacatggctgtacctcatctgtgggtagaggtgagggatggcggcgatggagatgatcgacaggaggacatagcagccaatggtgaccgagtccggtatctcgtcccggaggaacacctgcgccctgcggcgatcatcgaagctcttcaccggctgatcggcgatgtcgataccctggaatggctgcgcattaccgccaccaccttgcattgcctgccgacgccgcttgatcatggcacatgttgtccggaccatgatgcagaggaagacgaagaggcagtcagccattatcatggacaagccgatgaacaccttgtaacctctgatgccgttaaggctgttgggcccaaggttgcttgggtaccagatgccctcctttgactcgatgtacggccaaattacaccgcacgagatgatggtgccaatgaaaacggagaacacgatcatgtacgggcacatcatgccaatgccgacattggccatggtgaaatcgaagaagaatctgataaaagggaacaaaattagtttcccaatcaaccactacgctagctgatgaattccatccatgcatgtctgattgcgtacccgtgtttatatgcctcgaggccaaatgtggggaagaatttgaagccacagcccggcccagaggcgaagaaccactggaagagcgaccatgcgatggttcctccaaacgatttaaacaataatgtcacttgcttcctgcaaacacaaatagtcaatttgattgtgtaatctaaggcttcgaatagtacttgatccaacagaaacatttccatgtaaagtttaattgatgataccttgcttgcttgacaccttgaggtgtatggaagctattgatgaggtgcgccgttgctgtgccgctggggaatgtcaaccggtgcctaatgatcatgaccttcctgaagggcatgatgatgaacatgccagcaaagctgataaggaagaggaaggtgatcatcctggcaaagcttggctcctcaacgttattttgggcattgacatcccctacagctgctttctttcccattgcaagaatatatgtcccaaagccacctatgtaaggaagtacggttatagtaaagataaacataaaatagtgcacacaattctatcaactactattttcagattgtctatataccggtgaatgtgatcgaggtgcatgcgacgacacaggtctggatgatggtgttctcttggcgtgtgaatggtagttgtgccactgcgaagtagtcaagaatgcggatcgacgcacgggatacacaaaaaccgaggaggccggctgggatgctgaacgacggaatgaagccagagctcaaggtgaccttcatggcgacgatgctgagagttacactaaggatgaagctcaccaccattgatcgtggcgttattgtttccgacaatgatggcacaggctctgcctcaaaggcatgctctgttgaaatgccttcctggaaatcattgacaggctccattgtattgtagggaaactatatatatgtatcctttgaggctaggaaacctttgttattatttgattctgtgtgtatgtcttggtttttgcaaccaagacacacacacagaatcaaaatgctggcagcaatggaagaagggacttggggaggccttttatagagagctaggcagtcagttaccagccaattctttccaaatatagtttatttgtctggtcttaattttgtcaatgttttattttttcagtgtttaatctataacatgcacatgcagatgtttattaatagtaccatgaaccaaataaagagcaatgagctcacgcaaagaaaaggaaatgagtgttgtggaactaaaaatagtagtaaagaagaaatagagtgaaactgaaaaaactctaccatccaccttgcaatgtccataaattacctgttacaaaagtgactggttctgattcttgaccaatagcgcacacaccaaacatgtagcttcttcatccctacaaacctcatcattcttgtccaatttcagactaaagatcaatttcttgaacacgttaccagggtgatctacaagagagatgataagggcacaactgcaaaggggaaaaagcttggagtcagcgagtgatctgatagagagttcattgacagagcatgcatttgaaggggaaccaattccatcatagacggagaagatcaccgtgcagttggtggtggcaaggcgctaccagtcatcattaatatgaatcccgtattcatgtctgagatggcggcatcgttgaacatcccagcaagccatgctgagcctcttcttcctcaagatatgaacaccgaggctacaacaattcaatgtgttcaagaggcctttcatctgctagcagagcaccatcatcaaagttccaaacatgtatagttgcctatgcaagcatcaagtggtgaatagatgaacacaaatagcttgtttcactacgagtacaagaggggcagatctacagtagtatcaccggggtcagatgacctcgatgccctccagccgacctagtgtgttcaccagtattctatatgcagtgaccctagcagccaaagcttactagccccagcgtgttgaactgcagcaacttacgagcatagttcatttatttgaaaattaattacataattcaattggtatcagaaatagtaagcccgtttcccagtagttgctaggggctttggcgtagtcagtccaccaccaataccacagcttaacatatatatttggtcagttaaccaattagctaattatatagctatgtagtgggtctatgtatgcattaggctaccgttattctaatcaactactagatgtcaagctttttttaagttcgcaaataactttgacaatttgaaaacttgcttgtgtggttgaaagaattaagttttgttacatagctccaagccccccaactcttgaattagtgcaaaatatagagtttatcgtctgaaataaaagtgagttaaacatttattttagttcaaatgaagagagctcactgaaacaagaactcatggccctaactccaaacttttggagcttaaaatacatagcttaaaaaaaaagaagaaccaacaaagacaacagtattatagaaccccggtggctcagaatcatggttccgcacataaggaaataacagcagtcactatgcataaccaggtaaagaataagtaaatcatcatcgctgatgtgttggccctcttcatagccttttacaatgccaatggtgctggcatcacatatctgaaccactatgttctaatataccaagattgtctaacttgacaggcaccgtgatacttgggttcttgatataactggtggaaatggcgaggtaattggaagtttctacaatccacatcacaccccaggtggtaggttgcatctatcaaccctgtaaatttctgggttctctacagattcaaccatgataaccctagtcctacaggaagctatgacaagtacaacacaaatcaccaaggtctactgcaccatagccatgccactgctggatcccaacactacccaacgccggagaggaaattttaaggctgcattttgagtgtcccttgttgctttccatccctaactactagagctagatccaccaagctactgtaaacatcaacaatggcagtaacaaacaggagccgaaacgcacggcggcgatagatagatagggagatagaggtttcctcaccgctgcctgtgcgcacgccgccgcctcgccgtcgtgcgaactccggcgagaatggcatcgccggcggaaagcaacaaggaggaggcgtgtccgcgtgtgggggccacctgtcatcgagccagaggagaagagcgtcacgagtgggccagcaatgtcagcccatcagtacaggcccaacttaaaaattgctcggcccattttcggcctgcgaaaaagcccacccacccaggctctagggtttcggcgcgaccgcttatgaaggcgaggaggaaccaagagccccagtcctcactccccgccgccgccgccgccgctccatcctcctcacggagaagcgcgggaaatcacacctcgtcgcagccaagatctcctccagtccaaacgcatcaaagattccaaggtgggcatccaatcctcgcttgcaaacacaaccaccatgcccaaaaccgatgcctacttaggagttaggaatatgtttcttcgatttggttatcgcgttggtaattcttcgctttcgatttgagcagttaaaagcatgagatagtattaaccaaatcgatcctgatctgtgcgtttagattctgggcttgtggtcagtgttcgttgaaacagcacgaaattgttaatagtctaagcagtgtggatgtcgtatgagttaattgtagctttttttcctagtaattttagctctaattccaggttgtgctgttcgggagagcttcttgcgttgaggagaggggggatgaatagaagcgtttgccaccaccttctcacccagtgcaaaaccataagagagctccaaagaatccacgcccaggccctcacacacggcctccaccccaaccagcagtccatctcctgcaaaatcttccggtcctatgccgagtttggccgaccggctgacgcaggcaggttgtttgatgaaatcccccaccctgacattatctccttcaccagcctcatgtcccttcatctcaagttagatcaccactggaaagctatatccgtgttctctcacgccattgcttctggccaccgccctgatggctttgctgctgtcggtgccctctcggcctctggtggattaggggatcagcgtattggtagcgtggtgcatggcctgatttttcggtgtggattggactctgagttggtcgtttgtaatgctttggttgatatgtattgtcgatgtggcaagtttgagcctgcacggactgtatttgatagaatgcttgtaaaagatgaggtcacttggggtagcatgctgtatggttacatgaagtgtgttggtgtggattcagctttgtcattcttttatcagatgcctatgaagagcactgtttcttggacagcactgatcactggtcatgttcaagacaagcagcctatccaagctcttgagctatttggtaagatgcttttggagggccaccgtcctaaccatattacaattgtaggggtgctatcagcttgtgctgatattggtgctttggatcttggacgtgccattcatggatatggaagcaaatctaatgccaccaccaatataattgttacaaatgctctgatggatatgtatgcaaagagtggaagcattgctagtgcattttctgtatttgaagaagttcagatgaaggacgcattcacatggacaactatgatttcaagtttcactgtccagggtaatgggaggaaagctgttgagctcttttgggatatgctaaggtctgggatacttccaaacagtgtgacattcgtctcagttttgtcagcatgcagccatgctgggttaatacaagaaggcagagagttatttgataaaatgcgtgaagtctaccatattgatccccggcttgagcactatggatgcatggttgatctgttaggacggggtggacttctagaagaagcagaagctctgatagatcatatggatgtcgagcctgatattgttatttggaggtcacttcttagtgcatgcctagctcatggcaatgatagattagctgagattgctggaatggaaattataaagagagaacctggggatgatggggtttatgtgcttctttggaacatgtatgccttatcaaacagatggaaagaagctttggatatgaggaagcagatgttgagtaggaaaatatacaaaaaaccgggttgcagttggattgaagttgatggtgtcgtccatgaatttttggtagaggacaagacacatgatgctagaagggaaatttatgtcaccttggaaatcaggctaggcatctcaagatggatcccataccatctccattagtgttaactgatggagaacacatgctctagaaacacatattgtcctttttttttctttcctttgatgacctctaaccgaactgaggatgatatgctgatatttttttctttttgttagtgacaaggcaccatagttttgttttgatttgtttgattaaccaattagtgatagccagttgtaacacactgatgttatttcattgaaaatgcagaattgtagagatttattttagatgtcgacctgcagatatgctatacctgtattttgtttggtcactctgtcaaaaaaagagtaaagactgcaatgcgtcccagttcatgttatggacttctcctcattttacagctatcttgctgactacatcgctacctctgaatgttttacttgtttacttttttttatatataaatgacttatttatgtgtgccgaatttctaactatctgatttgcctactattagatgtgctctggagatgatattgatggagacatgagggttgaagcaacacaacacagggatataaggcgctacaagtgtgaattttgcacggttgttaggtccaaaaaatgtctcatccgagctcacatggttgctcatcataaggtataaaactacttagatattttaggaatatgggccatattatgccttatgttttaaagacaatgtggactgtattaattaaattgagttatttgaccgttatggttctctgattggagtttaggtccatcaatcaatatatttgtgcttttgtcaattccttctgctcttatccatttgaatcattatatgaatatctgatgccctcacttcaaatttatctataggaagaactggacaaatcggaaatctacaagtcaaatggggaaaaggttgttcatgaaggtgaccacacctgccaagagtgtggtgcttctttccagaagccagctcatctgaagcagcatatgcaaagtcactctgatgaggttggcatttctcatatgtgcatacaacatgatattgcttttttgttggaatggtgctgggattagtttttttggaaacatttaaacataacattcttgtatggtttttctccgtccgctgatctggttgtcaaagaaattgttcttatctacttcaatttgctaaaaacaagtgttttgcaggatatagattcttaactgtgtgaagcattggatcccaaagaactccaaaatgcgatgaggcatatttaatcttgtctggactagtaacaggttgggatgaccacctgtgaagctccaacaggattgcctcctcacgctctttcaggaggtttgtccttgcttgtattagttcttttcttttttactattttgattattattcaacttcatgggatagcctgcatctccttgtttccaattaagtactaatgtctcctttgttgtatgcacatgtgctggaattcattgtttatcaatttgccttgtggtatgctatacatgatatctttaatttttattagtaacaaggttttttacagcatacatatacataaatagtgtttttttacagcatgcataaatggtgaaaactgattactgcttaattattgactagttgctggctattttacatttttttgatattgcaaatcttgtgaaatggatccatgcagtgaatttgggaggttatcttctcctttgttctaatgttctctctcac

SEQ ID NO: 44317 - DNA, 2047 bp, Oryza sativa
tcctgcagcccgataatcaggctcgaactgatgacttccaccacgtcaaggtgacactctaccgctgagttatatcccttccccgtcccctcgagaaagagaattaacgaatcctaaggcaaaggggcgagaaactcaaggccacccttcctccgggctttctttccacactattatggatagtcaaataatgggaaaaattggattcaattgtcaaccagtcctatcgaaaatagagattgactatggattcgagccatagtcaatctgtatgattttcataaaatctgtacgattttcccgatctaaatcgagcaggtttccatgaagaagatcttgttcagcatgttctattcgatactggtaggagaagaacccgactcggtattcttaaaaaaagaggggaagcagaaccaagtcaagatgatatgggtcgccccttcttcttgcgccaaagatcttaccatttccaaaggaactggggctacatttcttttcaatttccattcaagagtttctatctgtttccacgcccttttttgagacctcgaaacatgaaatggacaaattccttctcttaggaacacatacaagaaaaagggataatggtagccctgccattaactacttcattttcatttatgaatttcatagtaatagaaatccattcctaccgagacagaatttcgaacttgctatcctcttgcctaataggcaaagattgacctctgtagaaagactgactcattcggatcgatatgaggacccaactacgttgcattgccagaatccatgttccatatttgaagagggttgacctctgtgcttctctcatggtacaatcctcttcctgctgagccccctttctcctcggtccacagaaaaaatggaggactggtgccgacagttcatcacggaagaaagaactcacagagccgggatcgctaactaatagaatagcactactaactaatactaatatatagaaatagatatctagaaatagaaacgaactaatatatagataatcgaaattgaaaagaactgtcttttctgtatactctccccgttctattgctaccgtgggtcttatgcaatcgatcggatcatatagatatcccttcaacacaacataggtcatcgaaaggatctcggatgactcaccaaagcatgaaagccagttagaaaatggattcctatttgaagagttcctaaccgcatggataagctcacattaaccgtcaattttggatccaattcgggatttttcttgggaagtttcgggaagaaattggaatggaataatatagattcatacagaggaaaaggttctctattgatgcaaacgttgtacctagaggatagggatagaggaagagggaaaaatcaaaatgaaataaataaagaataaagcaaaaaaaaaaaagtcgaagatagaagagcccagattccaaatgaagaaatggaaactcgaaaaggatccttctgattctcaaagaatgaggggcaaggggattgataccgagaaagatttcttcttattataagacgtgatttgatccgcatatgtttggtaaagaacaatcttctcctttaatcataaatggaaagtgttcaattagaacatgaaaacgtgactcaattggtcttagttagtcttcgggacggagtggaagaagggcggagactctcgaatgaggaaaaggatccctttgaaagaattgaacgaggagccgtatgaggtgaaaatctcatgtatggttctgtagagggacaggaagggtgacttatctgtagacttttccactatcaaccccaaaaacccaactctgccttacgtaaagttgccagagtacaattaacctctggatttgaaatcactgcttatatacctggtattggccataatttacaagaacattctgtagtattagtaatctccgaagacttctccacgaggctcataccaggcactacggcgctgaagtatgtaacccatgccatactcccaggaaaagctcgaacgaccttcaacaaaggggtacct

SEQ ID NO: 44318 - DNA, 4335 bp, Oryza sativa
acccatacggggatggagcgacagaagcatggaaataggataaggtagcggcgaaatgagccgtctaaataggtgtcaagtggaagtgcagtgatgtatgcagctgaggcatcctaacgaacgaacgatttgaacattggtcctacacgacctgatcaaatcgatcaggcacttgccatctatcttcattgttcaactctttgatgaaaagatgaaaaaaccaaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaagtagctcgattccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggtacccccaggaagagatccagtggagacggggtgggcctgtagctcagaggattagagcacgtggctacaaaccacggtgtcgggggttcaaatccctcctcgcccacagccttccaaacgggaagggcctttactttccccctgagggtaggaaaaccatgatcgggatagcggacgtaaagctattgaacttgggtatgctctttccttttgtcgaagtggaatcgtagaacagaatgtgatatgataagataaaatgcaatagaaacaaggatagcgaacgggttacctactcctaagggtcaaagcaagccctttaattcaattctttattcttaaattaaagaatgaatcaaatctccccaagtagaattcgaacctacgaccagtcagttaacaaccgaccgctctaccactgagctactgaggaacaggggggattcgacctcctagagttcaactcccgctctcaacccatgaacaatatgagtccgaagcttctttcgtaactcccggaatttcttcgtagtggctctgttccatgcctcatttcataggtaagcccagagtggctctatttcattctatttcacttcctagcgcttcctatcatttaatatccatccctttggtcttattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttagtagtctaagtttctcgatgaggataattaattcggttgttgcggtcggactctattatgggtttctgaccacattctccatgggtccctcttagatcttctttctccaatcttggattagggaagaaggagatattcgcgactcctggtggtttcattatggggcagctcatgatcttcatatcgatctattatccacctctgcatctattgtttcttagctaaacgggtggaagatccatccaatttggttatatcatggactcaaaaaacggatctgaatgtgactgaaatgcacgatcttcacaggtatcacttttcacgatacctaaaaggtggaatagcgattttcgaaccatttcctataagagaaaggtttccattactttgagaaatggattctatatcaaactatagctattgcattaaagaagaaaagaaactaatagaagtcgaagacgcggaatggtagtgaatagagagaaagattcttctggttttcttgttcctgaaaatattctatctatctcctagacgccgtagagaattgagaattttcatgtctttcaattctcgtactcgtaattggaaagttacggaaggagatccatcattttgcaatgaaaactacataaaaaactctggacaatttcgaaatcaggccaagcgtcttaatacatatgtaaaaaaattcattattggcccaccattgattagaagatttaacttgtataaatcgctattggtttgatacgaataatggcagttgtttcagtatgttaaggatacagatgtatccacaattcatttagagttacttaatagcctatttcttataccatatctctatcccgtgaaattctcgagccgaaagatggatgcatatgctatgtttcattttgctaaatgatatcaattaaacggtgtatcaattccataaattggatatagcaataaataaattagcaaaattcttttattttagatagaagaaacttttcttctatctaaaataaaagaatgtacccttctatccaaatccaatttgcatcgataaaataaatccaaattccagtagtagatgaataattacaaatttttgtgtgtacgagattacaataatttcaaaataactgacataattttttatttttcctgatcagaaaaatacatgaaaaaaaaggaggtagaaaattttttggatttatggttaaagaagaaaactggggttatgttgaatttcaagtattcagtttcaccactaaaatacggagacttgcttcacatttggaattacacaaaaaagatttttcatcggaaagaggtctccgaagacttttggggttttcagatcacaaatcgaagtgttcggagtaaaaagctaactgaatttaaatagcccaaacagatcgataaactcttaaaacttcggcttgatttacaaaaaatgatcaagctcctttgtttcatcacacaagtacacaagtgctagtataacacgaatgtttgaatcagagtagcccatgtttgatacgactgacaagtgacaagttcgatgcaaatttcattcaacttataatttttcaaatcgcctgttccaccacaacggagtagaaaattccaaccaaaatgaaggaaaattcaatttatggcaggttctctctcctgtgaggaacaaacggttgagatggtgccacgtggcgtgtatcggggccgaagcccccgctaacttatccgttacctcgctcccatcccgctaaaccccaccgcgacctcgccggccttcctccgctccggccatggaagccttcgccgccgccgccgccgcggccggcgtcttcgcgggcgccggcgcagctgcgcgccccgtactgctccgccgcagaggtgccccccggtccggccgggtgcgcctcctccgagcgccgccgcgcgccggtggggacagaggaggggacctgcccccgctcgacgagtgggacaggatggagctggagttcgggcgcttcctcggcgaggatcccaagctcaccctcgccaaggtttccttcctcccgtgtgcctgccttactactgctctcatctcatccctagagagagtagaggctctcggaataagatggaaatgtcgccttgttttttttaaaaaaattcaatgcgaattcatacttgcgttgatagataggatgtcacgagtgttctaattgtagcaaaacgatcgttgcgacttgtgagtatcatgcgggtatgtactagaaatgtttgtgcataattgtggactagtgttcaggttctactgcagccttatttttttctagtatttgtaccaccgcatatgttgttatgttgtccaatatgactgtattgttgtactccatgcttaagtttggatggtttgtgctaaatttacttatttttagtttaaaataagaaggtcgctagatggagtagtttagtactcctatatactatactatccagtcttgctaggatgttcctaccaatgtggctagtcgcaattgctcattgcagttggagcctaataatctgaggattacaattttgaattttatttttgtggctgaaccttgactcaactcccaagtagtagtactgcccaaatgtattgctaggattctaagatctgataactgcgaacctgtacactacaaactgacacatggttatttcacacgtgttctgtagcgatgtttctgtcacttgattttctcatcattagcatgccttaagtgtttttgaattattccctcagatacttctcaagaaagcagacccagatgcttcatcgctcgatgtagagaatctaattgccaaca

SEQ ID NO: 44319 - DNA, 3683 bp, Oryza sativa
gctttgactatgttgcgaccagcaggaagcaaattgaagcaagatgatcctcctttgactttgcagcgaccagcagggagcaaacccaagcaagatggtccttctttggctccattacgaccggtagggagcaagccaaaggaaaataacacttctttaaccttggtgcggccaatgggaagcagaccaattgtccggggtaaaccggtgcaagatagttggcctagcaaggggagcttagctgccagaagagagtcgagcgatgttggcagcacctcaagaaagaacaatgtggatgtttccttgcggaaacccaccatacatcagagtgatgatgatgaattgaagtcgaagctgaatctgaaaccaaatattgacttgaaaatgaggaaagatatggacgaggatttggccaacatctctcttcttcaaaagccagagctttcagtagataatatgaattcaaatcaagagaagtctgatgctggacctgcctctgttgcttctggagaggataatggtgcagttgacccagaaacaaatggtaaggtacaacatcccaaatgcaacaggccatgatgagctggttcttttggatctgatggattgcaaatttttcaatcttcaggtcttgatgaaagagtagtgattgacagtattaatgatcgtgagtcatctgtgcttcctgatgatcttagtgcaggtaaggaaggcataatagatcagtgactagtctctattcatccatcatactaatgttatgttaaaattttcaagaattacagccatctgagcaaaattttaaccgagaaggcgacccttctgtggtggatgatcaatcagccgtcagcagtaatttctctatgcaagctttcttgcaaggaaaacctaagatgtactttctgatgaaactatgcacttctatttttagcataacattttcatcgcttgtaaaatatatatttgacatttctgcttaactaattgtacttcatgttgttacattgatccaaattgggtgtatcccttcttcttttgagtaactcacgtcattacagtttctcgcatgttggccgagctaccactaatatggcaattactacattgtaggaaagacttagctgttgaaacatttccatctcaagttgatgctgagaagatgaatgccagtgagaataacatgaattatgttgatgatggaggcaatgtgttatcatcgaaattagaggtaatgtgaatttcataatgtttgagcttcagcatcttataggcttattatcaaactcaacaactgtagttcttagagtgggtgttgccttctgtggaatgagatgtttccctattcaagggtcattgagtcatatttcatccttttaattcttctagatattgattataactcttgtttatggaatcactaatgcaggacatcacagagagtgactggacaaggctggagaattatgcaagtaccggagaaaaagttgaggtggagctgataaactgcagctcgaaaggatttgttgtaagtttttgtccagttttagaattagcacctttttaatcaagttataatgaactgatggtacctgacctctatcatcatttctttgccaggtatcactcgattcattgatagggttcttaccgtatcgcaatcttgctacaaaatggaaattcttagcttttgagacttggttaagacaaaagggtggcgatccttcactcttcaagcagagtgtgggcatagaagaaagttttgaggtcaatgacaggaacatagaatcagtatctagctcagattcagaacttgctgtgcaggatcaaggttctatgccatctaaggaaaaatttgaagatcttcttcgaacatataacactgagaaatctaaattcttatcatcatttatcggtcaagtatgaatcttttgttagtctccaaacattcttcagttgaacccttttagctaacatgccattgcttgttttgcagagactccgtgtttcagttgtcctggctgacagaaaatccaagaaaatatttttctctatgaagccaaaagaaagtgaagaattgattcagaaaaagaaaagtctcatggtacttactatgttgaaatgtctattagcttagttcttttgctatgcttagcatggtccaacattttcccttttattacttatttatttgttcggctgcacacactgtttttcttaacatgcaggctaagctcaatgtgggagatattgttgaatgcactatcaagcgatttgtttactttgggatatttgttgaggtaggtctaaccatattttctacgctttttcattcagtatcagcagctaactgtttctttcaaaggttgaaggagttcccgcattaattcagcagtgggaagtgtcttgggatgaaaccttggacccatcagtttcttacaaaattggtcaggtaacacttgttttttgcatggaccttatttttgttgcaatctggctttgttaacagtgtgtgtgcacccatgtgtggataaaggaggagttgcaagttctcatgttcattttgaaactgacatacctctctatatcgtctagaaacttagatacatcacgtgacaatgatcataatgccaaactttctgggatttacagaaatttattttgatttccaggttgtggatgctaaagttattcaactggactataataataaccgcatatttttgtcacttaaagatgtaaaggtacctgggggcctttccccttttccctcatggtggttcagcttattgaattgctgatttcaggctttcatttattatttttgtcatttcccccttctatgcagccaaatccttcagtaggcgcattggaagctgtcattggtgaggaactatcactcggtggagctcttgaacctgcagaagcagattttgaggtttgtgtgacttatggcattatttatcatcatcttgaaatttttcattgtttgtgatttgaaggttatgcatatttagagggcctgaaatctaaatctaatgccctctctctattcaactgggaaaaaccacgtcatcagattgttttctaacttctggctaaatgatgaaaacatgtatagctgctacatggcagttgcatcccattttctgagttatgtataatatcttagcctgtgccaaagagatcgaaactttttgtaggtttgctggtagggcctcctgcatggtctgtgattgaatatgggcatacctgagttttttcccttctattgcaagcatgttttgtcatacagaagttgatagagctctgtatttgaatgcggggagtctgtgctacccaagcctggatccttcctatcttcttagtttgtttaattagttattgttcttcattcaaacttcttttctggatattttgtggacatttctgagagctgtagacatagcagtgaacttgggtcatgcaatgtttgtttcatacgtctgccttgtggcattgattttctttcttttccttatccatccactttgttgcatccttgttttaacactccattatttgatcataattattttagtggcctgaagtggatgctctcatggaagagatgaaaaatattgaggaagttagggatgtttataaaggacgattcttgcgaagcccaggactagctccaacctttc

SEQ ID NO: 44320 - DNA, 5431 bp, Oryza sativa
gtacagaattgttgtggcagtccaattttgcatccttgtagcatgcttttgagtcgtttacacctgattttcttccttttcaagttgaaaataccaggtgatatgtagtcctagctcaactttgtagaggatgacaggtgtaaatcgccttgatacgttactacggaattgcaacagaattcgatttgcatctttcacggtgctagaattaatctaccatatttttgtttgaacaacgtagtaaatgataggtgatagcaccggtaacatggtttattggttaatctgaaatttggaatgaagataaaaaaaattaatgattcatccaactagatattaattatcattaccataaacaggtttgtttttatttcgttttcatatcgacacgaacaactcagcgccaatgaatatactcgctgtgtgggtcacagttgtttcattgccgctccaaaaggttatgtaaggctgggatcatgatataactcagcttaaaaattgattttaagaaattagaaagaactcaaagtcagacggcatattaccattctcaatatcacagcaatcacattccctaattaaagtcattgtaagtatagcggagaaacaaaatgttgaggtagagtttctgtatgaagttggcggtgtcaaacatgataattaaaccactgatgtcgtagatatggttcgtatatagacctatgggttgggaaaaaaaaaagagaccattgaagtgataatttaaatacttaatagtaatagactctttgatggagtattacaacatgcagcagtggcattaatacgccagtacattaattaagttacacatatgcaggctccattttggtttcttttaatttatcgtattacagaatttctgtagccttgctgatgatcacttggatatcatgtactagtaattaacaataggatgcatacaaaagatggcccaacgacaacagaagatgcgtgcatctgacattgtctggccttatttggttggtagtactccaattaattaacaagagatgatgcattcttgtgccttagtttcttcacatgcttggcttcacgttgagcctattcgcaatcttcacccccaacgactcatcacactgcatgaagtaaatgagttaattacatagttagtgcaaattaatagctttttttgccggaattagtgcaaattaatagcgattaagtcatattaatttcaaattctctacagtggtttaaaattatatatttcatataaaataggattaaataatttatctatggattcataaaactgttgtgctaaacatggtgttaatcatgtggattaactaagagaaaacaattaatcattactaataactactccctccgttttttttatatgacgttgattagttcaaactttaactagtagtgtcataaaaacaaaaatggaggtaatactaaattgctggtatgaattacctgggagaggtagttgacccagatggcgcggagctcaggggagaccttggggtgcgcgagctcgccggcgaagcggcggatgaacctctcctgtctatccggcgcccacgacctgtacctctccccgggctgcttgaagtcgttctgcttgtgtatcgtcgccttctgcctcctccccaccacggggcgcggcgtgatgggcgtcggcggcgcgtggcggagcggcgcgtggcgcgatgggtagtagtccacctcctcgtcccggtgcatgaagttcatggcgccgtcgtagtggttgttgtggtgggcgcacttgggcgcgttcaccggcagcatcaggtagtttggccccagcctgtagcgctgcgtgtcggcgtacgcgaacaccctgcactgcagcatcttgtcgtcggagtagtagatccccggcaccaccagccccggcccgaacgccagctgctcgttctcgttgaagaagttgtcgacgttgcggttgagaacgaggcgccccacgggccggagcggcacctcgtcctccggccatgtcttggtgtcatccagcgggtcgaagtcgaacctctcctcctcctccgggtcgatcacctaacagtattaaataattaattagaaggagtactgcggcttcgaactcagatcgtataggcgttaatttctggatgatcacctacctggacgaacagcttccactcggggaagttgccggcggcgatggagtcgtagaggtcctgggtggcgtggctgtggttcttgccgccgacgagcgtggcctcgtcgtccatcaagcagctgacgccgcaggtgggcttccagtggaacttgacgtacctggccttggcgtcgcgggtgacgaaggtgtaggtgttgacgccgaagccgtccatgtggcggtaatcggtggggatgccgacgtcgtcgaagaggaagaagaaggtgtggaggctctcggggtggtgggacaagaagtcgaagaccctccagtactcctggacatgggagcgcgggttgggcttgaaggcgtggatgacgtcggggaacttgatgccgtcgcggatgaagaagacggggaagttgttgccgaggaggtcccagttgccctcgcgggtgtagaacttgacggcgaacccgcgcgggtcgcggatcgtctccgggctgccgcgctcgtggatgacggtggagaagcggacgatgacgggggtctgggcgcccggggaccggaggaagtcggcgcaggtgatgtcggtgacgtcgtgggtgcactcgaagaagcccttggcggaggcgccgcgggcgtggaccacgcgctccgggatgcgctcccgggcgaagtgcgccaccttctcgatcaggtggtagtcctcgaggaggatcggccccctgggccccactgtcagcgcctcgttgtcgttccacaccggagctcccgcgttcgtcgtcgtcgtcttcgtgtcgaacgagctcgacggccggaactgcatgggtagcacgtattactattaattaattaattaattatatacttaatgatcgactagctgaatcaaccagccatgcatgtttgaagagcttgagactaaaaaagaaatattcgtagaatctagtcgataatctaggttatttcaggaagtttctgataatcgaccaaatattctataagaagttaagctctctcttgaatctacacaactagctaaatgaaacctcaattattaactacaagattaagtagatttagtctcactagtcactgagtgactgaccttgcaaggatccatggtagtgggctagtggcagcagcaggtatctgggagtgagaggggtttgtttctgctagctctccagcttgctcggtgagacagcctgcctaaaggttatatagcgggaggtggtgaggagcactgacctccccggtgagcttaccggagaccggtgccacacactgactggtgggcccgggtggccatactgcatggttgggtcccacaggaactggacgaggataaggtgaggtggatgtgggcccccctcgtgtggaaaggaaatacatgcattgcctggattggatgcatggagtgtcatcacttcatcagtgctcactagctgcgtgccatcactgcatgtccatcgtcagatcagatcagatcatcggatcatatctcttcgattgatttcaacggcgccgaattgctgccatcgatagcttagctcatcccctttctcttgatcggtcggccaaagtttgacatgcttgcagttgcagctaacgtctctgcattttctttcttgtttctcagattaatttcaggctgcttaattattctgtaagaacgaggtgctctttgtgctagctagctatggctcagctacaccctcgtttatcataaacatacacgtttctcaaactgtaagctataaacagtgtgtttcgtacaaaatctttttatactatataaaagaatttaatggtgatggtgaatctaccatcatttagagttggtgagatcttctaatgctacataaatacatctttgtgtgtggtttggttttctattggatgtttgattgcaattatgtttgacaaatacaatttctaaatcaagaaattcacataaatcttttaaaatccgtccgttgcagagcacgttactttgctagtctttaaaattttaaataaatttagttttcaagtttataataggtaatactgagtttatcatgtactattcacctgttccggttttcatgccactaactagctcagtcaaactcctttatcgaacacagcccagccagaatgcacccttgtctttttacctagtgctataagaggaaccaattcaagatgatgatgattgatttaccttgtagcattactacgcagttcaaattactaacctttcagattaggtacggtctgaatatgtgatggaagatcgaagcagctgtatctcataaaataaattacagattccgtctggaaactgcaagacgaatttattaagcctaattaatctattattagcaaatatttattgtagcaccaaattgtcaaatcatggcgcaattaggcttaaaagatttgtctcgtaatttcaaggcgaaatgtttaattgttttttttctacatttagtactctatgcatgtgtccaaacatcctatgtaacagcgtgaaaaattttgtttgggaactaaacagaccctgattgtgatgcaacccataagtaattgcaaaactagctagctatctacagcatcatcagcatatatcttggtggtctaaacttctcaggaaacaaaagatgagaaattgttctgttcttagtccacgctgatgataacgataggtgtgctgtggtgggcacaagcttttttctttctttttttttttgaggggaaagttgcttaagatgaagtgacataaacaagattaattcgaggaaaatgtgcgcatctcagatgtgtactccatttatacaaaacccagcaaattaagaaggtacaattatctgacagactagcgaacaaactgaaaattatagtcgtagtactacaaatttgcagtttgtggctgaggggaatctatcccatctggtatatgctgtcactttgtgctagtactgtactatgtactagcctgtagcctctacttttgtaattgaatgagaatatttgaatgttttacaccacataatggaacagctcaaatctcataagatcttggagagatattcttgattactctgattaatgggtcatgtgttgatgcatatatatatatatatatatatatgttaatgaatcaaaacgcatgcatatgtctagattgaatgtgggcaatgctaaaaagtattatattgtgaaacggaggaagtagtagtcaaatggtgctaagatctgggttttcatgaaacaacactagacaccaataatgcaatcggtgggtat

SEQ ID NO: 44321 - DNA, 1056 bp, Oryza sativa
tcaaataaaaagatagttgcttattcgttcgagaaaacaggttatcaatttggtacagatttggcttgaattttacattttaatgctagttggtgaaccgtccagtactctgatggccatattaataatttccccataaaaaaacataaactaaattcaacctcggacactcaactttatattgcaaatctgaaataattttactgcattagaaaaatcagaagatggctgcgagtaatattagtgtcagttggtgaactgttgagtactcccatttccatatatattaatcattttcccatcgaaaaatgagaaaccaaatgcaaccactcaactttacattaaaaaactaaagtaattttgcactatatagagcattaaaaaaatcagaaaatgatttcgagtaatgtgagtagtcatcctgcacgagcttgactaatgcttttggaaaaagggagtaattgaggtgaggtgtgagagtgagattccccacctgtgggtacatgacaaaacaaaccaatcttgctgttgaagcgcatgatgtgagataagatcatcaatcagcagcaccaaaaaatatctctccttctattgcgtgcatggtttgttccttacatgattctatcttgagcagtgctcattcttcagtgatcattagctgtttcttgtaacttgtaagaacttgtttgaagcgcaggaatatttttttccttgaagataaatatagcgaaattggaatgctgaattatcaattaccggtgtgtaaatgccctctgatgaaataagaagagtaagtagagcacaaattttacagtaacaaattaagggctcctttgaatcgtaggaatgaaaaaataataggaataggaaaaacacaggattctgacaaaaatacaattgtaaaacagaggattgcaaaacacaggaatgaccgtttgattggaccacaggaaaaacgcaggaatcagatgagagagatagactcagaggaaatgttccaagaggttagacctcttgctaacttttctctaaaatgtgcataggattaccccattt

SEQ ID NO: 44322 - DNA, 19269 bp, Oryza sativa
taatccattcaaaaagtttcagttttactgcataagaaacatctcagtaaaaggaccagttgcttctggtaataacatatcccaaatttctgtcaaattccacggttgcagtatgagcagactgtactgaactctgaagatctcaagaaatctcaaaccgatcatacgcttgattagcagaacgatatcttcttcatggacaaaaatgagtgagcagtcagaagtctttctttcagacgatagcagcctcctactgatactgttcatgcatcctgcttgtgcgtttggatctccttcctgcaatttcatcttcagtgacagagacgccacggctgcgaaggatcgatggtgacatattcttagctaaggtgatggactgatggtccattggaggaccgaaccaccagctatcaccttatctgcaatttggatctctttgtttgtaatatataccattattcatactctccttttctttgaaattctattcattacaactggcgtggtagagtcgcctgactgtatttcgtactatcaatagagacaccgtaaaagcgaaagggtatgtaatggttgcagtgaccgaaataccacgaaattctgagttcaaatctttatatgtatgtaaaaattgtcgcattataccgacagcctcatcttttagcttatgcttatgcttataagccaaaatttaaattttcaacattaaatttggagttgattttgggatttttttcaatcgtagtttatttttcagcatttgcttttagatcgttaagaacacgtatataaaaattttatttataaattatttttcgtttgcaaatataccgtttcgcttataccgtcgataagcgaaataatggagtcccgatcgagttagttgcacaagtggtttagtgtagtacttataatctgcggggaccttacatagaagttaaaacctttgcagagcaacttagcaacaagacaatcgtcatgcaatcgtgataaggttgtagattaatttccatgtttatgtatgcagtgtaaccatctggaatattttcctgcaagcatccggacaacgctgtcaaaattatctagattacccgactttctccatggacacacaaatcatgagatattgtacatgtagaaaaaaaacgaagttgaaaaatatgatgttttaagatggaagctttattaaactcaaatagttacattacggtgatacaatcatagtgaaaatactttttttagataagggtatttttactcggcctctacattcaaccggatatatgtaacatttttaaattaggaacttggccccctaaacagtccaatcttaaattcgctcttataaaaatttgaaccaaagaatttagggtgctactcatgttactgcaccattacatgccatttcgctagtgaaaatacctttggcctatgtctataactaagatgcatattaagaaaaaaaacctcaaatgcatatgttagttatctttaaaaaaaagaaatacggaaaatgttaagaaccgccaatcaatatacaagatcatagtccatgctcctaggtacaacactcgaatgttgtaactagtgagccgtccgatcctggaggagtggtctggattaattaggtgcgagttgattaattcctcgtttgatagggagagtgacaaccacatgccgtccaccactagcgagctagctctgccagtgtcacactgccagtgaagcaagttggcactgtcaccaagagagcggcattgcattgcatttgcgtgtggaaattacactaagctgatgctaatcctgcatcatgagctgctcatcaactaaatgaccctcacttttggtaattaatcccttccttcaggaaaaagttggagattcagacatcctcaaatcagaacacagtagactagccaaatttggttgcccagctcatcctgatactttgcactaacagaagggttcttgatgatcaagtacgctttgatcaggaaataattggggatggctagtgggaaatgaccaaatatctcaatcaacaaagccaatcaatctcacactgcaaaaactaaagcaagcttttctctctcccggctgggtgcgtaataacatgatccaaaaagacatcaggtagtactcttgattgcaatttgcaaactaaccacccaaaaattatattgatatggtagaaatataatagaaaaggtacttatctagtttatactatatatgcatattatgtactgagagatctgggtgtcatgtcgatctgatcatctccaattctttattaattagtcatgtataagttgttgagtcatccattactgcctttttctttttttttctttttttgataactcacagccttaaattgtttcatatacttccagttcactgtattggaacaatgtaacattatgagaattgatgggcaatcaagaaatgaacaggataaagaatcattctcgtgctttgcatagtgatagcactgtagtgtatactttctgttcgttacagttcatatggccttctctagggaggcccatctacagtgggagcccagaagcgcggtgccaagagcggggcccacgacagcaccaatgtattcacccatctaatctgcaccgtacaacttcgatcgaacgtctcacggagatcaaagcgagtcagagttttactctccgatcccccttggatccccaccgctataacgtactactccctccgtcctaaacaaacgaatctaaaatagaatataccacatcctattacagtgaatctggataaaaggtacgtctaaatttgtactactagaatatgtcacatccagtactaagttggtttttatgggatggagagagtagctccatcctataataagcgcagatgtgggttttagtgtctaactttgaccatccgtcttatttaaaatatttttatgattaatagtatttttattgttgctagaaaaaatgctcgtgcgttgcaacgggtgaatgctattttaattttattattgttatacggtttagttaagatgaaattcactttcggaattcgcttggatatttttttagaaaatcatgaactgcaattaggagtctgactttcatctcaagttagcatgcgagtttttttaaaagatatttcttatacgactccttttatatttctaaaagcaaaaaaatttaaaatccgactcaaatacagatctatattttgaaaagcgaacgaacttaaaaaccgactcaaatacggatgacataccaaaataccggcaaaaacatctttaatttttataatagtaaagattagatgataaaatataaatagtactttatgtatttatgacttaacttttaaaattttttataaatttttcaaataagacgaatggtcaaacgttaggtacggaaacttatggctgcacttataatgggacggggagtattactgtaacgaatatacgctaacacgtggatccacccgccgacggcgccactccggccaccggaaagccgtctccgcttttctctggatggcggccatgcatccgccattgacggggtgaggagctccatgaaagcaagcggtggctcaaaggttcagagttcagaatgggcaatagatgctacggcatatccttgtgctctcacagtagcttgaagtcctgcttcatagtctgtaaaaaaaaaagaaaaaatttgatccatagcacataaaaaacccggtaaaaaaaatagcacaacaaattttccacttcgactaaaagcacagggcaccaattttcttgcgattcatagcactcccgtcacatttgtcatccaaacatgtgagttgatatgaaaaaaaactcatctacccttcttccccgagctagtgctcttctccctcagcgatgttgccgcgcccgtgtcgccgatgctcggtgagctgacggagccgcgcttcccgcccgtccgctcgcgaatcatcccaacgtccgccagcgcgcgctgcaacctgcctgcataagcggcaggtcatcgtccccgtcattgtcgtccccgtcgctctcatcgtcgtcgtcgtcacgtagaagcagtggcaagccggcgcggcgctgcgccgtggcgagggagaggctgttttgcggtgccgagtatggccaccacgggccacatccatccacgtcgaagctacggccgcccacgtcatcgtcgtcaagcggccgccggcgtgggaggcttgccctcgatcagcagcgccgagtgccagacgggatccacctcatcgtcggtggcgacggcgagccacgcacccacatcattgaagagcgcacgcgcagctcgctcggcagtggcgggcgccgcgcgccactgtccatgagggagcggaagagaagacctggtgggtaacgtggggaacgaagggcaaatgtgtccgacgaaaattttgtccactccgatctaacgccgttacttcaaaatttgacggaagtgttacaaggcgaagaaaaatcggtggcctatgctatagatcgaaagcggaaactttttgtgctattttttggtaccgctttctttcctgtgctatggattgaattttctcaaaaaaaaaaaagggttgtggaagaatttccacggttttcccaggtggattattattcacccgattaagtgagacaagaatatacatagctagtcagattgatcataaatagcatcgcatatatcagaataataagtatcttgtatcgttctgtattgtttggggtttgctgaaatctgaaaaatatactacacatgttcagagttcacaacttcagactgacccatttcaatctgcgcatacagagatgatacatattcatacttgttttttctgcaaatgttgtctgcaatcggaagtgtgcatacatgtgggatgtgttctgattattgcaatcggcagcatgcatccatacggctcggtttgtaggtgaagaactgaagatacaaagatttccaagagggttcggagttttattctccgaacaccttgggtctccaattttttttatcagtaatttctcctctcagtagagtaagttcggcccgataaaattccaaatgcgtgacatgtatgtataataaaatgaaatccaaaatgcctatgtttatttcggtgaatatatttacctacctgacgattcactgacgagcatgtatgcaccgctatgaaggaggcttcaagttcagaatgaatcagatcaatagacggtacagatacatacttcagacttgctaccccatttttcactgaagtacaccacccctctctgaacttctcatgcaggagtaggaaccacacaattgatagagagattgaattagcatgcccaaggggggtctgaacccccccttccttttttaaaaaattatcttctaactgtccactacttttttttagaaaaaaaaaacgaagcccaaataaatatgcacaagatcgatgcatgtatgcatgcaacagcttccatatccatgcatactgatcgatatggcatatctccagagttcagaaattcagaccaacccattttcttacagttcaaatctgcgcctgatcaacggttcgtttttcaaactatctttttctgcattgataggcaatcgtgtaatgcagaaaaacggttgcaatcacagattacatatgatgcgtacgaacgtgttgctaaatggaactaattcaataatcatacgcttcgtaggcaacccaaaagaggggtcggagttttcttctccgaaccctcttgcatcccccaatttttcaatttgtgatcttcccactggctttttttctttcttttttgaaaggaaggtaaattaggcccgtttaaattcaggcacaaaagcagcaatatgaactagtggctcgatcaaagccggaaactttgagacacctttgtgcctaatagatattctgctgtgtcctaacacaatagcaagttgcaatgatctgcttcacactcgagaggcatggaatctccattttcctttagagcacacaaccagatatactctgcaactttaattgactttgctatgttcagtatacgatggtgtttggttggaggggctaaagtgggactaaactttagtccctctcacaaaaatataaatctctaccatagagacttatacttttgtgagagggactaaatttagtccctagttcccaaacacccctatgtacctcaagatcatgcatggatgcatgcttgctgctgactgatcgatcgattgactgcaagttccaactaaaacagtaacgtgaaattgcgtctacaccaatgtgttcatccatctaatcttgaccgtacaactttgatcggagatcaaagggggtcggagttttttctccgaactcctatccatacacgacggtcatggatgcgtgcaggaagcttcaagtacagaatcgatcgagagatctacatgctgattaaatggaagtaatcagatatccaaaggagttcggagttttattctccaacctcctttgaatcccattattttttctttgatatcttcccactgactaatttttgttttgagagaaaactaagcctaaaggaaatttggcccggcccatctaaactggaaaaagttcacgtgcaagttcagtcttgacaacttcagaccggccaagttcaaataagcaccttaccgatggatgtttcagatgcaatgccgagaagagagggctgcaattgcaatggcaagctacatacgctcatatgtacgtgttgttaaatcctaaatgcaaccaactatatactgcgtaggcaactcaaagagggtcggagttttcttctccgaccccgcgttatcgccaatgaaaatcatctcgctgacttttattttttataaggaagctcggcctttaagtaatatttggtgagcctgaaaattaattgatacgatgatcacctaaacacaagtgcaagttgcaatgatctgcttcacactcgacaggcaaggaatccccatgtttgatcgggcaaaatagatgcagttgatgtggttcttggaagcctcctcggttcagtaactggaaagttgctgatgataaaaactaaaaagtaagacctaattatcgtcctctacactaatatatggattaggtccctatgacttttatggttatcgaagcagaagctagctactacaagattatggttgcaggcagtatttagaactacgagtaacagtaagcaggccacaggacaggagacatagtaattaaaatttacttatgtttcttcttcttcttcacagttcacatggaaatcagaaggaagtagcaaaaggaagagctgttctacactcgacagagtaacaaactaagagagcaacacaagtaacaagaggagagatttagtctcttttctggtgttctgcaaataaaactctcccctcttgctacccctaaaccccaacccaaggtagtagtaagtcaccccactaaaagtaaccggccatctcttacaaaaattggctgtctcctttgaatcaatcgaatcagatcatcatcatcatcatctacagctcgtcatgctcgtcgtcgacgccgccctcgccgtcggcgccgccacccggggcgccaccggtcctctggtagacggcggagatgatggggttgcagacggcctcgacctccttgagcttctcctcgtactcctccttctcggcggtctggttctcgtccagccactcgagggcctccttgagggcctcctccaccttctccttctcctcgctctccagcttgtccgccagcttgtccttgtcgccgacggtgttcttcatgttgtacacgtaggtctcgagctggttgcgggcgtcgatccgctccttcaccttcttgtcctcctccgcaaactcctccgcctcgcgcaccatccggtcgatctcctcctggctcaggcgccccttctcgttcgtgatcgtgatcttctccgacttgccggtgcccttgtcctcagccttcacgttcaggatgccgttggcgtccacctcgaaggtcacctcaatctggggggtgcccctgcaagtttaaccaacagatatcaggcgctggattcatttatccatttgagtaagctaacatttttttctggacatgagcaaaccttggtgctgctggaatgccagataggtcgaacttgccgagaagacggcagtccttggtcatgctgcgctcaccctcaaagacctacaccacaaggcgagattcagaggcgttaggtggtctgagctgaaattttctgaccaggatgtaatgtcaggactcaaagaagaaagtttgcttatgtctgttacctggatggagacggttgtctgctgatcctggtaggtggtgaacacctgggacttcttggtggggatgacggtgttcctggggatcaacttggtcatgactccaccgacagtctcgataccgagggtaaggggtgccacatccaggagaaggatatctgcgtaccaaaatcaaagcacgataagtatatgcaagacagatgatcgcagttgttaccaacccaaaggactatgtatgtgatcaaggtcgaacctttggtttcgtcaccgccctcgccgctgagaatgcttccctgaaccgcagcaccataggcaacagcctcatcagggttgacacccttgttgggctccttgccctcgaagtagtctctgaggagctgctgaaccttgggaatcctggtgctaccaccgacaagaacaatctcatgaatctggctcttctcaaggccagcatcgtccatagccttcttgacaggtcccatggtcttgcggaacagatcattgtcaactcctcaaatctggcacgggtcagcggctccgagaaatcggtcccgtcaaagagggactcaatctcaacacggacctggtgctggttgctgagggccctcttggcacgctcagcttccctcctcagctttccaagagcacggttgtccttgctgatgtccttgctgtacttcttcttgatcaacttgatgaagtactccatgattctctggtcaaagtcctcacctgaagagatgaacagttcagtcaaatatgaatcacagtgcactatccagataatcaagacgaccaactaactacaaaaggcatgtcattagtttaaaagcaaatgaatagtgccaatcttctaaaagacagcgtgcctttactgaaaagtctaatgagaatgtgcaggtataagataaccaatttaccatgatgtgttgcatgaaaatcattgaatcaaactacagtactctacaactgtgatgttgtacagaagcagatatttagtacctaagggcaaataaaagcagtcatacctccaagatgagtgtcaccattggtggccaacacctcaaacacaccgttgtcaatggtcaagatactgacatcgaatgtcccaccaccaaggtcaaagacaaggatgttcttctcaccacccttcttgtccaaaccgtacgcaatagcagcagcagttggctcattgatgatcctagcaacattcaggccagcaatgacaccggcatccttggttgcctgcctctgcgcgtcattgaagtacgctgaaaacatgaaagagcagaagtgagcaatggcttccacagaatcaccgcttgagttaactaagcacatgaatgtcttgtcattactaaccaggaacagtcacgacagcatcgttgatcttcttgccaaggtatgcctcagcagtctccttcatctttccaaggatcatagcactgacctcctcagggctgaagaccttgttctctccatccttgatcttgacctgaatgtagggcttaccgtccttgttcacaatcttgtaggggacaagtttcatgtccctctgaacttccttgtcttcaaacctgcaagaataattatacaggtcagatcaggcagcagtgatcaacaacaggaaataagagcgagcatagggtaaagtgccattactttcttccaatgagacgtttgacatcgaagatggtcctctctgggttcacagctgcctggttcttggcagcctcaccgatgagcctctcgctatcggtgaatgcaacccatgagggtgtgatacggttaccctggtcattggcgataatctcgacatgaccattcttgtacacaccgacacacgagtaggttgtaccaagatcaataccgatcacggtaccgagcttcttggtctcctccttcgcaacagaaaatgcaaacagggatcctgcaaacagaggagcagtggcagtatgtaagctacatgttctatcaattcaccatttatcgtgtattggcacacatatacacaggcatataattcatgtgattttaaaacagtaacatgaattatgagaccaagtaagtttctaaggtgaaaatctaggcagcccgtttcattcatgccattctagcacattttgcgcctctaaactattcagtgttgccctagaaatattttactactagcatattcagcataattgtgaaggtaaaaactctaccgctaccaatgcacaggacagatcatggcatcactgcaattaaaccagtatctaacaaacgaattccaacaaaatcactgagcactactaggataaatcataaataaaccccagatcacatatttcttggagtcgccagactcgccgccttcacctattggtggcatctaagtttaatcgcacctcaatttgtgaagtagtacaaaaaaaacaaatatcaaatatctcctaactaactaccacgatccatacgatccatcagtgtcactctaaaaccatttaccggaccatctcgttgagaaaaaaaaaaactactcccggatccgtgatccagtggaacgaacattcacagcccatcttagatcgaactccagcacaacatcaaatagacaaatctaagcgcgcgcaagcacagatccaaacgaggaacggggagatcgcacctgcgagcaggacgccgagcaggaacgcgcatccgcgaacccgatccatcgccgccaacaccaccaccaccacgcgctcgtctcctcctccacctctctctcgaagcttctcttctcttctcccttgtgcgagtttgggttgcgatccgaaaaccttcaagtgagtttgagttttatgggttcgtgggcgatttataaggggagatgacttgaacgggccgagatctagttgcgcccccgtcgcgttggccgggacgtcatgagtctgacctggaccagtccgagcacgacacgtggatgccccaaccaatcgcggtggtctctgtgctgggggagttgcggccgtccgtgggatcgatccgacggcggagatcgtcccacggcgtgaagtggtgggattggttgggtggcgtggctccccgctcgcggctggtcgggacccgtttactgggcgtggcctccccggcagctgacatgtggacctacttttttaatcggcccaattagatactcctagtttggcattagtttgaaccggtttcgtggatttgccatcacaaataaagggttgttcagattactgttaaaatcaagttagtaatattgtcaatttggtaaattaggattatgtgttgttgccaaaattttcaatgcaataatatatttgtcaattttaccgaacaatgttatgtcttaaaattgcaacaatctcaacaggcccaatgtgtaattgcatatctccatcaaaaacggttgaaacccattatacttgctattgaactgacagattagacgaataccattagaaaattggtttttattaagattagggcaaagatgcctttttgttgacgaaaaaatcgcacactgacctgggagatctgcttagctcctgtgcaggtacaaatcttgatgagatgtgggcgttccagtcaatttgatcctgcaactaacaagatatgcaaatagtagatcaaaacagccgatcggctaacaagccgatggagtagttatagctaatcgccaataatagccgatgctgataccagccgatagcgatagggtttagagcaatcggctatatgtccaatgtagattctaacactttagtaaataatgttatataggcaatcggctactgataataaaatataacaataatatagtccagtataaaccaatcggctagcattgatatgataaataagcatcgatccgaaggttaaagcatatatcggctggaggtccgatgtcatgaaatccacaagattatattaaacagtgaaacctctgttgtcatcggctaaatccaacttatatgtatatacaatcattatgagccgatgcaacgtccagataactcatcggctcaaaccccgatgaaacccttattggcagtcaaaaagcaggctagagattatggttctaaacacgacttagtagatcaaactcaactgatgcagcactaagtatgaaaagaaacataatatctagacaatcaagccgttgactaagttttcagagtggtagatgtctaagctaatctaatctagcaacacgatttagccgataccggcagaaaccctaaaacgagaagcaaccgatagagctaaattgatatgctaagactagattaacagagacatatgataaataggtaggcaaatatatcatcgaaaccagagcaatccaagaggtcgaatgtactgatgcagccttgaacgacgccgatatagatgagacaattgcttgggccgacggaacattggacttaccccttcgctggagatcgaacatcgatgcagccccgcgtcaggtgccaagtcccgccggacaataaaataaagtagaaaaggtaaaaggggtggcaatgcgacgaattgtattgatcgtgaggatagattacataggccccgggtgtacatatttatacccgtgggttgatacaagtccttgtcggacaagaaagaaactaacctaaagataaaaggaaaacataaagtccttattggacactaaacacactttcctaaagataaaaggaaactaacaaactatttctaattaatagataacttgccacgccgcatcctctttaaactcggtcacttagggataagcttcctttaatagattgatttccttaaccgaatatagcaggaatccgactattggcgacttgataactcccatcggctgattccgagatgctgcagccgataatgattctaagccgatgacgtctttgccgattaccaaatttcactgttaacacctttcccatgaaattgaaagattaacacaacttatccaaaatctagctattgacaaccttgactacacaatacaacattgatagaaggttacaaccatcttcctcctcctcctgcaggtgatgtagtatggctttgttgttgttgcctccttttttaatcctattaagcatatcactaatttattggtagtggattctaaattctcgatggatatcctcttgttgtttgcatgtcacctaaatggttacgagaaaaaaatataaaaaatcaacaagatagattaatatatgaaaaatcacttcacaaatatgtaagttaaaatttaacttctacaagttgcaacggaaaaaaaattaaattgtggctagttaatgtatattcgcagtcaaatttgtttttcgttgcaacctgtagaagttaattttgacattgcatgtttgtggagcgatttatcacatattaatcaatcttgttgattttttttaaaaaaatcataactatttaggtgacatgcaaataacgaggggatgtcccctcaagagtttaaaatagtttcccttttatcttatactaggagaaattttgaaatatcacacttataactttattactatcaaatgggtcaaattatactaaccttcgtataaaaatatgagctagaaatgtctgaaaaagttatattctggtacagatgtggtaacattttttaattggaagaaatttcacccaagaaactcattcgactgaataaattgaggttgacaatgtccatcggacagtagtacaagacgcaagtttaagcagacatgtgttgacggatacagtcccaatttgtcattacgccttcagaaaatgtgactcttcttttgaccatccaacaagatactacttccaaacaaaaacatgctcatgatagtggttgattctttttggacagagggagtagttatttttgcacaagtagggataatttaaacaaaacagttgcttcaggtacgaccttgtcaaaaagaaaaaagcacttgccatcacatcatttttgcatggattcaacaaatcttacactatggagagcagatttaaaagagagaatgtctagtggaaactgcaacctacgtggaaacatataaactacagttggatagaaaatgtacatcccatatatgtccacgtcgtccaagttaaaatattcagaaaaaacatcacctgattctgacatttagcatctcagtccccacatcaagcagtatcctgattcaaaagacatatccccaaatatgatgatgtggtagtgagggcaagggttgcggcgcgggggtggccactcatggaaaggagatggcagtggtcgctagcagcgccaccatttcacgcaagtcacagcaacacgaatcaatccccattatgctccggtgatgtcgaggcatctaccaacggggttgcctagtatttgtcgtttgctcctccaacattaggtcattatctcctcttaatccttgctatagtgaatgcatgttctttcatgggatatgcttcttgttgatttggacaccttcccaatttcaaatgagctagggtttcaatgccgccggcactcccaatttcatatgaactattgatgctgccaagacagctacaacttccatcgcatgtccttccctctatcttggaatattccctcattggtagaccagaaatttgctcccacacaaaaggtattaatggtgttcctctatattgttgatgttcgttgagtttgtgatgagctagtcttgacactcttctatgaatccatctctctcacaaacaagatgggatcagtttgtgttgatgtcttggttgctttgagccccccattttgttgtgactttcttgcttggggaaaaagcatattattttcattaagaaaacctgaaatgttttcttttcttcttttctttgctagtaaaatccaagtactttgttgggttgttatactttcctaataagtgaaattaattgcagtttattattgtttcggtgcatcaatagattccatatgtatggatgaccctctaacattcttcttggaatgggttgttagcattatatatggaaaagtaattatatatggaaaagtagggaaaaagaaggaaccattgtgttttggaaacactttgggcgttgggtaaatggtgtatatgaaaaatgtacacaacatgatgaggagagtattttgtaaaatgtatcgtggggatggcggggctgacaagtcttcatacaggctgcacattttggatccaatgatccacgatcgaatttacaattttccatgtaggttgcaatttccactaaatacatatttttcctagatcttacaggcactcttcaatctaacttctcatttatgttatagactatttttcctagatcttaccggcactcttcaatctagcttctcatttatgttatggactatttttctaccaagtacaacacacgggtagcaatgtctgggtgatttcaacaacaacattaaattcgctggtataatctacctccatgtatgcctttccttgatgctccaccaggtcacttatccgttctgcaactgatatttcacaaacaataacaacaaatcaaacaaagacgacaaaacaaggaaacaataacaacaaatcaacaaagatggcaaaacaacgaaacaataacaacaaatcaaacaaacaaagagggcaaaacaaggtatgacttactgaattttttcgtaagttgcgatgctgatcctgctaacgatagcctatatattagctttgttgctcaattcatactcaatttttttcagaacaacatcaataaatgtccttggatgggttgcaagataatcagcaattaagagttgctcacgcggtttatacagtgttttatcctataacctcataagtaatagtaggtcaccgaccccctttgttatgtctcattgtgtagtacccattaatagacccatgcacatttgaattgtctgtccacacaactaagttgtcaattcccatatcttcacatgttatgaaaccaaattcaactccataagctcatgagtatttttacatgaaatatctctaaagaacttggcaagttggaacttctcctcaaaccatatggtaatttaaattgttgttttcccaatatttcccgcttctccatcacgaaacaatgcatcaactaataatttatgaaatcctttaattccatggtcaaaactcagtctcacaattgcctaatttatgaaatcctttaattccatggtcaaaacgtagtctcacaattgctgatgttattcaagaagtgatcccactcggcacagtccacgtaatagcagagaaagacattactcaacattgtaatagctaacaataatcaagcaaaagaactcgcgcatacatatgcggtggcatgtacggtggtatgcttatcgatgagctaaagtaagaaaatgttcacgataaaattaaatacataccacctaaacctcgtgatgtagaaactgcaaccacctgaaactcatactaatttttacctatctaattccagcagtaatgtgcaagaaaatttgaaaacttattcagcatgaaggcttaacatacattggataaactaatcaatgtataaatgtcataaatgagctaaaactattgcagaaatgctgctgagataacatgaacagcctcttaaatccaatgttgagacatgttttttttcttctggttttcagttgtactcgcttttcagttggagactaattagaattttaactgatcccaaactaaactaaacatatcagttttgtcatcgtttatggcttcaccaaaataatgctattttgttctgcaatagattaacaagcaccaaggaaccagaaacacgcaatataaatgatcaaagccagagaaaaccattgaaatgcaaactagtacaaaataaaggtgcaaagtcatgtcccctatttaatatattgctatatcactacgcatagagcttatgtaatttatcccgggttgtggagatgcttggggccctcttctcaggccccctaccccctcttatataggatgagggggagggtttacaaggaaaatatctagttgattgcaactagatctccttattctatttataaaagatatgcatgatccttgggatttatatcttatcctgggaatatctcttacttaatttacaagtagcctagggctcttggcccaccctatgccacgtggcccaagggcctctccttggttacccgggtaccgtgtaccccacaaatttagaatatgatttttttttactagtgcgagaaatttcatcctgctagctattgctgcaacttattgaaatctttgtgttcttttttagtgttagaaagtatgacgtaatttgttgccttcatttgcaagaaaatcaaacaaaacaaatcaggtgcatttagatgctattgtccatttttcttaatattgtatgaaatccattgcatttgtaaaaactgaaattcgaattattgaataaccaaagattcaatttaaatacatgagtgcgttgtgattcatgatccataccttttgatgcttctagattccagttcagaaagccgagacaaggcatacttcatgaaacccaatacgcttccattcgatgtgattgtaaccctgtaactatgttagcaaactgttctattgcctaccaagtaccaactcgtatggtattgtcacaattttctttaaattcattcttttcaccctctcctggaaaccattggttatatgatgaatgatattgcatgatatattaaatgtgtctatatgatatatgtattgaattctcccgtttcctttttcatttatcttatacaaaggcataaatgtcatgcagttcccaatgtcgaggtccttgagcatgtttcatctattcttaaggattttgggttttgcctcactagagaaggcattgatgcgagaaacctgtattgctctttttttttgcaatgattctgcatttagttttcttgatcatgtattattctttctcttattcttgaagccgtccctatgactgcaattttacaaaacatctgatagagagttacatgataaaggtttgtgttacttatttctacctttactttttgttacttttgtgaagcgatttggtatgtgggcggcttttcacataaacagttcccagtggctctataagaaagtcattaagttaagagaattatatattatatatttacaatccatgtggatcaaattccaaaattatataaatggatagaagaaaaaaaggtaaattacatatatcgagcgagggcattttgctagtattaaaaagagagatgctagaagtatgctttctcattgaaaacatttatatttacgtcatcctttttcactttcttggtgctcgtgggaaagatgtttctgccatccctgtctgatttatcatcttgatatgttagcaagaaaaaagcaagcagcaagtaattgtcaaacaacaaggcccttcggtactgctgcattcatgggcaatggatattctcgtaatccaaatcataatcttttgttggaaagagtttggaaaccaacaagtaatcatcaatcaagtaggctctttggtactgtcacaccccgaagttctcctccaagcctaaatttaatttataaatgaccctaagaaaataccggtgcaaagcaagagtaaaccccttttaaatcaatgcaagtaataatcggaatgggaatgtggaatttttcttgagttctacatgtcgaaattcactaacagaatttttagtgaaattttcagagccctagaaataattttaaccaattaaaattgagcaagcaatattttaattccagggaaaatcctttttttcctttttctttttctttttccctccctttttcgaatgggccgctggcccattctctcctttcctccccctcctccctgctgggcc

SEQ ID NO: 44323 - DNA, 2737 bp, Oryza sativa
cgtcgagtttcgtcaccggaattcgcatcccctcgcgctccggtgagttcaaccgctgccgccgccttcggccatgaatgccggtcgccgtggttcatcttcccccctctaatctctctcttctccttccttagggcaccccgaagctcgtccgccggttgccgtcgtcctcccgtggcttgccgtcgccgttcgccatcgtcttcctccgcgccggccaccctcggtgaggcatccctcccctcttttccctttcctctcctcctagtgccgcgccgccgcttcaagtcgcgcgccgtcgccttcggccgccgccaccgcctcccatgccgccggtcgccgccgtcgtcggccgcgtgccgtcaccgctagccctggccggccggtcggctttgatgccgagccgagcccggcggccgcctccatcgccgcccgtccgatcggccccgagggcgatctgggccgtcggttccgtggaccggcggtggaccacccgcgtggtcctggtccacggtgaaccgccctcccccttgagtcgctgaccggtgggccccgcgtgccggcgccccttcctccctctcccgagccgctgaccggtgggccccgcatgtcggcgccgctttcccccgtgctgacgtcagccctggaaaatattgcgcaataaattatttaaggattttgttatagtaataaacacagtgaatcttctaaaattcataactaattcatccgagctccgtttcagcccattcaagtctcagtaaatcaagaaaaatgtgtagaatccattaaaaatggttttgttccctgtttcagtagtcttatagcctgtttgcaatgtttgctttgtatgtcgctagattccggttcatccgacgctccggtgtacttcgaaatagtcgccgaggttcctccagcagcagagcaaggcaagtcatgcttgtcacttgaacatgttgatcctatattgcaaatgctctattgttttctttcaaatactgcattgttttataatgtttctaggggatgtttacctattgtcatagccatgctattgttgtaccttgtccctttgtcagcttggggttataacatgattagagtttggactagggattgcttagccatgcttagttcaactagttcaatggggaagatcttattaatgtttagactgttggttctaatggttttgttggattagtgccaccgctttggtgctggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaaaggtcctgtcatggcctctttccggtatgtcgtggtggcatgtcggcgcacggaaacgtgtcgtggggctgtgtcttgtgggtacagttgtacacctctgatcagagtaaaactattcgaatagtcgtgcccgcggttatgggcggtcaaccagattcaccgtgattagtctcaccctagtgtaatcttttgaatttggatagtttgggtggatggttgggcctgttgcaacgtgggatggcgttggacagtggatagtcaatactaattaattattacaactgtttaaatctttcaacttctgtttataaatgctcgttttatgcaaatgaaccactctagctcttctttgataattccctgcatcatacccctattccggtatgacttgctgagtacagtgggtagtactcagtcttgctctatttttcccaaccccagagcacgagtatgtgtcagatgaaggtttctccgaggagtaggcttcgtccgtgccgtcgaggatgcctgtggagtggtgttcccgctacagttctagtcaaggcttagctcctgttgtctttcgtttttccgctgcatttatgtaagacttttatgatgtttgtaagacgtggatctgaatgtcaacattgtcgtttgtgtaccccggccggtcctggacggggattttaatgcacattctgcttgaattctattcaggaatttctgggcgtgacaggtaccgaacgaattgaggtcgacattgcccatcgaacagcagtacacgacgcaagtttaagtagacatctgtcgacccaatttgtcattacgacttcagaaaatgtgactcttcttttgaccatccaacaagatattacttccaaacaaaaacatgctcatgacaaatacagttatttttgcacaagtcggaacaattgcttcaggtacaaccttttcaagaagaaccaaaacttgtaatcacatcattttttgcattcaacaagtcaaataattttgaggttccaagaacagtggtcaaaacagtaaagaatcaaaatacttacaactcacaactcaaactgcgccattatgctacaaatatatactactagtaggcttcctctaaaactgctgcactttctaaattcagaccaactacttacaacaaaaacaccacggccatctaactaccaacgtgagtgggct

SEQ ID NO: 44324 - DNA, 929 bp, Oryza sativa
aacattcaacatttgtgaatgtcttcatgcagcgtggttcacagcagactacttccacgtagtccaatttcactgccagaacagcacaaattaatttaattctggggataccattagcatgattaattatataatgcatggattgagctgcagttttttagttctgaaatttacaaggcagcgcctgatctactataagtaactgaggagataccatgtgattcttcatgtttcttcatctttgaagcatacttgaaaaccttgttacagccctcctccttgcaaacaaactgccggttgcttttagtagcagtttcatcctcatggatttcctttacatgcctttgcatatttgcctttatactgaacttcctaccacaaccatccatagagcaggtaaacaacttcccttgatgcttaagcatatgacggttcaagtgatctttcctaatgtagctgaaagggcagtcttcaagtgggcaaatgaacgatctctacagtcaagaagggaacgagtcaaaactgaagctgctgtaagcttacacatttctttcatacttataaattatctaaaataaattatctagtaaactggttaacggaatatgcaacgaatacctaaatgttcagtgttttccattaagatgatagagataaaagggagtataatcaccatagcgagctgagaaccaatgatgaatagtcctagctttctgaggtgacattttgatgttggatcctctcacctcttctcaaagctcccaaaaggagatccaaagaaatagtaggatgaatgaaggatatttgctaaccttattctccaaaggatccataacctattctattcaatgcctactccctccgtttcaggttataagaagttttgactttagtcaaagtcagactacttcaagtttgaataattttat

SEQ ID NO: 44325 - DNA, 13309 bp, Oryza sativa
  unsure (1)..(13309): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgatggagctgaaaatagaattgcagaccatgtatgctgccatgcaagatgctttcccattggtacctgaaaaatcagtaggtgtgagtaacagttctcattatttgaagaaaccttagggtgttattacaaatgcactatctcatagctgaaatatagagaactgtaatgaaccccatttataccctaaatggtttttcaaccttttctgccagcattaatcattcaggaagttcaatgcagttagatatatgtggtttgctcaaaggtagaatatggtactgaccacaaagctttattgcaaattcacatggtgggatgaacttgttgatcctgtcgtaatctgattttttaataaggttcatgtccaatgcataatcggtgtaagctttgtactggattgctggatccgtgaggccattaccgatcgcaaaaccctacaagaaaaataggtaaaactgtgtaaaatagcaaagaagcaattaagttaaaagatatggcaaacttgggtaaggatcataccttcaagtttatgtgaatgccctcgtttgctttgtttccttggtgaacccggcttgcgaatgctggaatgtagtgcccagcataagattctccggttataaagaagtcattctttgcaaactctggatgcttcttaaagaacacctgacatgggaatcaagcaaatactacatattactctacatttttgctgaagtcaacaacacaaaataatcaactctcagatcaatacacaactctttagagagatccgtgcatattatctggtttggtgctaaatcttcggaagttatctactaccgctaatttaatgaagctatccagtcaaatatgttaggtacatcctttcatgtaagcaatgccaaattccaacctggaaatttcctatggtattgtagcaattaattttacaggagcatcatatcaggtaagagaaccactccacaaattgaggatgaaagcaataattaggcacaccagactgttgactgttagttacttagtcaagtagagtatgcaaataattattttgtgaaatggaactattattaagagcagagcctgcagttttaaaacaaacatattgctatgattactttacattggagatcatttatgtttctttattagtatttagtattgtaaaggaatggattgaacaagcctatatagtgtaatcagatatcacatggaattgatgaaacaaagagaaaaaggcaagcacgtcagttacaagggttgagagtagtacctgaagaaagctatataggtcattgctgacgcctgtctcatcatgacgagtatcacgatcatcagagctatagctaaatccagttccagtgggttgatcaacaaaaattatatttgaaatctgcatgaagaaagttttatcagaaggggtggatacaaaggaaccaaaaggtgtgtaggcttgatcattgtaagatgtgaactgactgcagcaatgaccactgccattgttaaactcatcatgaaactagttggaaaggtctaaaaaatcatagtaggaattaatgttcaccaataacgaacaatactatgtagggaaacattgtcctcaataaactcgtaaacttctgctgtcgtgcatcagttcatgtaaaaagcaataaaacttaacaaagactattgtggtggcataagagatgatagtcaaatggaacacatatggtaagttggtaacaacctaacagatagcaacaatgaagttctagccccagatggttttcttcaactaataagacactaaaaggcaaagtgaggaacacaatatagtaagttggtaacagttatccaaatttggtaacggaggatagcaaggatgatattctagacaataattttttcccccttcaacagttactgacttcaaccgggagaaactctgaaacggacattattttcactattgcttgcttaaccaagctagtcattcagtcaacaatggtcaaaatagttttttcatgttgctctcaccacaagattgcttgcaagcgatgatgcaacattaacaagttaatattatgaccaagtctgagtcgttaccatactaaggaaactaaacatatgatgcaatcaataacgtattatcgaatcgatggatcgttaccgtgtcccagccgaatttgttccaagcaagcgacatgttgttcgagatggtgaacgggccattctcgtagaagacggccagctcgctgctgcatccggggcctccggtgagccagatcacgacgggatcctccttcttccccctcgattcgaacaagaagtagaacatcctgcaagcaacgccccaatccatccaacaaacaaacactcaacccaaaatttccaaaagaaaaaaaaaagagagagcaagaactttgtactactttacaactaatttggggttcgaaattcgaaatctacctcgcgtcgtgcgtgttggggaggcggtagtagccggcgtggtggccgaggtcgccgaccccctgggggagcccgggcagcgtgacccgccgctcaagcagctcgccgggcgccacgctggggacatccccggcgccggttggcccggcctccttgggcagcaggttgagcgagcggatgagccgctcggcctgcgccgcggggaacttggcgtcgcggggcagccggagcccctccgcgcaggcggaggcggcgaggacgacgacgaggaggatgagggagacgcgcgcggtcgccattggaggagtttggagattcggagaggttttccctccgaatttatagcgttcgcggttttggtgtttgaaacggactggtttattagttttagtttttttttttaaacgaactttgcttccaatgcaatccaagcacagccggattccttttcttttttttttctgtttttggtttctttttgccttttcgagctcgaatacgaatttgtcctcgtgtggaatctgagctgattccgcttaaattcgtattgtactactacttacggttctatttctctgctcgagtggaaatcggaacagaattagtaacagaattcagcttgaccaactgaatttgcggctcagttttgatggcattgcatgggcaaacatttgcccaagtcgaaaaatacaaagaagatcagtttggtctgttggctggtgacatcttgagatttaattcaaaggaacttttctgacatctggtaccgactgaattaacttaaaaagaggtttgtgcaggctagtacgaaaacaaagagtgctgacatatcagtcgcagtagtttcagatccgtaaaatgtggctgaatccacatctgcatgactgaatttcggttccctgacatttaatctcacaaattgtagaagatgtgtgttttcggcatggtttggggttgcttgaaaggctggagaatgtgatgccccaccttaacatggagctgtccttatctcggcaactcgatcagttaataatagtttcactttcaaaaatcacatggttcagatgccactaattaagaagtgaacatgctgctgtgctagagaagctaggctgtgtttagttccttctaaagttagaaatttgggttgaaattagtacgatgtgactgaaaagttatgtgtgtatgacaggttgatgtgatggaaaaagttgaaagtttggatctaaacacaaccctagtagtatcataaaacttttcgcagcattagcatcaggccacaatgcttgacagttgacagtatcaggaattcaggaattcgttcatgtaaaaagtacatcacatcaattgtttcagaaggcatgcagttgacatgatggagaggctgtttatctgctaatgtaatcgacagtaacacgcatgcagtatctgcactaattgttactacacaggagtaagattgcaacacgcattgctgattacgactgaatctgtcagaatcagtcctaagattttgggagcacattgctcagggatcattgcagcaataattatatcgacgacgagttccttgcacgcagcagcctcacgagccttgacgcatcatcgatcagtattagtagtagtgtcagtattggtttgggtcgcaagaattgcagagaggcttgcaagttgcaggttgctttgcagctcgtcgttgcttcgcttttgctactagcatactacagcaggagtactaattaacgaacaaattaatagacagttagctggagatatggcctgaagattaaggtgttaggtatcgccgaaaaaatgtagatcagcaagctgcctctgcctgcttaatttgagatcagcagcattccagcctacgactcgtcaacgccagttcgtgattgctcgttgcgtacttgcgtcacgtaatcaccaattgtgttaaagatttcattttctttgagaggatattgtgttatgaaatttttggatgtttatttgtggggttgcaataccggcgttagcttgtgagtactgaagaattctgtctgtccaaatatcatccgcagcgaccaatcaggcccatctaatatggacgcacagacgccgcaatccttttccaggccatattttccaaggaaaaagtctactttaggtctctcaattatggtgagttacatttacaccgctcaaccataaaaccaggtaaaatccctcaactatcaaaaccagtacaaatcaagtttctcggctgtttgaacggtgatttcatcctatgtggcatctacatggcacgttgacctagttttcgtttggcgtggcacttacttgtaattacagtcacaaaaagaaaatataatgggatccatatcagttctcatagtaatatgagagttttcaataggtctgcataaaatacattttttggggtacgggtaaaaatataaactagtggcatgtatcaaactattatgaaaattgtaatagcaaaatatcatttttcaaaaaccatcaaattgacctttttttaattatttttctgatttgcttgtcctctaatgggagatccattgcacaagctaaatattttgttttcccttttcccttgcatgctgagttttggtggcctttgggctgccagttttttttttctcatatatcgattatctgcttcagctgagaacttaattagaatatgttgttgttgaagcagtgcaaagaaatgagagtgtttgttacttggaatcctccagatgttactgttgtcatggccccttttttttggaatgctagataccggaattccgtccggacgggatcctttttgtctccttgcttattcaaagaggagcgatacctgaccatgcacgtcctgagcagcagcagcctctacaggagccgctccagtgcgcacgcatggttgacatgggcagtagtgttgcggcgcccacgcccgccctgtcgacacactgccccgcgaccgcgagctcctcgccggtggatgaggaagtagatcgcgaaggtgctgccctcgctgccgccgtcggtgcggagcacgacgagcacatacttggctaggcagaggacgcggccaccagcgacaagctccgacgtggcatggacgatggaggatacagccatcgccgacgagctccgtcgtgggacgtggatgacgaaggacgcggccgccggcgacgagctccaatgtggcgtggacggtggaggatgcggtcgtcagcgacaagctccggcgtggggcgtggagatggaggacgcggccgccggcgatgagttccgacgtggcgcggacgatgaaggatgtggccgccggcgacgagctccggcgtgggacgtggacggtgggaccaccggcgacgacgctttgatgctcggctcctgatatctagtaggtaacgtctgatacctcacaagtatcaccttttacgtggtaagaatcgcatgatacctgataggtatcacccgataccggttaggtatcaggacctgataccttaaaagtatcatcctctaagtggtaagaatcgcatcataccttatagataccatctgatacttcacaagtatcacctgatacgtggtagaatcgcatgatacctgataggtatctcctgatactggttaggtatcagaacctgatatctcacaagtatcaccctctacgtgataagaatcgtatgatacctgatagatatcatctaatacctcgcaagtattacctgatacgtggtagaaacgcataatacaggttaagtatcaaaacctgataactaaccggtatcatcccattcgaaaacgggattccgttgtatgacagccgcttttttttctcttttctttttctcaaatgacattagatttatataccaacttaggggcgccaagtggcctaatcagctggtaggtggcctgccatctttagaaagatggatggactaatcaattggccttgggcttgtcggcggcggcggcgacccggccgtcgttgccggcgagcttcatgtacttgtccttcctggtgagcgtggtgcattggaaccctagctccttggcgatcaccctctgcacgtggttcgccacctccaccgcgctcctcccgccggcgacgcacgtctcctccggcctcagcgccggcaggaacgtcacctcgtaccccggccgcgggttcatgtagaagaagtaagggtccaggaacttccaccccctcgccgtcgacccatagtacgtcccctgcctcgcctccaccgccaccggcacgatcctcgccgtcagctccgcgaacagcgccgagaaccgcagcaggtacggctcccggcacgtcgtcccctccgggcacaccaccacgtccccctcctccagcagcgccgcgatgcgcgccgcgtccgccgcgcggtcccgcgtcagcgccgccgcgcggatcggcgagatcgccgtcgacagccggctaacgctgtacgtcacgcacgtcacggggcggcccagcgcgatggacacgatgatggggtccagcgcggtgcggtggttgcacaccaggagggagcccggcgtccccgggcgcggcggcggcggcggcgccccgcgcacggcgaggcggatgccggtgaggcggtaggtgtggcggacgaggcgcgccgggacggggaggttgaggaacacgcggaggagcgccacggcgaagcccacggggaggtaggccagcgcgaacagcgcgctcgctggctccgggcggcggacgaggcggccgtcgtggaagatggcgcgcgacagcagctcgtcggcggcggcgcgcggcgcgcgcttgttcttgggcaccatgtaggcttcctgcgcattggcaatttggcgccaaaacagagttagcacactaaggctgtgtttagtttcacatcaaaattgaaagttcggagaaattggaacggtgtaacagaaaagttggaagtttgtgtatgtagaaaaattcgatgtgacagaaaagttaaaagtttaaagaaaaaagttaaatctaaacaaggcctaatttttacaaatatctggctttggagtatattcatatgtacattttgaacacttgtcttctttttttttcgttaaataaaaacaaatattgatgatgggctaggttgcattctgaatgtaagcatgaaattttagtttatgatagtctaaccaattaaaaattgctagtggtcaaagttgaaacagtagagtcaatattcagagtaaatgcaaatggagagagtactaaatccacattaattgatgcaaagaaaacaatactatatgagtaaagtgatcaatgataatgatattactataacaagtcagcatgagcaaacaatatttgaatataggagtacatactaatttggggttttggttttaaaaaggacgaaataaataggaagcaactgctaactgcctactaaaggaggtgatggtaccaacagtattgagttttggccacaagttttgcataaccataatgtaaattctagagccttcttgatctttcctatgaaaagaggggaaaaaaaggcaattcaacaaaaaaaaaaggcaaaaagctaagaagcgtacatattcttgctactcgtgctaccacaaatgagccaatcggatcgaagccatgaacactcgaagaacaatcgagcgtgcaattcctaccacaattaatttcacaatattttctttttttatttttggcgttctaaatgaattgttaaattattagtggccacatgatgcaaaacttcaattttgttcatgtgtgattgattcaattcaagaaatgatgaaaatttcgagctttggatcgtaggccatgaagtgtaccttgcagatggccatgaagtcgtggtcgctctcgcggtcgccgaggccgacgtcgggcatgtcgccgccggcgaagagcctctcgacgacctcgcgcttcttctcgccgacgaggacggccttgatgcggccggtgaaccgcttgccggaggcgaacgtctcgagctcggtgccggccacctcggcgccgaggaactcgcgcacgaactcccccaccatgacggccggcgacgcggtgaccacgacgcggcgctcggcgcagccgtggaacaccgcccacgtgtcggcgcgcaccccggcggcgtagtggcgcggcagcacggcgcgcgccacggcctcgacgtcgcggacgcgcagcccggcgaacgtgatgaacacgagcagggcgatggcggcggcctcggagacgccgacgtagagcgcgaggagccacggcgcggcgagcagcagcgccagcgcgcggaggtagctgccggcctcgagagccacaaggaagtagtacgggaacgccgacgacgacaccagcagcgtcccgtcgaggtccgccgccaccgtccgcctcgcgcccgccgccgcgtcgtacgccgtcaccggcggaaagaacctcctcctccccgccgccgccgccgccgccatgtcgctcgcagtcgccggcgaggccgagctcttcacgcttctagtagggcgatggagaagggttggtctgtttgttgagctgcttcgtctgcaccaccgcggccatcgatggcgacgtcgagcttctcctctgtttataccccttctgcaaaaaaagccatcgaatccgactcggattacgagcttgtcaattacgcgatccgaattggacttgggttaaactaaagttgccgccacaagactgattaatcacgcacatttcagacctcacaagactccgatttaattggttaaaaactttcagccactgttacatttgatcactactccatccgtttcacgatataagtcattctagcatttctcacattaatattaatgtgagaaatgctagaatgacttatattgtaaaaaaaggaaaaggaagtactaattttctccaagaaaagattcgagaagttgtatttatactggcggtatgggaacgcaggtaacgcgtgacaggcggcgcgaaacatgagaaaaaattgcatcgagttgtaatcaaatttgggtcaagaatggcacgcatgaagataaatggtggattggattattcatgaggttttggtgctggatcgttgttcgtttggatttggtcaagacgtacgggcgttcgtcgcaacgttttcggagtgtcggggcaattagtgagagcaaatgaaatgaattactagttctttttgtttgagagagaagcaaatgaattagtttgatgtgtgtagctatccgtccccgatataaacgtgagacgtgagtgaacgagtgatcaaatggaacaagcatccacgacgagaagactagtagtactactaatgtgtgcatctatgtggatgacaagggtttcctaaaccggcgccgcgcggtaacagtaaaaaaccgtacaaaatttattaaaaatttaaattattttttaaatttatttaaatttaaggaggttaccgtggtattgtattaccgtacctcgcggtaaggccggtaaccacggtaaccacacggttaccggcggtaaggtaaaccctacatcgacacacatggaggcatacggctacagtttaacagctacttaggcaggaatgtacgtatgtgcgttgaagagtttggcatgtttggacttttggacgttggacagaagaactgaaagaaaatttaaacaaaaaaaaaataagagaagaaacagaagttgctgtgcagttaattagcgtgaagattactagcacgggtggttgatgcggatggccaaaccattaccttttaccaatgctgctgtgagcatgtgaattactccctcattctttaaatgtttaacgctgttgacttttttaaatatgtttgaccgtttgtcttattcaaaaacttttgtgaaatgtgtaaaactatatgtatacataacaataaatcaaatgattggaaaaaaaattaatagttacttaattttttttaataagacaagcagtcaaacattttaaaaaaagttaacggcgtcgtacattttgggatggaggaagtatatatttcctccctatgtcactgtcaatgcaaatgggtaggcaaccataattacccaacccagtcttttgttggtccacggcagattggcagtggcaccatattcctacctctatatttcttctgcgtggacctggaaaaagacagcattcgtattgtattttagttgacagtttttaaccaaaacaacaacatcagagtggcgcagcggaagcgtggtgggcccataacccacaggtcccaggatcgaaacctggctctgataattattttttattttattttaaaaaacatcaatttcatcacttaaatggctaatttttaaaatttcaatcccgctatcattttcttattcaatttcatcacttaaatggctaagttttaaaattttcatcccactatcattttcttatttttttaaaaaatcaatgtttcgtcacaggctaatttataaaatttcaatcacaaatcttatatggctcaaagataagtcagaacttagctacttcaattttatctgtaaactaaagggccgtgtttagttgttttagcaaaataattttgagcgtatgaacacacatttgaagcctaattaatccatcattagcaaatatttactataacaccatattatcaaatcataacgtaattaggcttaaaagattcatctcgcaatttacatgcaaattatgcaattgtttttttttcgtccatatttaatgctccacgtatgtctaaacatttgatgtgatgaaaaagttagaagtttaaatagaactaaacacagcctaactcattcaggaaaaattcagaacatatcagcaatagaatgcctagatacaccatcagcatgcaagaaaaatgaacaatcacacataacaatcacaggacgcatcacactcgtgaattatgaacaagttattatctcaatatgtataggtgtgaaataaacaactgaacctcagacttcgtttgttacagcaaacgggcacaagtcggagatacagcaaaaatactacaaacaattaaacaccaattagcaacgggcactctctcgagtaaacaatgcctggaggattgccttatttcatatgtgcatcaatcaacccatgtcaccttcacatgtgtgacattttctccggacaatatacagttaagctgatgccttcagatgctgataacccggcatctctcaggtgggaagtcatgctccaccaatgggcctgtggaagaggacaccaagaatccatctgccctgacagtatccaggtcaattgtcactatactcagccctcttccaataatgtaaatctttctcccaatgcctacgagctcacaaggaggccttgtaagcttgtcagacagcctaccaagcatgatccactccttcgtctccttctgccacatcatcagctttgtgccgagcgactgctccagcatgtagagcgttccgtccatgacgactgttgatccagaccaacatagggcaatttcattctcagtgcccctccaagtgcggcacaatggatcatatatacctgcaaagtacattctgttccaggcagccttgtgaacagttaccaactccccatccaatgccacgaattttacaatgtcaggggtgagcattggattcttgtgcacacaccaagagtttgtgactggatcatagatgtcccatgaatttggcgacttgtctgtcaaacctagtccaccagtaatgtatagtttcttgtccagagctgcagaaacaaaatagcacctgaaaacaattgaggcaagtcaaaatgcgtgcagatgtcataaaacagcttcacgtgaaaaaaaatgttaatggccagtaagtaaactttgtcatcatatttacctagcagtaggcattggagctacactgctccagcaatttgatgaggcatcataacaaaatacttcatcattagcatcttttagccagctacaaccacccaaaagaaataatctcttgtctaaggtctcaatggaaatgccttccctagacgagcatgggggttcgatgacttgcataattttcaaggagcgggttgtaggatcaggagcaagtacatagcatttgatgcccgtactcctacaaatcacatatacccaaggctcatccaaattgttcctcttgcggcaagagtgccactcttcactggaaagcagtgccctccatctctttgagacacacctgagagcattatgatatcgccgtggaactctcgctaagcaaagaatagcaatctcatcaggaagaccatgtataagtgaagtatgggggccatcagaatccatgccgctacaggatagctttccaccgtgctttatttcagaagtcatcaattgtcctaaagagaatgagaacagatgagaaagtggcgatagacttaattaaatatatgctctgttgatacaggagataaacagtgtgaccagaaatttctaacaaaaacagaaggaaaaaaagagaacatcagaataaggaaaatgttactttcatg

SEQ ID NO: 44326 - DNA, 12856 bp, Oryza sativa
attcctgcagcccctcataaagggtgaaactatacaaggaacaggaacacagggaatgcaacgaagcatatattattttttcaagttgggaaaaacagtccaaacattgacatgattttgcaccaggagcatgactagcatgctacttgctattctattcacatgtttgctcagaatctctgatcagttttggatgtaatcacgtgaggaccaccttttcaagtggttccttactaagataccgtccatgtaggaatcatcacagcaaacaagcaagaaaagaaaaggcaaagcaaaaatctcaattggtttattattatcccttttttttatattagccacaatatgtgtcatggttaaaaagggtgaaactatatgagcaacaaaaacatgatggaaaaactaaatttctgaaaacttttatctgttaactttaggagtaggcgtgtttaaatagggtgacaccatataaggaacagaaacagtcttttgagttaggaaaaacagtaaaaaaaatgacagtatcttgctgtttgcaccaggagcacaacaaggatgttacatgctattcaattcagatctacacacgtttgctcagaatctttgatcagttttggatgtaatcatgtgaggaacactctttcaagtagttcctcactcagataccgtccatgtaggaatcatcacagcaaacaagcaagaaaactcagtcatcacagcaaacaagcaagaaaagggaaaaaatgaacatctcaatgggctgatctattatatcaaaagtagtgatgctttaaaaggggcgacactatataaagggcagaatattgaacctagtgaaagcatcaagcatatatttttccatccagttgggagaacagttcaaatttacacatgttttctctgagtctctgatcagtattggatataatcatgtgaggaacacttttaagtggttccttactcagatcgtccttaccaaagaggtcatgcctgcgtgacactctacataatgagcttacacagtgaagccaatgaaggcatgttattcttttcagctgggaaagcagttcaatcacaggaaggattttgctcaacaggcacagcgacttcattatttattatttaattcagaattgcatgtttgctcagaatctctgatcagttttggatataatcatgtgaggagctctctttcaagaggttcctcactcagataccgtccttgtaggaatcatcatggcaaacaatcaagaaaagaaatgttaatgggcctaactgttaacttcaaagggaaattatgtttaagtgtaaaaagagcagaaaccaagcagatacataagcgcgtatcattgacaggtttgcataacagtcaaatgtacgacaggattgatactctggttctattcagattcacatgtttgctcagaatctctgatcagttttggatgtaatcacgcaaggagtactctttcaagagccaccttactcagataccgtccttgtagatgtcatcacagcaaacaatcatcataaaaaaaaaatagggggtgtagcatgactgtaaccaagcctacatagaacaggaacgagcaaaatatttccttctttcacagagtgaaaaatatgcagagttttgctcagacatttttagtctcagttaggtataatcacgtgaggatagatccatcgtcagataccgtgccttgtagatgtcatcacagcaattatgagatacagtcattaagttgagcaggccctcaaacttaaaatccacttcattccaatctaaccatgtaactcagcgacatcaactcaatcaaaatgtactaccttataatacgtagtaccttaacatgtttctcaggttgagaaacagtcaaatgtacaacaggatagacaatttcttctgttcagacacatgtttgctcagaatctctgatcagttttggatgtaatcacataaggagtactctttcaagaaccttactcagataccgtccttgtaggaatcatcaaggcaaacaatcattctaaatccagtgcaaaacaatcattctaaatccagtgcaaatcatcattctcatttcaaggcagtaacaaagacgacacagaacacgaatagcatatgctggttgctgcttagttctgaacagcgagaagcaaatattccaacttccagatggtaaaaaagaaatgcagagttttgctcagacatttttagtctcagtttaggtataatcacgcgaggatagatccgtcgctcagataccgtcctattagatgtcatcacagcaatttaatttgagatacaatcagttcagcaggcagattaacttgcacgcctcattccaatttaatctaatcatctagctcagctagctcagcgatatcaactcaaacaaatcctaccacctgaacatacactaccacacaagagcaaccttaacaacaagatgataagagaatgagaacgatacaataccatcggggggaaaaatcacacctcggaaaggtgcttaagcgtcggatctgacgaggagcagaggcgggcgggggtggacgcggtggatttgagagcggtgggcggagttgtggtggaaaggaaggagaagggcatggagcaccgtgaaacaacaaacaaatcctagatctggtggggatcagagggtggcggcggcggcgggactagggtttcggccattgccgcagcccggaggaggaaaaaggcgagatgcggagaaggggaaatgcggatggtgacgccgccattttatcgcggcgagatgatatgatggccattatgcaataagacccctctattttttctaaaatacgcgccgttttttccgcaactataagagggaaaaggagaaggatagcaacagtagatggtttcaacatttaaatctaccaaaatcaactaggaaaatgtagcagatttatgaaggccccatgtgagaatctcatccactcaaatcacagcaaatcaaccaaatagaggagaaaaaactgggacagggaagaggatgcccaaccttgcaatgggcgacggacaactatccattgtgctcagctcgacggagagtgacggtggagcagggggcacgaccggcaaaagagagggaggacgaccgaggagagccggagtcggaggagaggggaggggcctcgccgccgccagagccgctagggtaaaccctagttttttcgcgagagggagaagtagcggtgaccccatatatcctccgtgagcgggtgcatcactcgagtcgagccaggccgagcagcgaagtccgtttccgtcgggccttgggcctggctgaggggctattttttgcatcctcgtggacaggctgggaggcccggcccgagcaggcaaccaaagaataagttcattttgggtccctctatttgtaggtcagtctgattttcgtcccttggtcgcaaacaaatttgcatggactggtgcgggccaaccaaccaaacagcctcaaagtgaacccaaaaaccctagcgccgccgccgccgccatggaagaagcgtggccgcctctcgcccccgccccggaagctgcggctcctcccggaggaggaggaggtggaggagcatggggcgcggcggcggtggcgcagcggaaggaggtggccgaggagtcgtcggcgcatgcggtgagccggctggtggcgagctgcgccaacacgagcggcgtggcggtggccgtggtggacgccaacgccgtcatatcgggcggagccgcgctctcctcgtccgccgcccgcctcgtcacggtgcccgaggtgctggaggaggtgcgcgacgcgtccgcgcgccgccgcctcgcgctcctcatggcccctgtcgagaccctcgaccctgcccctgaattcgtcaagaaaggtaggtactaccttcagcaattctgactgaaccttgttgagtattagcaataaaactatctacagatcagtgaatttcacattttccttaaaatagattttatggtacgagtgtactaagaactggataacggtgtaggtgtagccaagaccatggtttaataagttttgtggttaaaacattgcctttgtgtaacatgagctggtagtttgtttaatgttgttgtcttaaaacttaatgtaagcatgagggaaatggcaaggcttgcatgtgcaaaagcaattagatgtcacaacagtatggttttctatagaatagaattagccttctagtcttctactatggaaattttcctcatctttgaatgacgtaatgatgagaaaggctaatttctcaatctttgtttctggcagttgtcaaatttgcccgggaaacaggagacctccagacgctttcagatgttgatatcaagattattgctctagcttacatgctggaagctgagatccatgggactaaccatttgcgggagcagccacctcctctgcgtgtggtgaatgtgagaaacctgaaagaggctccactgccaggttggggctctaatgtgcagaacctagcagaatgggaagaattggaccagatgtctgaagcaggtggggatctcaagtcacgcatacttccactgaaggatcttgagaaccacgaaataccgaatagtgagaccaacagtatttctgacaagcaaggtgatgaagagcatcagcctgcaaagaaagatgtaggtattgcttgggaagatgatgagaataatgaaggttggttgcctgctgttagtcgcagtacacacagaagatatctacgaaggaaggcgagacgtgatgccctcaaggaatctgaacaaagtattgagacaagttctgctgccccatcaattgatgacgataaaattttatctgaaaatggtttgaatccagtggatggcccttccgctgatactgatgttatggagcaccaagaagtgaatgaacctgaaattgttgcagatcattcgcaatctgataataaggacaatggggtaggcaatgttggtgatgttgaggagaccggcggtacggacgcatgcattgaagagttggataatttggatatcaaaagcgactctgaggaaggtgtcgattcatctcttgcagatgatgggagcagtgagcagagttgggcgttgaggtccttatctgaatctactgtagcatgcataaccagtgactatgccatgcaaaatgtcatcctgcagattggtctccgtctcttggcaccaggtggcatgcaaatacgtcagttgcacaggtatgagcttttagcatcttcagagctctttcacgcactagttcttgttctatttatagtagtttctttgtaacgctaatgctttgggatgctaatttggcaggtgggttctgaggtgtcatgcttgctataaggtgacccaagagattgggaaaatattttgcccaaaatgtggcaacggtggcaccttacggaaggtttcggtaacagttggtgaaaatgggatcactatggcctcacgacgtccgcgtgtgacacttcgaggcacaaaagtgagtgtagtttcaaacttaatgctgtttttcttccatgtggcctagatacttttatgttttgtcacttgcctgattattgtggcaatattggtttgtttgctgccttgctttactgttatctgagaaatagaaaagcacattttagactcatgccaaatgtccagatagtttatttccatgcttgtaatatgtatgatggtcagaggttcaaaagtgtcgaacatagtcttcagtgtagtggtgtagaaaatccatgagctttggccagtcccgtatgcattccttactaatcaagtccttctagactctctttggtgaatcgcaatacatatcctgccatactatggccttctacatcagttttcgtattcatttcttagtctgaatgcttttggttggatatttttccatgtgcccacctggcctttccaagttgattcctactgtgatgacaaaagattttctttttaattgtatgcctattttctttcagttttccctcccaatgccccaaggtggaagagatgccataactaagaatcccattttgcgtgaagaccagcttccccagaaggttctgcaccctaaatcgaagaagtcaaacaagcaggtaactagcccttgctattgttagatttactgaaaagcctccttttataaggatgcctgcttttcggcacttaaattcaacatctccaaaacgttcttttacaccaactatgtgctctgctaaacagatattctccattctgtgggtgcatatgcttttttttcctgtttttgtatcgcaatagttaagcaactatttatttaaccattaataatattctctataggacgatgatttcttgggtgtcgaggacatattttcgcacagcggtgaaaagaaagtaccactgaaacctccagtgaggaaggcccttgcaatgttcagtgggaaacggaatccgaatgacaaccacttttctcgcaagaagcattgaatttctgttccccatttgttgctcttttactatcatggttttgtactgcattgtttgacgagagaagtagagtgtatcaccttgatggtgattgtggagaaaaaagtcatcctgtagactgaactctgatgaagcatgtaagctatacaattttgcagaacatctatgtaaggctcagttccatagtaccattttcatatcaattacagctggagtattttgagtgcatgaattgcgaatacatccagaggtttaacgttttttcgaacatcaattattagtgacaagtaatcactctattcctcaaaattattcaaatgagcaactggagaattcatcaaacttactcgatccaacaataaaactttttctttcagttgggtattgtgctactactacttgagaattacaggctcacatttacacagacaaatggttacactttttttattgcagaaacaaccaaagaatatgtccagcctagggtgtgcttaacttctactacatcacattttttcttacaaaagagaagaatcaaattaatgaagcagtataccgcaatttctttcgatgcttttacgctcaatgcacacaaaacacacgaactcgatcgatcatatcacacacaatcgtcatcagaagagcagatcgtcactagtggcagcaaatccgccatagatgtctcccatgtttagcaggtcaaagtagccgccgcctcctgccattggagcagcagcagctgagctctgatgctgctgctgcaatgcgccgtagctgccgctcatctggtccccgaacgcgccgccgtgcgacggcgtcacgttgccggagctcgccgtggacgccggccagtgctgcgccgagatggagtagctctcctgccccgccgccgccgcagacatcggcatccagtcgccggtgaagacgaagctcttgggctgctgatcaaatggctcagcgacaggtgcaggagcagagatgccgccatggctgccgccgctgctcaggttggcgtcttggtcatgggaggtggtcgtgctgccgctgctgttcttgatctgatgatggtgagggtgatgatgatggtgatgcaatgatggtggctcggtggtgctcatggaggtgacctcagctgctgctgctgctagattgttagggatggagccctgtgcctgcatcaccctcttcttgaggtaggaattccagtagttcttcacctcgttgtccgtcctcccaggcagatgcatcgcaatctgtgaccacctgatcataaatttctcaaaacaatcagcatcatgtagatgaaatggaacaattgaaaatgctcaattttgttattctgtgacagcttgagctttgttttttttaacttaaaagacgttgttttgtctgaatttcaaggtaaagttcagctacaagttagaactagcttggttttgtatcatcctgttcatagagattgtcaggtgtgaggattacttgttgcccagcttggcctgaagattgatgacaatgtcctcctcctcctgagagaacattccacgcttcaatcctggccgaaggtagttgatccaacgcagccggcagctcttgccatttctctgcaaaccttttggaaataaaaaggagagaaaaaagggtcagaaataatagcagtgaatgagacaaagatttcatttttatttaagaacaagtgaacaactgatgaactttagagagctagactctatgtactgtaatgcttttgttattattttggaaaaaaaagggtgagaattcttccttggctggaatttcaactggcctaagaattgtgatcaagctaagcttgaactaacccaaagctaagtactctctgtaactgctaattaccaattagagaggggactagactaggctagaattcacaattgtgaagagggatgcattggtgaatgcagcaatgtgcattcacagtagagacagagagaagcaaaaagctcaccagcctttgcagggacagcactccagcagccaaggccatgcttgacaatgtagtccctcagcctctggtcctcctcaggagaccacagccccttcctgtagttcatcttcggcttgtcgcaggaccggcaccccattgctctcttctttccttctctgaatatctcctcctgttcttcctcctgcaacctgtatgttggtcttgtctcaatatgagctgttgcagtagcagagttgtgccagtcctttcagcaccatgtgaccccttgtcatttaaagggggttctcacattttggtgttaattagtttaattggtgggaatgagtaggtaatacatgcacatgcatgaggatcatcaagagggaggcgttggtcagaggatatcacattgtcacctctttctcttcattacacaaaaaaagattctgatagttattctttcagttttggccttgttctaatgatgtggatgcttgctggcactaatgaccacattttatttttgtttttaagtcggtgactatattgttattgtaattggcagctgatagtatatatgttaattacctacttacttagaccatcggtttagtaccaaaattgttagttatcagagttttactgacaaagtaattcgtttcagaggcagtattttcagatgaccctgtaaaactattagggccatgcattagtagtagagtgataatggccatccaatttgtttactataaaacatgattatccagtaatcagcgtgataaaggtcagactgtctccaccaatgatgagtagagcattgacatgagctgttattgcgatgaaacaaacaggctcttggattagcaatgacaagacatgatttaatcaccctctcttaatgccaattgccaatcattgaaagcatctgcctagacaaaacaccaaggaggatgaagaattgcccaaggacacaagaaaagacaggctagttagcatccatccagaaggatttgcatctgcaaggatcaacaagatgaactgcaccatggacaagggccatacataaacaaggaccccagaagcacaaattaacaatgatgttgagcttgaatgccaaaccacaatgctcctttcttatgaaattttaagaacaacatagctggcagaagaaattcagagtgaaagaatcacaatcattttacacggcttcatgtgctcatcatatacaatacagaaatcggtgttgtttttcctcttggtgatacatagtggcattgtcctaattcagcgacacttggctagttgtctgtcttagttttcatagtgaaatgatgatgatagattgcaagagaagtacggtactagtttgtgcagtttgacagctaacatcatctgttcatcaagatttttgtcctttcctcgaactagttgttcttagaatcccagtataggtacaccagttctctttacttcttctcgagttcctcgcgtaggaaaaacaaagacttctccgaaagtgtcaaataaacgaaagccaagtttgcgtcatgatgatctaaaattacatcaaaatctctgcattttggatgccatgtgtttgtcttttactgctggtgctgacatgatttaatttcagaaaaagatgaagtgttaagttcagctagatgttgactcgttgttcttcagggtagtagctctatgtgaatgggttcagtgcttcagtttgcagaaagctgaaaagcatcaaaatctacagcctactaagtatactaatacttgtagaactccacaagtatgctgagcttaagctacattataaaattttaacgattttacatcctctgaaatcagtatacaacatgctcgcgagacacgagaaccgaaaacaaacaaagcatgatccaacgcatagatgttatttacccgaagaaagaacaaagaactaaaatttaataataattagcttaagagtcctatcatgactagtgatatctctgtcctcttttaatacacaacaatataatgtcctacaaaaagggacggttccatgtgagcttcagaggcgtcttaatctcctcttctcttcctcagcatcaaaaaatgagatttgctgatgagaaaaaaatcagagctctcttctctcaacattagccgacaatgataaactaatacaagtatacaacactatgattttattaacaaaattaagtatacggccctgtgccaaattatatttgtctgcaaattgacttgtgcataagtgcatgtggacaaacacctaatccccgaacaaattcaggcatcttgccctatacattatgtcccagtggttaaactaatagcactgttctgaagagaagaaggataaaggaatcttttgtcagttccacacacacataaaatcctagtcctagttaagaactgcatcctgacttgcgaggcttgttgcttcttgtcacatctagaatgtaatgtaaatgtgtagtactactgatttagttaatgattaaagaattattgggaaaatgatggtgatttgcaaaatatgcttctaaaattaaaaaaatgaagcaggaacatgcaagagggcttctttgtacttgcaatgatgggatgcaagtcaatgctctcttcagaattaatccacagagacaggcaagatggcccaattgtatacacaagtacagctcatccgggtactcactgaataatgaagactagcactgcaaattgtcagtatatcttgccagaattaagtataatggatggctgcaaaaattatgtcatcttgataagcacgtacacgaataattattaggcatccttgaggattttgagaggaatgctgaagatggtgattaagtggatggatgctgtttaacttgcttgttaatcagcatgcagcagcaacgatttgcttctgaaagtaccatgtttatgcatacttggtagcaaagaaaagcttatccgattattttaagtacattatcatggattgatgataatgttcatgcaaggagattaggagaagctagtgaccaaagtggaggcaaagaggggatccatgaggaattgagtaggctgagtacttcaggcaatgaaagatatacagatttatttcatttgacagccttttgagtctaaagtttgaaagaagatatacaaatttatttcatttgacagccttttgagtctaagtgagaatgaaaatttattttctataaatctagttcgttggacagctttggagtctatgtgtgcaggaaagaagataggcgaaaccagttcattggacaaacttttcagacataagtgatagcaagatcaatataatagatatatctatctagttaaagacagctttaatgcaaattaaacttactttcaaataaaaaatgcaaactgaactttataaatctacttacaaaattgtgcagtttcttatttaaaaggaatagttattcagtaatcgcaccttgactgggccaaatgaagcccagtttatgtgggccgataccaaaaatgggccttacctgttaggcccaactcctttgggctaacactaggccgaatgactccgttgcagtatgggccgacactgtaacattgattaggcccacagcatctaaaacttttacgaaagaaaatgagggcaaaaaagcgtggtatcgcgcaaaatcgaactgaagaaacatacacaaatggcgctcataaagtgaaaaaaaacatgtaagtatactcaatggtataatgcatgctgttggatcaatggtaaatggaaatttattgaagcattattattcttgtttaaagaataaatcagcgtgtacactgtcaggaacacatcgatcacattcaccgatcgaatcaaacaaaaaaaaaggaaaggaaaagaatcttaatccatcagtcatcctcttctcctcctctctgacaacttgagcattacatccatatctttctccctttttttagtatagaaaggaaaagaagaaaatggaaggaaaaatgtggtgattaaacagaaacacaaacacaaagaagagattaattaagaatggcggcgtcacggtcgagcacggtggcgatgattaattaatggaggatgatgatgatgtgtttgcaatgcgttgctcactgtcatgcagccacgtcgtcgtcgtcgtcgcccccgacgccggcgacgtcgggggtgagacggcggtgggtggtgaagagcttgagcacgccgtcggagccgccggcgacgagctggccgtcgctgtcgtcgccggcgagctggcgccatgcgaccgcgctgacgaaggcgtcggcgtgggagaatgggtggacccagatgggcttggaccagcggaggtcgtagacgaagacgtggccggactcggagccgctgg

SEQ ID NO: 44327 - DNA, 2955 bp, Oryza sativa
gtccggtcgtccgacccggacgccaccatcgtcgccgcgccgccgccgcgggcgtagtcgagcgcccacacccgccgccctcgtgctcgtcgcgctcccagaccggcacgccgcgctccacgtcgtactccgtcacgacgccgtcgtagtcgccgcaccccacgtgcgacgccgccaccgcctcgccgccgccagggcgccaccgcacgctgctcagcttggccgggacgcagatgcaggcggcggggctagacggctcggcgaccctgtaaatccggatcttccgggcgatgccgccggtggcgaggtggcggccggtggggtcgaagtcgaggctgccgatggagtcggacgcgcccgcgagcgccggcgacggcacggtggccgccaggcgaaactcccattcgcacctcggcggcgacagcttgtcctcgtcgtcgggaataatgccggcggcggcgtgttcttgctgcagcgccgcctcgtcccggtgatcctgatcgtgcagctgctgctccccggcggcggtggacgtggccggcgaggaggggttgctcatggaacgctagcttgctcgcctcctcatagggctaagctagctaccaagctaagcttagctcaagctcaagctcacaaccctattcttttcttgattcgagatcgatttttttttggtttgtttttgttgaatttgatttggtggttcttgtttgtcctggggcaagaactagagagagagaaagaaaaagattgtagagagagagagagagagagagagaatggtttggttgaggtggattattaatggagagccacaggagaggagaggagccaatgagaggaaaggtttaggttgcagtgcagggtttgtgtggctgagtgaggctcatgtcgtggctgcatttgcaattgcagattagtacgtgctcctggtaagtggcatggtgaccaatcacaattcaaattcaatgcgaatccaattcaagctggctaatggctatggcttgctgagctgagctggtaggggttagttaattagtttggttaggtttggccacatatacacaggcagataatggtccaagatcgaggcagttacttgtactgtactgtgtcctggttggaatatttctcaccatttattttggttagcagtacatctcaactagtactactctcctgcctcttcttttcctttatttggaaaaaagtcaatcctccttacatgtaatcaactaatttaatcatgcatgaggccgggttaattctcatcatgtcaactattattggtacatgcatgcaaagtataattcattcgatcagtacaaaactacaaactgaaaataaattactccatccgtttcacaatgcaagtcattctagcatttctcacattcatattaatattaatgaatctagacatatatatatctatctagattcattgacaccaatatgaatatagaaaatactaaaataacttacattgtaaaacggaggaagtacttacaatgtcatacccacgagtctcctaacacacacctgaaaagacagatagacgaattctcggtctcactaaatttgtactcctaaagctcacttgcgcgtgtgtaaattcctattgaaactaaagctcactcgcgcgtgtgtaatatatatatgatttgtttattattgacgtgcattgcacattacttgttcaagaaattaatattttttttcagaccaaacaaaatttaatttatacgcagtcaaatgttggataagagaaagctagctgcctgcaaattaattaattaatttaaattttaaaaatagattaatatgtgtcgacgagggatgcccgtagaccggatatagagggtattggggtacgctggtacgaggatctacgtagtacgacatcaagcaaacagaaaacagagattatactggttcaggcccctcggaaggtaataaccctaatccagttgatatgagattatatgattgaaatcacatattacaaagggtataatagaactcgatgataccgtcgagaccgtagtcgagttggttcgactagatcacctggcgacttggctcctgtaggctccggcttcgtaggctgtggtggatgtgttggcggtaagatttgatgccttaggtcctcccggggggttccttttataccgtggtcagttggtctttaagtagaactcggagacatcagaccccacacgatacagtaacgacccggttctgtccgagtaggactccttccatccgtggactccatttctattacacgatgaatttccttaacgtgtacaggaaacatccgtatacacgcaggtataccatatcagtatacgtcgtatatccaagggtagagggtataccttatccgtaattctgacaatatgatttttaaagaatcttttatataacgatttctctttttttttgcaaaaactacatagtttagcaatttgggaaacatacaagcgggaaacgggttcttttgtttcttttgtggttgtaacaaacgcaacctagtatgtactcgaaattgtcaaagtttttgtttgtttagtactaattaaaagaggagaaattaggctttgggggacaaatgaaataaaataaaagatcgatccccattggaattattatatgtatagtttgtatatataggatcgagaaaacagtggagatatgagatggacgtccttactagctggagtagctcttttgttgtatagatagatagatgagattggtggtcacaccgttgacaggtacgcaggcagtgaacgcgtgtggaccagatcgtttccagttcgtacgtactagctttattagttggcgtaattactgtgtcctagttagctaccacttgcaatataaattattgttttggagcatatatatgcaattaactggcatcatatttagattagtagtatatatgaa

SEQ ID NO: 44328 - DNA, 1522 bp, Oryza sativa
ccgagactaaagatcaagaatctttactctcggttggtagtactaaccgggactaaaattaaacacgtagtatataatccctatccattattctctcctccacagttacaacttagacagatcgaatctcacccctctcctcagatctatcctctctaactctcctctccaactcctccccttctctccccttcctccttccttcccagccggcttccccttcccatccggcgggccggccggcggcggggccgcgcccggcggggtcgcgcctggcggagggcggcagcgccgcgcgcggcggcgggcggtggggcttcgggcggcagcggctgtggcgggtggcagggccgcggccgcggcagctggcggggccgcgcccgtcgttcgtagcgaccggcggcggcggcggcttctttgtttttttttaatttgtgatgattcattgttatgtatttgactaagaagttacaaatttgtgattcgcggttaggggagctctcttaatgacgtggtggaatgtgtggttagagagaaataataggattttcgccgatagtgctagaactgagcgtgaggtggcctatgtcataaagcaggagctagatctctgcaagtcggctttcaggccgccctgatggtttttcctctatttggcttgtaagcactatatttcctatctctaattaaattccggcagaactcctgccgtcggtttcctaaaataaaaaacaaatttgtgattcattgtttggatctgtgatgtatttgagtaatttcttaggatattgtgatgcatttgatttatgtgtataagtaactttatgattgtgatgtgaatttgggatgttagttagatttggggattgatttggggatttgcctacttgattcgggagaatataaaaatgaaaaaagaaaaagaaaaaggaaccatctgtactgccgctattgtctcttttagtccaggttggtaacatcaaccgggactaaagatcccctctctttagtcgcggttggtagtaccaaccgggactaaagatgaatatctttagtcccggatccgtactcccggttggaaaaccgggattaaagggggttcccaaccgggagtaaagatggtttctccaccagtgacatgtgcatgcagtgcagtgtgataccgaaaccttttttcaggaaaatgtgtagttttcatgaataaatctcagatgtatatttttttatttaatggtagatatctgcaggacatatatagcatacttttctatcttttttttatttcgtgttgaatggaagtcaagtactactctctccgtttcacaatgtaagtcattctatcattttccacattcatattgatattaatgaatatagatagatatatgtgaaacggaggaagtagtttacaattgttaaaaaaacgcgtctaacaatcgtgcaccctaaagaaaaggttcttgaaaaaaaccctaaagaaaaggaagtcgcgtgggggtcacatcaaagggctgcaggaatt

SEQ ID NO: 44329 - DNA, 2466 bp, Oryza sativa
attcctgcagcccaataatatgaaaaaaactcatctagagcagcttattagattataataatctagtttatagattataataatctgctataataatctacttatttatttcagcttacttttaataagctagattataataatcctaagatgaatcaaacagtgccttagattgtttaccaagtgaaaggtttaatactccaagaaaaaagttaaaggtgctaggagattcatcttgaagaaggaaattaaataaaatgcatggaatctatcgcgatattttagccacgagaacaagattgattgatccaatttaagccgcacggagtatatatatagagataaaccgattactttccacggttatgcctttttgtcattacccacttctttttttaatttttcttttgaaaacatcaaactaaaaacaatgaaatgatggagaaatagaccctacgtaccaactaatgatcattgtgttatatattgcgaataattacgctcttattataagaaaatcaatgcccttttgttctctttgtaccaccctatctagcttaattaggttattactcatttaactcgtcctatttttacaaagatgtacaatttgtcctatatatgtcctattgtcatatgtatacactatcttttccacctctttgtcatcgatttttattccccttcttttcccgggaattatatatcttttgtttatttctgggtattaattcaatttcttttgttttgtttgtgtggcagctggcgtgtaaaaacacctgccacaaacaaggccacataatgttctcttcagggagggagatgattaagattaaagcaccagttccaatcagtacggctagctgcttaattatagcttgtgctaataagatcagacaggtaccgagtgtcatatctgtccatctttttatctacctgatgacgccgtcactatctactactccctccctcctataatataaaaaaaattaactttttcttacactgtttaaccactcgtcttattcaaaaatttatgcaaatataaaaaatgaaaagttgtacttaaagtactttggataataaagtaagtcacaaataaaataaataataattttaattttttttaataagacgaatggtcaaatagtgcaagaaaaagtcaaaatcccctatattatggacggagggagtacgtacttcgttcgtctcaaaatataaacaattttaacggaataaaatacatccgacactaatactataaatatgaacatgttacaagtctaggtagttttacgaatatgaaaagttaaaaattgaactaaccaatgtatgacattgcttagttcaaatttgcactatctactacgaagtactatcctttttctatatgacaacgtatgaaagtaaatataggtagtatttaataaattgagttttggtattgaataaattttacaaaactacatgtattttgtacaatttatcacgaaattacagattcagtgtctccgtttatcacaaaactatatatgctttgtacaatctatcagaaaattacatatttaaaaacttatttcataaaactatagattttatatagtatatgtagttttataaaatttactctttagtatttattatcggacattttctggctaatcatataatatgttgtacggttaggtagccggagtagctaacactaatttttgatatccaatcaaatcaacctctgatcccaagttcccaacatctgaaaaaaaagtaccccctctgatcccatcgattaagccgcaaatgaaagagtttgcatgcatcgatgcaccgaaactatttaggccctgattagtttccgtaattttttttatccaatcatattaaatatttggacacacacacacacacacatatatatatatatatatatatatatatatatatatatatatatatatatatatatatatatatatatagtattaaatatcgatctacagtatggagaagggacacatatatagagtattaaatatagatctacagcatggatagggcagatcagcagctaatattagcttgtgagtatttgttaatttaatttgatataatcgatcacgagaggtgattattaattaattagattggatacacaacaacgtaccgtacctacttaattaattaagagtagcaagcaaaggcattgaatgcatgggtgcaattttcatattgcatggttgggcgacccccccacattgcgggagagcacgtgcattcctatggtccatacaaactactattactacacacatctccatctttctatcatatcgcgccacgtagccagccaatagcggatctaggaagaaataacaggagagtacgaaaaaattagataaaactacaaccccttcctatttactaaaaacaaaaaattttaataaatgcttcgtgaggactctcata

SEQ ID NO: 44330 - DNA, 3146 bp, Oryza sativa
atgtaacgccccgattttcgttcgggattaaaaatcatttaataatgcatttcctagaaattaaataaaaagttaagcaatttatccaagtgaattattgggagaattaaaattttccctttaaaaattattggccgggaatattttgtaatattctttgtgccctaaaatactctccggaattttccgtgaattttcggagctcgagaaatagttttaatagcacaaagatcattgcatcaattaaaataaaacgaaaacaaataaaatcctccttttcctcttcttgggccatcggcccagtccaccccgccgcgcgcgccctcctccttgtgggccggcccaagccgcccctccctctctccccgggacgccgacaggtgggccccacctgtcggacccgtccccttcctccagccggcgccgccgcgcccgcaaccgccgccgcgtccacgcctccaccttctccgggccacgtcagccacgtccgtgtgtgcgccgcgtcccccatgcccactcccctctctctcccgcccgcgccccgcgcccgagatggccgggattcgattttcgaatcccgcctctctctcctcccccacttccccacgttggccgacgattcccgcctctcccggccacgtccggccctcccctcccctatttaagcttccccgtcgctccctctcgctttttccccttctcgccgaactccctcgtgctccccatcgcccccgcgccgtgcaaccactcgccgccgccgttttcgctactccggccgccgctagccgccgctagggtcgccgccgcaccgcgccgtcgccgccgtcgggttcgcgaggctaagctccaccccggccgccccttccccgtcgagtttcgtcgccggaattcgcatcccctcgcgctccggtgagttcaactgctaccgccgctttcggccatgaataccggtcgccgtggttcatctccctccctctaatctctctcttctccttccttagggcaccccgaatcccgtccgccggtggccgtcgtcctcccgtggctcgccgtcgccgttcgccatcgtcttcctccgcgccggccaccctcggtgaggcatcctctcccttctattcccctccctctccctcctagccgccgctttagcgccgccgcccgttagccgtcgctttagcaccaccgcccgtcggcgccgcctttgcgccgccgtctccgtcgccggttgccgtcgccggcaacgcgtgtgcgcgcgccgtcgccgtcgccgtggccgcttggccggtcttgagccgagccgggtcgccaccgcccgtccgatcgaccccgagggcgatctgggccgtcggtcccgtggaccggcggtggaccacccgcgtggtcccggtccacggtgaaccgcccccccttgtgtcgctgaccggtggggcccgcttgccggcgccgcctctcccccttgctgacgtcagcgaggtccatttcctttgtaaaaataaataataattacgcaataaatcgagtttaattctagaaattcatttaaatggctcaaaacttctaaaattcatatctaattcattcgaactccgaattaagccattcaacttgcaaaattcatctaaaattgagctctgcatgtttgtttagtttttatgtactgtttccttggtttttattagagtttttcctcattttgtgtgccagcgtgtagaatccgtcgtttcggaagtccgcggtcgcgaggaaaagagttcggaagatcaaagtgaagaagcaaggcaagtcacacattccccttgagcatgttgatcccaatttacaaatgttttactgtttgcaaataaatatgcatgttttgctaattacatgggatccgggtattacctatctgctcgcttgtgccatgtttacttgatatctgttctttgtcaaccttgggtaatgaatcgactagctcatgttacttatgtgtcctagctagaactatatgcttagccatgcttaattaccactagctcagttgatgggataattacagtattagacctttttagtatcagagtgagctgcgtgctcgagacatctggccatgcttcatggtcgtaattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctacgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggtgcacgggaacgtgtcgtggggctgtgtcttgtgggtacagttgtacacctctgatcagagtaaaactattcgaatagccgtgcccgcggttatgggcggtcgactagattcaccgtgattagtcccaccttaataaatcgactcaatacactgtagttcaggtgggttggttgggcctgttcaacgtggtgtagcgttgatcagtggagattcaatattactttaattactcaacagttttactgttttgctcaataaaatgttttacaaccgcctttatgcaaatagccacaaaccatccttgtatccccttgcacatctgcatcgttggtgtggcttgctgagtacggtggttgtactcagttttgctattattccccctttttcagaagtgtagtgcttctgagcggaagatggagttagaggaccaaggctcagaccccagttgagttttgcctgtggagtggagctgaagccccgctaggatcgcctttttccgctgctgtcgttctgtttcggtgtgaggactaagtgcctcttccgttttacgctttatttacgtttggaactgtatattacttgtcgttttgtgtaccctggctggtcctggacagggatttaatacgcaaaatagtctggaaatttggggggctgcaggaa

SEQ ID NO: 44331 - DNA, 1271 bp, Oryza sativa
  unsure (1)..(1271): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcccttcccaggcgttacactattcaaggaattattgtaagtctttcttcgtgaacattaatctcttttgtttcaattaataattaataatgctagtttcaaattgattttgatgtcaggattattgggcaatcttacaagagaaggataacacttggcaaacctttgaaaaggttgaacattaaatcttgttcacattagttttattccaggtgttgcatcataagcaatgtagattacaccttgcaattaactgaagagctttatgttaactttttttaggttgttactggaacttccactaaattgattgcatatcttccacaggtacataaattattatttttccacagattttattttgtacaggtacagacttcttttcgtggggctgtgtcattacttaattatatatgtatacttttacagttttggagggatacacgatattataaacatgagtactatgacatcgtcagggaacccttaaaaaaggtatgtcttagtcactacaaaactttttaatatattgcgtttattatttttgtatttactgtcatgtttatggatgaaacattgaaactacgagcctcaagaaatcaacacaattttgaggtgactgtagcatttccttgatcaacatagaaaacatgtccagcaaaatgtaggtcttatatttactaacaatcaaactagaataaatagaaaacaaacatgacctggtgtaataatagcgtttaccatgttgttttttgtataaaaaatgattttcagctgtcctatttatgcaaatttcttgacatgatgacctatataatccaaatacaaatctcaaatatcgtgagaatgagtttatggtcctcatttctaatatatgaattttactcaaaactatttccctaaaattgttatttgggatcacaggactgttgtttcattggcacgggttggaaaacagaatatcataaaacaatgtgatcgatcatctatagttatctgaaaagcgttcatttgttgtgttttttgtggtagtctatgactctgtggattagatgtgacgtacatgg

SEQ ID NO: 44332 - DNA, 4352 bp, Oryza sativa
  unsure (1)..(4352): unsure at all n locations
nnnnnnnnnnnnnnnnnnnnnnnnnnnnnnnnnnnnnnnnnnnnnnnnnnnnnnnnnnnttgaggtgactgtagcatttccttgatcaacatagaaaacatgtccagcaaaatgtaggtcttatatttactaacaatcaaactagaataaatagaaaacaaacatgacctggtgtaataatagcgtttaccatgttgttttttgtataaaaaatgattttcagctgtcctatttatgcaaatttcttgacatgatgacctatataatccaaatacaaatctcaaatatcgtgagaatgagtttatggtcctcatttctaatatatgaattttactcaaaactatttccctaaaattgttatttgggatcacaggactgttgtttcattggcacgggttggaaaacagaatatcataaaacaatgtgatcgatcatctatagttatctgaaaagcgttcatttgttgtgttttttgtggtagtctatgactctgtggattagatgtgacgtacatggccaccctttttactgtggcttatttttgttctgattttttttgacagaatttttgaagtccgaattatttactggtgacattaattaatttgtttatctaaaaatattaattaatttgctgatgagtgctttccattttgtcagtcactgataaatgaatactttgcagatctttgtgtagggacgggtcaggggaatctgtgccgagagggtgccactattgttgatggggttagcatactgtgtttttctattggcagatatcatgtttctaatcaaagttctcctaatctggtgccatcatctttactgatctcctggatgaagcagatgccacttactgtagaactaacatgaccagaaagacgctgtgctagtgcagcacattgcaacgaatgttttatcatgtacagcgcaccatcgccatttttcgccgtcagctactgaactggagatataagttggactgtaattttatactctctctattctaaaatatagcaatatatacatatgtctagatttattatatcggcactatgggtgagcacaagtttcttacaactgattttctcgttttctgaattcaccttctgttcttgtggcgataaagaaaccaagcatactgtataaggctgcatccgaacctcctcttccacacacacaagttaaaatcaactcaagttatcacgtgacgttttatgaacgttcctaagccatcactcgataatctaataaagtagagaaaaacctaacagttcttaagaaagaaatatatcttgtcatcaattttaacccattattttgtaccatcagatttattttttacaaaaagagattaaaaaatttaaaaggttcacgtcgcacccttctgatctgtaatactcagtccatcaaactttttacgaatcctctcaagctgccatataatcttctataaatgcttctaggacatgtacaagtgggctctttattaccatacaaataaatttggtgacgtaaaagaaagagatgggaggtgggctctttattaccgtacaagtaaatttggtgacgtgaaaaaaagagaggagaggaaaaagaaacatggttgttatgcatgactcttagcgtttattagaaaatatatttgttgcatgaggttgaaagaaaggaagggagaaagaaaaaaaatattttggcacattaatggttagagaccatattgccttaattgttgtaagataagtttttaggtggcatagagctcccgactgactctacctatatacatgtcctaagttatcacgtagtgttttaataaactagagaaaatcctaataattcttaaagaaagaaatcatcgatttttgactcattatcttttaccattgaatttatcttaacaaaaagattaaaaattgaaaggcccacgtcccaccccttccaatatgtacgtgtacgtacgcacgccatgctatcctctcctgtccaaccgcatgtagtacgtatcagtaaatagcaacctgttcgaatccaccagaaggagtggataaacttttggattttcgtggcacgcttttcaaattgctaaatggtgtgtttcgtgtgaaaattttctatataaaaattgttctaaaatatcatattactctatttttcaagtttgtaataattaaaacttaattaatcacacgttattactacctcgttttgcgtgaaagacttaattttcatctttatcttcatcttcatgagattcaaacatcaccagctgtgattcaaacaccacctattgaatgactctcattcaattggaaaaaatagcaagggtagtatatgcctgacgtctttcatctatttaagaacccaagtaaatagaagcttcaatctaatagggcgtaaggtgaggccacatcgcttgctcccattaactgaggatttgatcgcctcaggcgatgaaacaatttcaacacgcggtgttttacggaacactcgctatataggaatcagatgcagaagtggttccaatacttgaaatggtattggatgttcaatatggacctggacatgggtactgttgtagttgtaaatacacagtcttttttagatccattgtaatctagaaattctataaaaatggaaacaacaactttagtcgccatctccatatctggtttactcataagctttactgggtatgccttatataccgcatttgggcaaccctctcaacaattaagagatccattcgaagaacacggggactaattgaagtggggagacttcttacattttctttctaattctaaaattggatattggctaaaagacaatcagatagattttctctttagcaggcattttcatatagaacttgttataataaaacaagcatgttatagaaaaaaaactctttttttattatttatcaacaaagcaaaaaagggtcttatcaaaccaacccatttagcttccttattcgtagacaaagcagattcggaattggggacatttgcaaatttgccaacggttttttcaattttgtaaggataccactggaatgacagttcgagtggtatttttataattttttagtagcagtcttgcaataatgattcaaagtagcggtaattttgcaattgccaataaatatttttggctcaaaaatatactgaatttcaacctaatcttttttagccagccgagcatttccaagatacagttcttctatttttagggtttatttgacacggttccagctctagccctacctctcctaaccagacagaatcaattcacctaaaataggaccataggagtggagctgggtaaagcgctctcacaaaattaagctagaggggttttggttgctccacaactccactctaaatccagctcttggagttaaatttaggtgttagagctccaccaaacaattccttagaccatactccctgtctcaaaatataagtattttttatccgagatgctactttaaccaacaatatttataataaaaagagtaacatattacgatagtttgtttaataataaatctagtaacatcaattttacatgattaaccttttttattttttattattaatggtcaaaattaaaaatgttaaacttgttactagctaaaaatgtttatattttggtacggagagtaatattttgattgttggcagctagtgggacctgttgttttattgaccaatcttttttcagtggccctatcgctgctattggccctctgtcgccatacgtctattgcacaatcaatctgtacgctatatgccttaatcaatctgattattagttgcttagttctgcaccttgtattttctgtctaaaactcccttgttgtctgtagcaagaaaagaaacaaagatttctgagacatcatttgtaatggacgatagcaatatggctaaagtgaaatgtttccccgtgttttctgcctataagcaggacacagtgcagagtagcacaaagcacgctatcagaagagtgggaaccatgagcgatattgcagtaccattacatatgttgtttaaattcaatcatttgtaaaccaaactataactattactccctccgtattttaatgtatgacgccgttgacttttcgaccatcgtttgaccattcgtttgattcaaaattttttgtgcaaatatgaaaatatttatgtcatgcttaaagaatatttgatgacaaatcaagtcataataaaataaattataattatataaatttttttgaataagacgaatggtcaaacgttggacaaaaaatcaacggcgtcatatattaaatatggaggtagtacaaattaacttttcacagaccg

SEQ ID NO: 44333 - DNA, 1639 bp, Oryza sativa
agtcgctggaatcaatcaacatgcagagtctcttcgattgtgtctgtagagttgatcggacggcatacacggcgcccgatatttatctctccgatcgggcgaccgacatatagttgcttccaaacaaacaactaacaacttattctatatcggcttattataatccaccttatagtaatatgactcaataacctagattacaataatcttaaactgagacaaacaggaccaaagtcgatggcttctctaggaagccaaccgggagagtccacggccacgctccgttccggctgaacgaatattaaagtacagacaaaggatgtgttcgtaagtgctccttcccaactcccttcgcagttttttatgcgcacgcttcccaaactgctaaacggtgtattttttaaaaaaagtttctatgcgaaagttgcttaaaaaatcatattgatccatttttgaaaaaaaatagctaatacttaattaatcacatgctagtagactactccattttctatgcgcactgttccggttgggaacaacaagcagcgaacagagccaaatttatactttctactaggtaattctagcaattattaaaatttaaaactcaatgtacaagtatgttgtatcattatccattagcaattattatttagatcatctgaaacaacaagatcatctaaaatataatattgtagacttccatatgaggcaccatggtgtccgggcaacaaggtatgaaatacacaaatacactaaaaaattttcaaattgtgagtatatacctagacataagaatttgattcatacatacctagtaacaaaaataactcaaattcaactttatttcgcgaagtgagcgtagctcaactggttaggttctttgtggtggaaccagcccacccgggttcaaattctagatttgacacgggtgctcgcatttacggctaattattctttcagtggtaggcgacgtacccgtcgacagcgaggcgcctgtggtgactttgtcaatcacaagacatgccggctcagtctttcggaggtgctcataggggtagggtgtgcgtgtgtgcgttcataggggtgagtgtgcgcatgttgtgagcgcctgcgtttgtactaagtttctcaaaaaaaaattcaactttatttcacaatccattattgcatacctaactaattatatgtttggatgctatatatctagaatcaaaatctaaccaaaagatgttcaaattcagttcaaacaagtttgaactcgttagtaaataagttaatgttcatacctaaacattttaaaaaaaatcatactcatttgaattaagtatatactcaatttgaatcttggtgcccgggcaccatgaagccccagctaattttactatgtatatatgtgtgtgtgtcaaatcatcttcctcacatcatttttaaaatatttcaatattcatcatttctataatatttaacgtatattcatccatttatttcacaccaaagcgcgggatatcacctaataaataagaaagttattaacgtatgatttattaagtttaattattttaaacttttaaaaaatatctaatatttgaaataaattcccatatagaaagttttcacacgtaatacaccatttagtatt

SEQ ID NO: 44334 - DNA, 1588 bp, Oryza sativa
cccaccggtcaaacccgcctactaactccccccaccacccacctcttctcagctctcgtcccaggatggtgcagtaacacgacgaccactgtgcagtaacgttgtgtcttacgtgcagtaatggcgttaaaatatagttgaaatatagtcatgacggatctacttttgataagctctttttttctaacatcatggtgcaaacggttttaaaaaaccttacatcacttgggagatattgttcttcaaagcttgacttttttgcaatttgtctctctacaagtagtaatactatactattacttgttattacttgtctgttgtacgttactataatcacatcacgatgttactacactgcgttttactatatttttgggtagtgttactgcataaacacgtggtaacgtgtaccttccgtgcagtaacacttttacttttgtgcagtaacaagtatatggttagcatctgagacttttaacctatatatttttgtttcaattcctaatttactgtaattcaccacaatattactgtcacatcttacacatgcagtaacgctatattggatggaggagaccaattttcttgagaagagggaggaagaacggttcttgaggaggggagtacatagatgcatcttgaagtttaatcctccacatgcagtaacactataacatcatggtggaaacggttttaaaaaataatacatatcttgtgatatattgcttttcaaagattgacattttgaactttagccctccacatgcagtaacagaatgtgtaatttacgtacagtaataggggtatatatatgcagtaacatggttttaccaaatgtataaaattgttcaaaacactcctacatcaatcagacatcgctcaaagccacctacagactttacctatggcccacctatttgatcttcatctcgtaaaaatgacatagtaacactgcatttatcatgcagtaatatagctacttgaaagtggtaacatgcacctattatgtagtaacacttctacttttgtgtagtaacaagtatacggttagcatgtgaggctttaacccatatatttttgtttcaattcctagtttatgtagtaatactattcaagaaatgcaagacactttgttactgcaaagcttattgtctttactagactcttatagtaacgttgtgatagaactgtagtaacgtgtaacgtacagttgcaacaagtaattctattgtattactacttgtggagagtcaaattccaaaaagaaaagcttttaagaacaatatctctgatgtcatgtatggttttttaaaattatttgcaccatgatactagaaaaaaatgcttatcaaaagtagatccatcatgactatatttcaactatatttgagcgttgttactgcacgtaaaacacagcgttactacacgatgaccgtcgcgttactacacagtttcacgagacgagagctgagaagaggtgggtggtgaggggagttagtaggagggtttgactgagctttgaccggcgggagggggaggtgggtgtatatatatatatatatatatatatatatatattatttctata

SEQ ID NO: 44335 - DNA, 10093 bp, Oryza sativa
agaggtacctatgctcatctacataggtgtcggttctactattcaccgtcaaaagctatcataattcttaaggtttaggtgataaaaaaatcattgtcacatcttaacaagtgtaaagaaatattgccatatcttttttaaagtcaacaacatatcggacctacttggttatatataacggaatattatcctgactatggctgtaaccaaacggctaccttcaaacttgtctaatcgtagacgctacacactgcgttaaaatgtggatgcaaccaaacaactcctacataacattgctataaaaatattctctatgtttcaaaatattagtatttataggttatcatggtgggacagtagttcttatattttggaacgaatagagtatttataggcatgacatatcgaaatgggtagttgggagcaaaacgagaagaaatttgaatgtgaatttgaacgaatagaataggtgtaaaatagaaagtttttgaaatcagcgtgttttatgtatgtgtagtaagaataatccgtcgataacctatcatctacaataaaaatatagggtcatttttctacccgatgatatgataaggacacgcctacgctgtccgagaatttagcccgatctttcacggcacaaaagaatatgaaaatagcttctctgaattttggtccaaaataattcagccttaacaatattgcactctggagctcttctcggcaatattgtaaataattgagtgtatgaatcctcacggcaaatataatatatttcataataatttaattggataataatcaatggcctcaactacagaatatatcaatatccagtgactcagcaatagtagttctcggctagaaaaaattatccagcgaccaaacaaaatcagattattaatgtcacacgcacgtatatcaggctcccaattgacgcacgtacgacaaaataagaccaactaatctgattatccaaatcaaacaagagcagtagcaataatagatgtaacgatagcagatggatttgtcttgcagagatgcaatccaaaccctagataaatcttccacccgcggtcacgacgaaccatgatcagaagagagggaattccaaaaaaattccgatctgaacccaagcagtagcttgatcacgaccttctcaatccaagttggatcggcagcagatagatgtaggaggatgcgcctccagggttcctagtgttccagcacagaaccacgaagaatcaccaaaaaaaaaacaatctccccttcataaggccagacctagaccatattaattaaaactagcaataatcgcgcagcgtatgtgcgtaagatgatacataatatatggttgtcagtgatatttttaattatacgtaagatgaaaaacttatatgtaagcaagcataatgattgcacacagctggcacttgacaaacattcatctgatgaacaaaatatatacacatctccagattcctgtaataaaacatatctccagactccacatatatatcatgggcatttattggaatcccatatgccatcagctccaattgttttggttatctagttaactacaaccaaaggactttcggaaaagacaaaaccattaatagtattgattggtaccatcagagaataaaaggagatcataaataagacggttaatatcaagaacacatcacccgtaaggcacatactgaacttggtgatttctcaacctggtgataacaattgagaagagtatgaatctactacagacattacatctcttgatctatctctgctctcagtggtacacacatatacatatacatatatatatatatatatatatatatatatatatatatatatatagacacacacacatatacagatatattctaatctctcccattaatgcttataactccaaacttatgtattcaatttctaattaatctgtttgaactaatgttttatataatcaaatatattattttcttctaccctatagagtccaagagatgtaagctcctcaatgactgatcaattataataaattaattagatacagtaatcattagtagtacttcagatatatgtgacagggcgatcgatcagtcacgtcgcgttggaatttcagatatattcgcagtggattcagatcatgtgcagtactgcagttatagctatgactgcaacttaagaattgcatgcaatttcagccgtccatttatattatcaacggttcagatctagtgatacagtgaccgcactaacagtattctgtgctacagtatttatgctacagtgctatgaatagtgcacctcgctgatctggaccgttccatctgcatccgttgatgaaaactggtactgcctaagttgcagtcccagtagcgactgcacctgatacggattcatgtgcagttgcaggtttctgttgtttaattattaatgtttgttattactgtaatgtggtttttacctccaaattgtttccactaattagtatttatattaggccctgtttagttccaaaataaaatttttcacctgtcatgtttagacacatacatggagtacaaaatgtagaaaagaaccagttgcacagattgcatgtaaattgcgagatgaatattttaagcctaattgcgcccaagatttgacaatgtggtgctacattaagcatttgctaatgatggattaattaggcttaataaattcgtctctcagtttcttggcggaatctgtaatttgttttgttattagactacgtttaatacttctaatgtgtgtccgtatatccgatgtgacacgcaggggcaaaaaaatttgccaactaaacaatgccttatttattattattattattattattattattattattattattattaaccttatatagttaagtatagactcttacgtccccacccaatttatcctttaataaactatgataatatatatgcaattaaaaaacaccttacttttacttttgttggcatgttttctaaagaaaataagtctaccttcttttcaaatgatggaaaatattataaataattgcttatagatattacttaaatatgatataatatgaagctaacatgttagaaaattataaaagcaattaatgtagacgaaaacaatttatggataaattgtggcagatattctgcggttagtgcttacttttataagtgtctcaaacttagcgacgcatgaccgcgcaaatgcgcgggctatcttcctagtttttatagaaataagaagtcaaagttgtgttttggagaccgtgtcgctatccaaaacgacttcctttacgagtacggagggattacgtattcaacataatggtttctttatattaattaaagtatattatgaccatattaatctatactttctatatagttggtaccactaacttctaaagctcaacatgcaaatgtgccacatcatcatccactagcaattaatatctagagtattttagatctcatgcaaacatgatatatcatttgtaacttaatatacaagcaatgttaaatcatcatcttcatattatttaaatatatacatctaatatttttataatgtataacataaattcatccatatatctcgcagaaaaaaacaccactcaggattctagcatgacccaagtaggctctaattagcgcatagctggcccattacaggcatgtcagatccatattaattaaaatatagctaatcattattaataccggcaacatatagaaacatatattaaactatccggccacgatgcaaatctcaccattagcattagcattatgaacctcgtactagcacttgcatgcagcatttttggtcccaaaaatggctcatgtgaagtcgacctgaatgcaaccaatttggatatattttctttgcttcttttcttcccttttcttgtgaaaattaactcctcaaaaaaatatatatttgatgatagacaagcgctagtaaatttctccatatttttgccaaatttctcatcaaaataaatagctccaaattaaagaccagatgatattagagaattaccaactacaatatttaaattatcgctagtcatgtctccatgaacatcttgacgagtcatgggctcatcatcctcccttccttgaaacaaagcgacggtttgacttatatttaacatcttctaccttagccggcctcactctctagtgcaaccttagaagctttgattgtagtctcggatagcatagtaaaatcatatttaatggtgcaagcggaaacataaaaagaattgccatcaaaattcccataagtaccaataacattcagaagtgcgagcaattgcattctcacctgagctctcataagcaataattttagaacgtacggtcacatcattctctccctcttgaagtaaagccgtcctcggctttgaggtaggagcaatagcctttttcttcactttcaaagcagcaaacacctcagccttaagggcaagtactatgatgcttaatgtgttgcccctaaaaatgtcatgtaggattgaatgatgaggtggaagtaataattgaggaaagagaatgtgagccacctctcatgcaaggggcaacctccacacaaaccccaagaaaaaggagatgaaagaaagaggggattggacaaacaaataaaataaaattatttgggttataatgagagaggtggtgtagatgtggtgtattgtatatatcaccgcttatcttacatggataaaattagatgtgacaactacccctactataaaacttgccctaatagcagtatccggcatcggtttgagcacatgatatatgcccttgtacataaaagaaaaattattggaacgaccaccgtgagtagcatcgagatcaaactgccgaggtctacccaacaataaatgacaagcattcattggtgcaatatcacagtccactatatcaacataatttccaatggagaatttaactctcgccttatgagtaattttgagtgtaccactttgattcatccattggacattacgcggcattggaagcctccgcgtagacaaagacaaagcatgcacaatatttgaactaatagcatttgtgaaactaaccaccatcaataattactctgcataccttatcttgaattttgcacgcagtctgaaatatattagatcgctgccctttcacatcaacaggagtatcatcactgtgtacttcccatgccatcatagataaaccatctgaagcatcattagtatcatcaattttatggtcagactgaatatcacaggaagaatcactaacatgcaaccccaatgtagaagaaagattaccactctcatgcataactgtctggtcaagcactgcaccctttagcaataactgagaatcttcttcatggaattctttagaactatcagttggcttggtagctagagattgtaggatagcagcagcaacaaccttttccagtgaatctgttggaaatttagtcataattcggcatattttaattcaaaataacaagataataaacatgatatttacaatgggatttgatccagtgatagtggtgaatgtaatcaacatgagcatgcttaatgtagaataagcatcaacaatcacataataacacaatgttgacattgcgatgaacattaacagtaaaacttctaattgaaataatgtaagaaggttataccccaagaatggtcctccgctggagtttgaggcagtattgcctccgttggtgttgacgggagcctccttctccttgtatccagtgttgccgttgtctccagtgttcgacatattggtgaaggtgaagtagatgttgatgaacagtgagtagtcgcgccttgcgctccccaaaaacctgatcgcccgcccgtccgtgcaaacgtcgcagcagcgcgtggtttcggaggcctactctcccaacgcgtgtgcacacactcgtcgggataggattaccacagcagcaacagcgttggaaaatggatgaaagtgtgtctcacaattctcgcgggagatcaaatccattctcattttataagaggaatggaagatgaagagtaagagtcatggaataggaagaggaatagagcaactaattgtcatcaactagccatgaaccatcctccactacacaaccatcaaccaacaatcaattaggagtaattgatgtaagttaccaatggaataggaagaggaatagagcaactaattgtcatcaactagccatgaaccatcctccactacacaaccatcaaccatccatcaattaggactaattgatataagttaccaattccctaaacaaatggattaattctcaaaacttttcatcctattgatatcctataaaagaatgaatacacatgaattcctagcataatgaaccttggaatttatttgatttaattgatttaaatggatcaattacccaattaaatctaacagaatcaagtgaataaacaaattttcgtcgcaacacaaatgtcatatcttcccatgtctgacaagggtcatccacatgaagccaccatagcaaaacatctttatcaaatgtctcttctgcataatacatctttacgactgattgaaaaccacggccctcaaaaaaattctccatcgcatcttgccaatcaaaatactcacgaggacatgtttctagagatagctttggcatacatttcattttcttgagcaaaggaaaatgatccttcttaccaaagaagccaaaagaaataccgagctgtaccatgagcaacccaggctatgcctacgctgtccgagaatttagcccgatctttcacggcacaaaagaatatgaaaatagcttctctgaattttgaaccaaaataattcagccttaacaatattgcactctgaagctcttctcggcgaggtcaaccgggttttggcacggttgataactagaggagacgtggtgttgcgattgcgggactcagtagcgtgttcgttcagaagccggatcgagttgtgtcgcgactccacccaaatcgactgtttattagtacctatcaaaagatcgagacctaacatcctcatcagttggtatcagttggtaagggtgtaaatggctaactttgctcctcgtagcttctcatagaatctccagctattaaaagctccccaaccagtctagattttcacctagattctaagaagctatagttgtagaatccaaaaaatgaactaaaagacaaatgattctcacaagcttcttttcataattttaagctccttaaacatggtctaaaccactaaccaacttatgttgatatataagtgggttcacgggttagtcacttatacacccctactgataggtttgtaggctttttgaacatacaaagcaaagaggctttatagtttcaaaagaaaatttttgggtattacatcagacgtttgaccagatgtcggaaggggttttcgtacacgaataaaaaaactaatttcataacttgcctgaaaaccgcgaagcaaatttattaagcctaattaatccgtcattagcacatgtgggttattgtaacacttatggctaatcatggactaattaggcttaaaagattcgtctcgcgatttccatgcaaactttgtaattagttttttttaatctatatttagggcatgtttgggggagcttaagattctgagaagcagctggttagaaatcagcttctaagaatctggaaaagctggttttccagcttttgacttctagttcattttctagattctacaattatagcttctcagaatctggaccataagctgtactgtttaggggagcttgtgattttaggagaaactgcaacagctagaagcttcttcaaacaagcccttaatgctccatatatatgtgaaagattcgatatgatgtttttaaaaaaaattggaactaaacaaggtctaaatggaagacagataaaatcgatgtcggagccacggacgcattagtgccctgtccagttccgtcgcctaaaatagtttgtactactaatcgttttattttttttaagtggtaaaaacccatattaaaagaacatagaacatttaagcatctctttaaaacatagcattgagaaaacgtaagaatagaaaaaaaaaaggaattttttaagtataaaatagaggattgtaaaacataaaatcataggaaaaacgtgaaaacatagaggagagataaaagactcgaagaaaagatttcatgagcttctacctcctattattttttccttaaaatttgtatagcacgaggtattccatagaaatactgttcattcctttgcattcaaagggtcatctatgaaaaaattccgtaggataaacaagtttaatggtatagccaactactaactccaaatcacttatagtcaacttaatagccaattcatacaatagttatatactacactattaatacctagtctcacctattatacacacattgtatcttaaagtccgtgctataactgactataaatctgtagtccgctgcttttctctctgttttttcatcttcttaaaatatatttatagctgtcttatagcctgttattgtaccggctctaaaacacctggtatacaactttcatttaaatcaaacatttgtgccaccataccacaactagcctaagagcaggtacaatagcagactaatagccagctgcaaacatattttaataagataaaagatgagagagaaaagcagcgggctatatatctgtagccagctgcagcacggaccctaagacgcaatatgtgtatgacatgtgggaccatatattaatagtatagtaagtaattattgtataaattagctattagattagctatagatgaattggagccagtagtgggctatactattaaacttactctaaacttagttatggcaaagttaggcatcaaccaaacatccccttaaattttaagattggggtcatgagccaatagggagttggatgaccaaatgaccaatccatggaagggatgggattctgagtggacgacctggctcatatcgatatggcgcttcattttcacccttttctttgagactaccgttatcatagctcgccgtaccctttcaaattcgtgtatgtcactgcaggtggaccccgcggtctccgggccccgccatgtcagtgggagctgggggaagcacggcgaggtgcgtgaagcaataagcttcacctgtcgccatcaccgtctcgggacagctgcctgctccttctccatctctctcaccgagcgccgcgtcccgcatccttgctcccggggccgccgccgccgacgacgcctagcagcttcgggttgcagcggcgctgagggcgagggagggagaaggccggccgtcaacgaaggtggcagttgggggtgcgcgctccggtcgctagccagctagggcaagggccggaggccgcgagcgccgccgccgccgcccgtctgccaccacctgctgccgcgggtcgtcgttgcgggagccgacgtccgcgggcgcttcgagaagcccgtgcgtgagcacgccgccgccgaggaggcggacaagcgcggttctccagtcgtacgccgcgtcgcgtcgctctctggcgcggaggaagccaggaaggccctgccgaaacgtaccggccggccacctgctgctccctctgctgcgtcacgcgccggtgagggagtcagggtcgaagcgcgcgtccgcggcgctgagcttcccacactgcgcgtcaagtcgagggaggagaaacctgcgcccgccctgccgcgcgcccgcctcgaggcacaggtacgcactgatccgctcgtccgcctgccgcgcacaacacgatatgcgccgccgccggccatttcgcgcagcttctgcgtgtgcgtgcgactgctgcgcttatgcgctacgcgcgctcaccttgtcaatgcagtgcccgtgcctcatagagaagagatgggtggattggccatcaggcgaagcaaaacagctacacacacatactgcagccacgcctagttatttctgagttctgagcgctaaaacagaagacaagtttggttac

SEQ ID NO: 44336 - DNA, 1136 bp, Oryza sativa
aataattacattggcctatttgtacatttgatgatatactttgtacacagagtctatggaacgtggggaaaacattgaagtgaatgtcgatgccaagtctgattcagtactgtaagttgttccctttcctctaagttttgtattttttttcttctacttaggaaaattgaccttccacccgaagttagttgtccaagtggcttttgccccacggtggatatattggacttatgatttactccaaactgtagtgaaaactagtcgttttggcatattttaagcttttaccttccatagatgccaaatttgcccttgtatatttctcttagttctccacatgcacatctattggtggtgtcccacataggcacataatttactgttcattagtaggaatggatgtgttttgctctgaaggtaacctatcatgagcattgggccatccatggtccaactgtccaagattcacacagtcaaaccaacgagactgatcagagcgctgccaaggaggcccgcacgaagggttgtacatgagggacatgttagagaggttttcttacaaataggatatatgttaaattggattgttaggtgtggagaggttttcttagaactggggtatatgttaaattggattgttaggtgtggagtttaattagtaatactaagcaacctatcaaaactaaattattgttttcctcaagtagtatggggcaaatcatcaaaacaatttgcattttgggttggggtggaacctaggttaaaactaaattattggttagttccttgtggtggaacttaccatggaaagaataaatagctggtaggtgacattcttgttgacaatgagacgtccgtggtgggtgtacgtatgtatgctcatatgggtgagtgtgcgcgttgtgaacgtctgcgtttgtattgtgtttcttgaaaaaaaattgctttgggggcaaaaattgggtgacctacttactttggcctggtcaacagaccgcattttccaagtgcaaaagttatttcttctgtcaatttttatatgctctcaaatgttgctttttgtttcttagggcacatatcgtgggtaatttaccagtgggacaggtaatttcacttgaacttagatttcttcaaca

SEQ ID NO: 44337 - DNA, 1316 bp, Oryza sativa
attgagtggtttcccataccacacaaatgaggctttaaggcctgacccttgaactcgatgtgcaatcgagactctgactatttcatgtaccagtgcccattgatttgtttctgggcagttgagtaccaccttccgcaccgtgtcatgcgacagttcgggaagaaacaagattggccggttgaggacatctcaactggagttgaattacataagtaaatatttcttatctttgtttgctttcattgtcaatgttcaattttgtaccatttaacccttgtcgatgctcactactatttcatcaccttctacttgtctaggtatgacagggtgagaacaaagaaggtgaaagactgggggctagagcataatagatacattgatgaatggagaacagccggaaggaacgataggtacatcgaaactatacaccaaaatcatcttttctcagagtaccttcgttggctgcataggacatatagactgttcctccgccctacttggacggaagccgacatagaggatgaccgcgactccgatgaggggcggaattcctatgatgtccggactagagttggatatcaaatggagcacgccccacttagagacagagtcgtaagttttcttgcatttatcaaagttacttacatttgcaccctagaccctaacatatatcttttcaagctttcagtcgagagagctcctcaggagtgtgaatgaaatggggcatgccctccaagctccgaggggtggtgaggacatggagaacacgctccgcaatgttttagaggtaaaatttatttagcactttgcattacttgagttattcctaacaaacttcttttttttttgaaatgcagaaagttcgtcaaaggtgccggaaacttgcagcaagattaggttgcaggtcggttggattggacgacgtgtaccaaccggggagactaccaccaccactacctcaatccgcgcgtccaagtactgctcgacactccatcaggatagaagagcgtgaaggagttggtggctcgtcgtcgtcacgcattaagcaagggaggggaaaggggaaggcgccggctccacctagcgacgacgatgacgatgaggacgaggaggatgaggactacgtcgcaccagacgccgaggagatagacatgtcacagcttcccgacgcgcctcaggggacgcaacccacgcaatacaacttgcgatccactcgggcagcgaaaaagaggtaaaatgagcttaccattctcaaatgttatttgatttcccttattttgtttttaaaatgttttaaacattggattttcaaatgt

SEQ ID NO: 44338 - DNA, 1549 bp, Oryza sativa
taaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttattgctgaacagcagaagcaattcgaggaagccactactctctttgtgggatgcattcttagcgttcttggcaatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcaaacgggctcatgagatacaaaccatggctaaggaactcgaactccttaagtgtgtcttacccgacaaatttgtggccgggtgcattattgcaaaactacctccatcttggagaagtttcggtactgcactcaaacacaagagacaggaatactccgttgaggggttgatagcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacatcaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatatacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctaaagaacgtgcagcatgtcccttctatcgacaggaatcttgttagtggctcccgtctgactagagacggatttaagttggtttttaagtctaataaagtagtcgtgtctaaacatggatattttattggtaaaggttatgagtgcggaggcctgttccgtttttccctttctgatttctgcaataagtctgtgaaccatatttttggcagtatggatgatgaggctaatgtttggcattcacgtttatgtcatattaattttggcttgatgtctcggctttccagcatgtgtttaattcctaagttttccattgtcaaaggtttaagtgccatagttgtgtgcaatcgaagcaacctcgcaagcctcacaaggctgccgaggagataaacttggcaccactagaactcctacattca

SEQ ID NO: 44339 - DNA, 1311 bp, Oryza sativa
  unsure (1)..(1311): unsure at all n locations
gtctgatcgcggtgcggagtttttctcgaactattttgacttagtctgtgagaaacatggcatcatacatgagaggacgcctccctattctcccgagtctaatgggattggtgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagttttttcccaatgaaggatacacatagtggttcgaaccaaccctctgaaataattcccaattcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtaatgaaatggattccattatcgctaacgggacttgggaggtgacagagcgaccctatgggtgtaaacctgtggggtgcaagtgggtgtttaagaagaagcttaggcctgacggtactattgaaaagtacaaggctcggcttgttgctaagggctatactcggaaagaaggcgaagatttctttaacacttactcacctgttgctagattgaccacaattcgtgtgctactttccctagcagcctcacatggtcttctcgttcatcaaatggacgttaagacagcttttcttaatggagagctggatgaggagatctatatgtatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgtagtcaatgaggcagataaatgtgtgtactatcgccatggtgggggnnnnnnnnnnnnnnnnnnnnnnnnnnnnnnnnnnnnnnnnnnnnn

SEQ ID NO: 44340 - DNA, 11034 bp, Oryza sativa
  unsure (1)..(11034): unsure at all n locations
nnnnnnnnnnnnnnnnnnnnnnnnnnnnnnnnnnnnnnnattgaaaagtacaaggctcggcttgttgctaagggctatactcggaaagaaggcgaagatttctttaacacttactcacctgttgctagattgaccacaattcgtgtgctactttccctagcagcctcacatggtcttctcgttcatcaaatggacgttaagacagcttttcttaatggagagctggatgaggagatctatatgtatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgtagtcaatgaggcagataaatgtgtgtactatcgccatggtgggggtgagggagttattttgtgcttgtatgttgatgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgttttggctacattgatagtaagccttctccaacaccttatgatcctagcttgttgcttcgcaagaacaagagaattgctaggaatcaactagaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcttgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgtcttaatgagttatgttggctttaattagcgaagatgttgtcctgcagagcattcttgaaagaactcacctttgtgagcttgactgttggtcgcagtctatgaagattttgggtgaatcttctaggaagcttactaaagacctaggagtatgacttatacgctccatccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtatattggaaaaggcaaatctcagtgggattttgagatttggtgggggattgttggaattaatgaatgggccttagcccactcgaagattaattctttggaaaatcacaaaagcccacctcatggggtggcatgcatgtggagtttaataccaccttgtttattctaggagagggggacctccttaaaagggaggatgccctcctagccacttgaagcatgtgtggtggagagaagaggggaaacacgcgcgcgctcgcctcgcctcgccgggccgggccgggccgggccgggcagcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctaatcaagcgacccttctctatataaaccgatctgccgtcttcacgcaacatatgcgaaatcaatctagggtttgcctcctactctgtactgcgccgtcgctcgtagactactccatcccgctcgctggcgtgcaccggcgatcgggagagcaggtctccgaaacctctgccttcgacgtcctgcaccgggagaaggcggcaataaggtttttgggaagcgcttcgtgcgactgctccctgtttgttcgcgacggctcgccttcctcttcgctcgcgtgtttcgtgccttcgtagacacctgcgaaaagtttcaaccaatcagccggtctttccgtcatctcggtacgtgttcaatatgttgcgcatatttgatctgttcatgttatactgtgtagtttacatgtatagatctaatgatgcgttcatgctagttttcttctgtaatgtcatgatttatttatggaatagattaaatcattatatatctataatctcaacaattttgacacctcatcgagccagtaatctacatggattgtttgttccactaatgatttgaatgatggtcctgaatgtaattcagttcactgatgtccgctcggcagcctacttcaatggacatcaacacaacatagaagctccccatcagaatcgtaaaaaagaataccgaatgagaacatacattacatatggcattcatataatgctactggatctcaaacttgtatattgctgatggtgtgtttctcattttactttttacagctcaatgttttttctctatgccattcttattctcagtttgtttgtcataacattagtaaaacatcactcatcgtggtgtacaattgtatgacatgtacagtccaaacatttggaaatgaagcgagcagatattaacagtagctgaggtaagtcgattacttccactctgaattaacttgacagattctataaggaattataaatgcagctgttaatttgatttacctttgtacatgattcaagattcaagtgcaggagctgaaaggttttttttacccctgatcaagaagaatatgaaccttaatggccagtgtttactgtggttttacatcatgattcacttgatggatgccaaagtgcaaatataagcccatcaaatgtgtccttacctaaatgtgtatttgcctacgtcgctgattgggacaggttctgaacttctgtcatgtccctttaacaacaattatttttggcatttagtatttttcatagccacactttattcatgtagataaacaaaacctcttggtgatattgctaatttcagttgaattaagtataataaagtatgctagagagaattatctctccctcactgctgacaaagggaagaattggttcaaatgaactatgagtatatgtagcacaagaaggaagcatttctagagcaataaacttgtctgcctctacttctattagaggtgagctgaaaacaatctataattctacttgaatacaattagcatataaatacatgtcataaactcacagtgtatgaacttttgtatttgaattcagaatcaacaacatgatctgacacgcacatccaactaaggggagcataagacaggcttgcaatgaacaagctttcgaagaaatgggtccattcaataagatgattttttttctcgacagatagaaaccgcacttcatgacttcaacttagtttgtataggcagtaataagccccataaaagacaatactaagaattttttttgggtaaaaatgaatgttttttccacataagtttcctataatagtaatatgatcgaaccccttcctcttttgatatgggttttcacttgcaacttttcttgtttttgcagcaaacttatttgcaaagcactcaattcactaccctgcaattgcttcacaagttaaattcgtgctttgaaatttatacaattcattcataaatagcccaccatccagctgcaattaatagtttcgatgttgaaatgcttcgatataacattggaacactgggctatccttttcttagcgatgtgaactgctctcatcaaggggcaacattaattggaggtcggaaagtgtgaggaaaaaaaattcatggcatcagcatttattcagctggatacttacagttttcttttttaccagaatggaaatactgagtatgtcctttgtacaaacaccaagggcagatgttgtaaccaataaaatactgcgcaacttaagtgcaggatggacaatatatttcttcatggcagtctctaatcagttagaaattggcctaccgattcagcagtacatgtcatttgatgtgaaactttgttggttttaggtaattagcttgttcgtttgatttatgtgtacttttcccaatttcttttttgtaaaataggatatgtttgataaactcactattgtggagggctcatatattgttgttgttttatagtgtgtgtgtgtctgagattttcatctaacacgcacatatgagatttgtgtataacaacgaagctaattatttgaatcatcgaagagttcatactttgcgccaaaatttgatctttccaaaacatgtattgcacgtgcatgattactagttaggggggggaaagggagaaaccgggaaaaaaactgcaagaaaaaaccaaaataaacaactagagaaatttaaaaaacatatatgaaaaaaaggccacgcgccacttgccctcgcgccctcccatcgcccctcgtggttgcgccgcgcaggagagggcgcccgcccctagccgcctggtagccttttcaggcctcttaccgtgcaagctatggggccgtacccttagctcaaaaggttgacaaaaacacccatgctacagtacaagcacccatatatatgtggcttaattggatggagacactggtaaaaggtaccaagcccacagtgagcgtgaccctaccacgaggagacgggggagcgcaacgaaattatttcctcacctaccctcgcctgcgcgtggactcgtttccatcccattacatcgcccttgcccctccccgccgcttcttctccgccccaccgctcctcctccacgcgcggcggctttcttcctcctcctcggccgccgccgccatctctggcgccgatggggaggcgcggtgtcggtcggaacccgctctctcctcggggcgctcgtcctctgcgtccgccacctcctctccctcgttcttggcggcggctcgccggtgcgcccgcagccaccagttcttggcggtgggaggcgcccccggctgccgcggcagcgttggccaccaccaccgtcgacctcgccgccacccaccgcgtcggccaccaccaccggcctcgatgcgtcggaggatttggattgggagttcactagcagcagcagtagaagacaacacaagcgcagcagcagctgcaggaagggaggatggaggagaagcagcttcaagaatcaccaacaaagagtgagcaagagagagagagaggtgagaaaatggtggttcttttgatctatatgccctgcttctgtttgcagaaatgcgtgtgtgcttgcagtattgtcttgtgggttgtttcttgggtttttttaattgtatgtatggccattgttgttgtgggaggaggaagaaagggtgagagctctcttgattgcttggcttctccaggtccatggcttgtttcagtggtagctagggataaagatcaagagaaggccttttccttttgcattgcatacttttttatttccttttcgtgcactctttgtttcatgtctttgtggtttctttgatctgaggagcaagttcagtccctttttttaattgaaaaaagccaattccttttgaatcctctcatttccatcttgttcttgcaatcttgctaaccccaaacttaggaagaagctagtacaatgcgggcaaggcaaaaatccagcgcaggagcggaggaatcggtggcgggagaaggaaatcggtacggcgggagaagattttggaggatgaatcggagatttcgccagaggaataggcgtgaggccacgggtgggctaagccacgctgccacagcgcgtgttcctgccgatttcgtcgccgcacgcgccctcgtctctgcgaggtttcgcgtcgctctgcttgggtacgagaaccaagttaggttccgggcgcgcgctccacatcagcggaaatcctccgtggcactggtaggtaacgcgctccagctgtgtgcactgtgagaggcctcacaagtagaccgttgtatattgggtggtattacccgtaaataatgcaaactttgtacagaacaaagtgtattacggtttttctcttttctttaagtaactagtataatgcccgtggattgcgacatgttctaaataaaacttattgacatgaattaaaatactaagcctaccacaattgggcataaatgatgaaacaaatataatcgtagaaataacaacatgaaacaagtaactttgacctgaacgaatacgaattcaatatcatgaactaaatcattttttatttagctatatacaattcaaatacgaggaattataagtttcagaaaaatttaatggatcaaatactgataaaactaacactataaatgaaaaaacaacttaaattagctagaaattaaaaaaacatatttaagcccataaataaatgatccattagtttagaacggttacccatttcattgacataaattagtatgtgagtgatataggagcatggttgggcttaactgagaaggaatattgccgaacatgaactgttcatcgtctttcttagccaaaggcaagaaatagaagaggggaaaatggacgttggtgatccagcgaccaaacggcggtgaggaaggttgtcacgcacagaaatttaggccccctttgattcaaaggaaattcataggaattttaaaggatttaattcctataggaatttttcctatatagccctttgaatcaaaggaatgaatcctatggaatcctataaaattcctatggaatgcctcttcccatgcaaattttgaaggaaatttaacatgaggttctacctcatgttaagaatcctttgagtctctctctctcctcaaattcctgtgtttttcctgcggctcaatcaaatggtcattcctatgttttttctgtgttttgcaatcctctgttttacacttgtattcctatcagaattctatgtttttcctattcccccgttttttcattcctgtgattcaaagggggccttaaccaaatttctaaactattttgtgtataaacccttgtctaagaatcaagacaaggtacacaaaacgataaattaatatacagatctaaacgtaaataaaatataaatacttacagaaaaggcacttaggcctcacacaaaaaaaaaatcctcacaccaaaaagaaagcagcaatggaaaaatgcaatcctatgaaggcttcagctccactccccaagcaaaaactcaactggagtataagccttggtcctttaacaccgtctttagctcagaaagcactacatttctaaaaagagagaataatagcaagactgagtataatgatcgtatccagcaagccacaccaatgattaatttgtttgtcaatttttttaattgattatatgatgtatgtattattagaataacttcttgagctctcaaaattcacagaaaatttcaaatagtattttagggcatgaagaatattacaaaagtatttctagccatgatttttaaagaaaattttaatcccctcattaatttcacttgagaatttgctttaactttaatataaattctcgaaatgcatcatttaatattttttaatcctgaacgaaaatcgggcatgataaatctacccctacaggaatcttatcccaagattctggatggctagaaaaaaaaactaggtgtggacggtgttgttgttcctttctgttccaactgaccgattgattaaccaaacctcatgactgaactggctggattcaactatggtgttctgtcactccataaaattgaattgacttattatgcttttatctgaccctagccttgactgtaggtgctcatagatcttactttccttggactaaactattagcgatggcatctttgataacctgaccctcaggctctgttcgtttgtgaggttcccaactcctcttcctcgtcttccacgtgcacgcttttcaaactaaaagttgcttaaaaaatcatattaatccattttttaaaaaaattagctaatacttaattaattacgtgctaatggaccgcttgttttctgtgcataggttcccatcccccaagccagcctcaccttgctgactagaaattcgataatgattatgctcgggcgaccgggcgggagaggaaaaatcgggcgctccccctgccccccgtgcacgcacatgcctgcgctcccctggcccaccacgtgtccaaacacaaacaactctattgcaacaaaaaaaccccacatattttagaaaccctctattaagtgaatttggtttttttccaccaaaaatgtttcatctagtgcattcacaatgtttcattatgtatagatctaatgttgcagtgaactaaaatactccattgtaacaaaaaaaccgacatattttggaaaccccctattaagggaatttggtttatttttgttccaccgaaaaatgtttcacctagtgtactcacaatgtttcactatgtatagatctaatgttgcagtgaactgaaatattatttcgctatttgctgaaacattgtttttatataaggtgaaataacacccaatttaaacgagtgaaacattttcgatctacttagtgaaacaattccaatatacctggtggaacatcgtgtaacatttaaaaataattcaataataagctaatttttttcgtcggaatatatccatgtgtggtcttgttttgaagatttaattacaacaaatttaatggtacaatcggatcatgattttgataagtaatttgagagaaaaatcagtttaaaatagctttccatgtaaatcgggtgctgacgtcatgctgatgtcagcgtccgattttttggagttttggatcgggcgtcaccccctataagaggaagtttaatagtatagcccacaactagctccaaatcatctatagacaatgtaatagccaattcatacaatagttgcttactatactattaatacttggtcccacctgtcatatacacattaagtattgatgaaccctgagttccactcgtcactcaaggctgttgttggcccgatttttcggtgagttgagataactacgatttgtggaaaaacattgacgatccgactacaaccgtacgagacgttgtgttgtgccttagcgatcgatacacctctccgtgggttgttgatcttgccggtgaagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatttaacaaaacccaagaaaccctgaaggggtacctagctatataaataggggtgggaggacgacctaggggtgcctagggtagtgctccacctggctggggcacaccccacatgggccccacctgggccaggatcccaaatgaagttacaagcccataggcccattataggtgacgcagcaccttgtgcgtgtgattccggccacacgagatggaattcggagatgaggctggatccgttggaaagagggctccgaaagcttttcatcaagtactcacgggccaaaaacggaggtcgtatgcagattcggcggccgtttgaagtcagcagtgtagcaggtggccgaatcggattccagcacttgaaggactcgaacttgatatcttgttgttcatccatgatgtgagcaacggatgtatccgtagtagccatcgtcacatcatcctccccttcttcatggaaaaccgtcctcggtttttccatatggtgttcttcacatagtccattcaaaataacctgtttcatccaatcaaaactagagaaactcgaagtagtgtgattagcaataacatgtttctctaaatccgaacaaatgaaaactctatgcaccaaatatattcctctatcattatatttgccaaagatatgaaaaatagcattagttggatatggcaaatcagacttagcaaataatttctccttcaaattatcgagctcacaaaaatcatcaaactgaacatagcccaaagtatttaaagaagatcgcaattcgcattcctctacttcattagcaatgtgaacaacatgcttagaatcagcacacaaagaaatagtagaactaacatgttcattcactagttgtggcatggatataagtgaaacattatcacacaactcttctttatcacaaggaacagcaagtaaatcaacttgtgacaaaggcaactcagcaattgattccactaatggttgctctactatagcatgaaa

SEQ ID NO: 44341 - DNA, 4433 bp, Oryza sativa
  unsure (1)..(4433): unsure at all n locations
nnnnnnnnnnnnnnnnnnnnnnnnnnnnnnnnnnnnnnnnnnnnnnnnnnnnnacaaagaaatagtagaactaacatgttcattcactagttgtggcatggatataagtgaaacattatcacacaactcttctttatcacaaggaacagcaagtaaatcaacttgtgacaaaggcaactcagcaattgattccactaatggttgctctactatagcatgaaaagtggacaagtgtagctcaccttgagaatactcaccttcatttctctcagcaccatttaatttaccttgcgaactttctttagacatcgcaggtgcttcatcctctttcttctcaagtataccattcaccttttcttggatgtgctgatcttcctgcaaaacgttagtaacaggggagacaaaagattgctcctccaatgtttgcacatcatcattacataagtatattggggattcagaaataggagataaatcacattggtcatgcatcctcgcctttgatatgatctgactctcaatgctacgagcaagcatgaataggtgcccaatatgattatatgtcacactatcaagcaaaacctgaatttcagaactaggcccattgaaaaatctacgcgttgtattttcattgcactctttgagaccactgtagatgatacagaccttaaattcatgaatgtactccctaacagttctgtcaccttgtttcagatgttctaatttctcccgaagagtacatttgtaataagatgtcacaaagcgttttctcatcatggttttcaattcatcccaagtttcaggtttattactaacataagtccaccaaaataaagcagaagaggtaaacttattactagcagccttaatcatttgagcatcagaaaaatcatatatatcaaattcattgtctactgctagctcccaatcaatatatgcaacagaatcatacttcccatcatagaatggtaacttagatgcaacttgttcaaaattatagtcatgtacctcatatgcataacgtggagaagtcgtcatatctcgtcgaaggtgtagaagttgatgttctcgtattcccttacgcaatccgggcatggttagtatgaaacaagaaacacacaaaaatatgcacgctcctatcaactactaggtagtggcagctcaaatatcacacacactcaagctcttacaagtttttaccaaagcaagcggaatggtgatgtacaccgacttaaccaagcaccccaatggaggttggatgtatcgatgccttggcaaacacttgttgtacggctgcaatcagatctgtggagctctgggtaggcttaaatatgtagccaagggatagcaaatgctcaaatcagagaatgcaaagttgaataatggttcaaagtcaagtaccgtgctggtcctaggctagaacgtactagagacgcgagcctagacacaaacgataccacaagatagcaatagtaacaactcatgcacaactctgatatatgaagttcagctcaaacataacagtattttctcttttctttctttattctttcttcttttctttttttttctttccttttcttttctgttgttttttttggtgcggcttttcttttcttttcttctttttatgcacctttctgccttttttttctcactttttttcttgattttttttaacaaaaactgactcaaggaccttaatgtaaggttacagggactcaaatgtaaatataaaatttacagggactcaaatgtaaaagtctaaacctaaaattaaaattatacaaaaatggaatgctgaatttatgccggttccgtttttttcaaacagatctcgaaaccgacaccaaacgaaatttcaccaaggtgtttgacacaactcagaactgagataacgtgatttggagagggaggagggagtcggactgtcacggtggtggtgggtacggtaggtgggagggttcggcctggcccttcacaagtggaaaccaaatccaataaaaaaaaactttccttttcttttctttcctttttttttccttccaccccaccgaatccaaactgatctactatattcctttattcttcctcgcacacatgcacggcacagccaccgaacagaagctatgcaactcaagaactcaaaaactaaccgacaaaaacttctgaaaactacaaaaatagaatcgtggcagcgagctgattccgttttcgtaggtcccgacgacaacagagacacggaggcgacgacgactgtagtataaaacgtgaccagaactcgaaactctaaacggactaaacgctaagaccagcaacacgactcgacgatgcaacacagattcaacaaagcaaaaactgaaaagaacaatgcaatggcacaatatggctaggtaaatgatacaatttttttgtctggctattttttggttataggtagaagaaaactcaccgagaaacgaaagctctgataccacctgatgaaccctgagttccactcgtcactcaaggctattgttggcccgatctttcggtgagttgaaataactacgatttgtggaaaaacgttgacgatccgactacaaccgtacgagacgttgtgttgcgcattagtgatcgatacacctctccgtgggttgttgatcttgccggtgaagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggcaaagcgtgacgaccgcgggcacatcgtcaagcataaggcccacctcgtcacgaaaggctacatccagtagagcggcatcgacttcgacgatgtgtttgcgccggtcgcaagactggaatctgtgaggctgatccttgccgttgctgcgcatcaggtctggcaagtccaccacatggatgttaaatccgcgttcctgaatggggaacttcaagaggaggtatacgtgcagcagccaccaggattcaccgtcggcaaggaaggacaagtcctgaagctgaacaaggctctgtatggactatggcaagcaccgcgagcctggtactcgaagcttgatgcatgcctcgtctccctcggcttcacccgtagcgaccacgaacatgcgctgtacacacagcgatatgcgcacaagccgctaatcgtgggagacgacctcctcatcactggccaggatgctggtgacataaaagagttcaagttggagatgctgcagcaattcaggatgagcgatctcggcatgctctcctattatctgggaattgaggtacgccaagatcacaacggcatctctctctctcagtctgcatatgccttgaagctcttggagaagactgggatggtggactgtaatccctgtcacgctcctatggaggccaagttgaagctgagcaaatccaatactgcagctcttgttgatgccacatactatcgcagcattgttggtggcctacgatacctcgtcaatacaaggcctgatctggctttctctgttggctatgtgagccgtttcatggcggagccgcgcgaggatcatatggctgcattcaagcacatactgaggtacatcgccggcacccgagatcatggtgtgtcgtactcaggaggcaagacagaggagctgaagctgattgggtacaacgacagcgacatggccggcgacgtcgacgaccgcaagagtaccactggcgtgctgtttttccttgctcagatccccatcacctggcaatctcaaaagcagaaggtggtggtgctctcttcttgtgaagcagagtatgtggctgcgacaacggctgcgtgtcaaggggtgtggttgcaggggctcctcagcgaaatacttggagcgccagcgacgacgccaattctcaaggtggacaacaagcccgccattgctctatcaaagaacccggttcaccacgatcgaagtaagcacatccaaactcgttttcatttcattcgagagtgtgttgatgccgggaagatcatcatcgagtatgccagttcagtggagcagctagttgatctgcttaccaagtccttgggaaggcagcgtttccaggagctgagcgagcttgttggtgtgatcaacacaaaaggccaaagttgaacttcacaagatttagggggagatttgttacaaataaacttgtgtcgatctgctttgtgtttttggttctggtagtttttccctcccctgtttttctgttgattctgttagagtcacgcacatgacctcgctggtttttcggccgtgtgcgacgttgggctcgtcgtgtgcgtttagttcgcacgggagcgcgnnnnnnnnnnnnnnnnnnnnnnnnnnnnnnnnnnnnnn

SEQ ID NO: 44342 - DNA, 12262 bp, Oryza sativa
  unsure (1)..(12262): unsure at all n locations
nnnnnnnnnnnnnnnnnnnnnnnnnnnnnnnnnnnnnnnnnnnnnnnnnnnnnnnnnagcagctagttgatctgcttaccaagtccttgggaaggcagcgtttccaggagctgagcgagcttgttggtgtgatcaacacaaaaggccaaagttgaacttcacaagatttagggggagatttgttacaaataaacttgtgtcgatctgctttgtgtttttggttctggtagtttttccctcccctgtttttctgttgattctgttagagtcacgcacatgacctcgctggtttttcggccgtgtgcgacgttgggctcgtcgtgtgcgtttagttcgcacgggagcgcgtcatgcgcaggcacgatcctggtgattgggatggcagtcgccgttgagggatcgtgtccgcatcaaccgggccaacgtgcccatgatcttgtattcgcagaataaaaggaagaagacaaacagaaaatgctgctcagttgttcgcagtgccaaacatttgtgttctgtgtgattactgttcttctctctcgcgtccacgttcgcgtgcgttacgggtttttttgctaacagatctttctatgttgtgatctccccggccagaggaggagggatgtgcggcggtgtgcggtaggtgctctcctccggaatcgccgccgccgttgcgtggtggtggtggtgccgatcccaccccctaccctcccccccctccccccgcggtcgctaactctccgtcgtgcctggagagagaggagaggggagagggggaggtggagtgggaatggcacgtgggccccaccactttttattaattttggtgtgaaactgacatgtgggtcccacagggtttattatttttctataccgaattgccgcgtaagcaccacgtcaatgccaagaccgagtcaaattagctggtaaacgccacgtcagctaaaaccgccatccaaactgctgagggacagtcaagggatccgttgtatcttggttgaaaatcggattcatcgataagttaagggacctcggtgaacttatttctcgtgtaccttcatcgatccagcaccaatctcaacgtgcgcagcgccggagaaaaatccgaccagacttttgtttgttcagctcttcactcccccatctcgcactcagatcccgccgccgcccgccgccgccgccgccgccatgggctccgcccactcctcccactcctcggtgtccacggccgccgacatggacgaggacgacgacgacgagccatcggccgcgtccgccgcggctccggcccctccggcgcccgcgccggctcccccggcgtccgcgtccaaggtgctcgagcaggagcccgaggagctcccctgccgcgccgccgactcgccgctctcgccgcagccctccgccgcggggacgccgcgcctgctcgccgcgggccccaccatcaaggtgtgggacccgtgccacgtcctcctccccccgccgtcgccgcaccagtcccagtcggcgcgggccggggccggggccgaggccgccgccgcgctggaggtggtggtggtcagccacggggagtgcgccgcggcgatgcgccccgacctcgtcggcgggcggtggcccgccgcggcgctcacggcgcgcggggagaggcaggcccgcgcgctcgccgtgttcctgcgatcccgcggcgcgcgcctcgccgccgcgtacgcgtccccgcttgaccgcgcccgcgccacggccgcactggtctgtcgggtgagcgccttctttggcttccctccctagcatattccatgcttctgcattgcgcttgttcagtttaggtgtaggattttgtggcactaacatgtactaggattgaacagaaaatattagttctggtttctccattctgatttgtgattgttttatgcgatattgcgattcggaggaattgtctcaaagatggcagcattgtttgtagcaaagctgcaagcctgcaacatatcatgcatttgaaatcagtgccctttagcaatgggggatttcacctaatgtgatcttgaaaattagcgttaatgaagtgatttcggttagccttcaggcaaagcacttgtgggcttggtgtggggatgggatctttgtgatgtgatggggcaaaaattgctaaatgcttgtgttatgcagtaatgcagtgcatccttactctgttactcatcatggtctcatggatagcataggagtgcatgggccataagatacatgcttctgaatagagcatttagcagtatgtaaagggcgtccgttcaaaattgatgctgtcttgggtcaaagtctcttcaaagtttgctggtgaaattagctcaaatcatagtcatttgatctcttttggtctacaccatggccatcaataagcctaaatgtgaagtatgaaagcacttatgagttacggtgaccttcgatcttgtcaacagtgcaggacctgacagttccacttataggtacaaaaagacattcgaaagaataaacatctgaaggaaataggagtgagtcatttcattgcaaccttcttgatatacttctgaagggagtaccctgggtctgctactttgaaatggtaaatatttaactgtgcaaatgttggaagacaaaattaggggcattaatgaaaactagctctagatgagatgagcctattctttagtagtaaaaggtaggcagctttgaaggatctcttattgcctttatgtaaccggttgacaggtgtattgcatttccacccttgcagttgcagtctgtctctgttttttcttgtcttataacagccctaatattccttgtttgtcttttacatggactgatgtcaaagaaaaggaataattttgtatttgcgaacattacaaaatagtgacatggggatactctgcatgctaaaacaatgctttcaaggcatgctcaattgactttatttttgataaaattggtggctatgagttgtgaggacagtctggcagagctacagctggactttaattgggttttgctatgagagcagttattcttgtgcacgtaatttttcttgctcccacagaacatatggcttcttatgccttcatcatcaattgtaacctgacatcatgatcattaggcacttatttaatgtgtatttgtgctttagtgggcgtaactgtctcatcttagtatgtttgttggattgggtggcccaattacatttcatttgaaacaattgtcatgccgtatgcatctatggtagtattggctagccactgaattatgggtctatgatcattggttatctgttcctttgaaagtgtgttccgttattccagtgttcacaactcatgaccatggaatgcagcttgtatgggagctggagcacaccctctggtgaacatacaaactgtcctcttatgcataagagagttcacgcatagaggttctgccataattacgtgtttcccgccagaataaatcagcaaaataaaaaggtgtatttatttcatgtataaatacccttgtctcaaactcatatcgttattttgcatagatttagattgacttgcaaactctagtaagtggaaaaggcagaattgtttaccctcatgctaaaagtttagtatctggatgtttttatattagttagctccccttttacctgcctgcatcctttctgctctgtccctaaaagtttcacctagatttctagcctctaggattgaattcaatttgagattacaatccattattccatagatttatcctgggcagaaaagcccaatgccttgaaattttttattgttaatcactggtaaggctggttatccattatgtaaacaaatgaatgcaactatcctggtgtctactggacactggcaagggacatgtgcctgctaatctgctatacaagtttgactctcacgctatcaaatggtgacttacatattcttgtgttgtagacttgtcactgtcagtcttggacccaaatgccataagtcaggaaagacagattgaagaagctggggttcaaacccaggatttcatcaactcgctgctttactgttgggcaggctgggtgttcatcaatgtcatggcttcaacagccttagttttaaaaatcacacatatctatcaaaaaatcacaaataatattttgctggtacaaaattctatccaaacctagtacttccctagtaatgccagttatttctgacactactatctgggatagggattttccctggtcctgggatgtaaatgtaactgaaatttatatgtcattcattgctcttagcttttgggcccaggtccacatattattcagacacccggatttttttggaaactatacctcccaagctactttgtgctatgtaggtataaacttatatctgaaactatatctggaacatgtagcatttgacaagtagtggtcctgcaaatgtgcagtcttgttttaattattaattagggaagcggaggaactacagcagatgttattttccctcttcattagtttttatatatatgcattcctctgtttacgttttcttttgattggtcttcagcactgcagttcgtgacatctggcaatgttaatctgcaggaacttgattttccagaggagcagattcaagtatcagatgctctgactgagatgagtcaaggtcagtgggaaggctgcccgaaatcagaagtatatactccagaaatggtcaacctgatggatagcactcagccagatttctcagcgcctgctggtgagtctctcaggcaggtacagtttcggatgatggaattccttaatcagacagtcgtacggttaccagaaaaggtggcaatgggggactcactatcacaacaaaatgaggcgaagggtctgtctcggcaaagttccaccaattctgtccaagatggtcccccttgggatttgctttacaggctcaatcggcatagcctccaaaggaaaaaatctgggaaaagccggcttcagtttgtcacttcaggcgacaatgagactgaggatgacttctcaccaaaagaaataaatcaaaggcatatccttcatgaagcaaatctagcaccctcggtcacctccattgcaattttcagtcacgcaactcccatccgatgcctcgttgctggcgtgctggattgcaatcctatgatatcccagagaatttgcattgaagattcctccattacagttcttgagcattcactaaaaacaggatggcaaataaagaggctgaatgatactgctcatctcagacttctctaaatgcaagcaagctgttgtgctacgctgttcgagaggaatgtatctctttgtgcattgtacagaaactatcagatcatattcctcagatcagatgccaaggccatcggaagtgggagtcttctgattgtatttcatttgtatttactgacatatctaaatgccaggaagatctggccctgtgatagtgttgtattgtatttgttattattctttttttcttgagctaaattatttggtcaagtgtaatttccatgtaaggggggatacatttttaatgtatcattctttttgccgatcactctgttttcattttaatttatcattttttgtgcattgtccttggattagttccatcaaaacttcttgagggtagataatctacagtggatggtaggggaagatatgaaaattgtacgcattttgtagactaaggttaccttcagttgttaaagatgtaatttggaattttgcgatagttgagagtgtttgttccgatttaaaaataaattagaaactaactgtggtgtatggaacgatgccaaaccttattaattatcttcttgttagcattggtccaatattaaccatggacatattgtgttgtgatggcaaggaacaaaacaagaaaagcgaagcaaaagtgtaagtgagacaggctggaagataggcctggacattgtccatctactactacatggtttggttcacttagggtattcataatgcagtggaattgcagataataatcattaaatacatctttgttatcactttagatttcatgtttagagatttcttttaggtggatcccacctacccattttgcacatgcatatattattatctctctaatctgttattattatctgacacagtccatcctagcacttagttttacaacaaatattgaggagatgccttaacaatgtccagtgtaggtgaggttgaacaatcaccaaccgtatcattgccatctccacaataaaattttgtgttcctattctggtaattggcatcgctacctttttgttaagtgtcgtcactatcttctcttgattaatttctcctcatggtttctttccgcgtcacactggagatggccttaccgcccataaaccagtcagccgcaacaccccaccacaaaccaaccaaatcaaagatcactttagatccctgaaaattatcgccgagtctaaactttatccctgaatcacaatatcagatactataatgcatccctcgactcccaaaaccaacgtaaatagaaacccaagatagtttggatggtggttttgactgacgtggcatggacagggcacttaaactttaaaaaaatgtgggacccacgtgtcagtgagtgttcaattaaaaataaagaaattacagttgttacaactacgataaggccaggccagcgatcgatccaattcacagctagggttctacctatcggatatactccctcagctcgtaaatattcgatgttgttgttgacttttttaaatatgtttgactgttcgttttattcaataacttttgtaaaatatgtaaaactatatgtatacataaaaatatatttaacaatgaatcaaataataggaaaagcttaatcttttttgaataagataagcggttaaacatttttgaaaaagtcaacggcgttaaaatatttagtgacggaggaagtatatactacctccttccctaaatgtttgacatcgttaacttttttaaacatgtttgaccgttcgtcttattaaaaacttttgtgaaatgtgtaaaactatatgtatacataaaactatatttaacaataaatcaaatgataggaaaagaattaataactacttaaatttcttgaataaagcgaacggtcaaatatttttaaaaaaatcaacgcgtcaaatattttgagatggagggagtatatcgtctggagctgctgcgacaaaggtgaccgtcggcgccaccgcgcgctcctcgatcgtcatccgctgctgctcgcggcgtcccacctacgacagcgagctctctcgcagccgcaggcaggcgcaacgcttcctttgctggagctcgtcacgacctgtatatggcgccgcgccaccacctgctcgccggccgcatcgtgctcgatcgtccgccacggcgacgtcgcgcgcgacgagctaggctggcctgacgtacgcctacacgcgcgccggtgcccgagcccgacccccccccccccccacatcgacgacctcgccggccgagaactacggcggcggcggcgagactggaaggcgtactactgtacttgtgcgtgtccccctacgttggagacaaattactccctcgtatgacgccgttgactttttaaccaacatttgaccactcatcttataaaaaattttatgcaaatataaaaatactaatgtcatgcttaaagaacatttgatgataaatcaagtcacaataaaataaattataattacataaattttttgaataagatgataggtcaaacgtttataaaaaagtcaacgacgtcatacaggagagagtagtttattaagatgcatgcgcgtcgattaggagaggtacggccgccaataagctcagctagtagcttcttctaccgcgtaccgcctcgcatgatcgaggaccagatcgagaagacgacgacagggagtgcatgcatgcaggagtacgtacgtacgtacgtagctggtcagtgtcgtacacgtactccctctatactcgtaaaaaagaaagtcgtttaggacagcgacacgatctccaaaacacatttttgacttcttatttctataaaaatatttattaaaaaatgatatatgtatgtttttatgaaagtatttttcgagacaaatctatacatatagtttttacattttcaaactcaacaacttgggagttattcatgatttatattcccaagatttaacttaaacattgttctaaacgattttcttcatgagtacggagggagtacgctggtcggctggctccgttcggtcgcagcccgcgcggtgaggctctacctccagcgagcagagcaccaggcccgacccgccccgcccgcgcacggggtttatcgaggcttcagatacgagaagaagaagcgcatgaagccgcagcctaccgacgccagcgacgtcgacaaattaggagacctaaagtggacttattccttaaaaaaacacttatatatatccacaatatgataacagagtataagagtttatcgccatattaattgttgctgagatggaaatgagagagaaaagaaaaaaaacagaagctttattatttaagggcattcccaatataaaaaccagatatatatatagtaagtcattactagctacatgataagaatcatcgtgaccgcgataaatagtacaagtacgaggccacaagagtactatccaaagcaagcaaataagttagtcatatgcatagtattttccgacacagggaaatcgtggtgttcgtcaaagatgcagctagattcacattaccaataggggatgtttggttgcttactaatttaccaaaccacatgttagacaaaaatgaacggctagcaaaatgttaactacaacttagccaaagttagaaaaaaaaataagtgtatgatatgtggagccatatatagaaaatgtatagctagtcacaattgtgtcatcaactaaataagtagctaaaaaactgtggtatgactaactttagacgtggcaagttgtagcgtgcaaccaaacaagccttaatattcagttttggtaatatatatggagaatgccgtatatcctctagtgcagcatagtggggcccactggtggcaggcatagccagcccaattgaaacggggtacaagcgaaatgatgagctcaatgatttaaataaaatattaaaaaataacaatatacaaacagctagttattaattaggtaaaatttattatagaacattaaagtttgtgtaatttgctgctaggcatcgtaaaagcgtgtcaaagctgaaagacactcttaaaaaaactggtaatttgctggagaacactttcagctcaattgtagattgaaaatcttcaaaaagacaagaatacccctatggtcaaaagattttgagctaagattggagtgaagataaaatatgatgtatactagtgatgtacttggggtaatggtaaatttagaattacataatttctaaacttttactctaatgttgtgttgaagcatatgattctaggggcattcttgtctttctcaagaatttatcttgtcaattgaatcaaaacagtcctctagaaaattatcagtttttaagaatatatttcagccgtgatatgttttttcgatgtctatcagcaaattacacaaatttcaggtgttatgtagcaaaatttgcctaataattatatatttcttctcattcatctttttctgacgaggattattttcgagccaatggctggtagctctattgatctttagtctaagtgtgatagaaaaaaatccacgtgcataactgtgatagacgaacaagccgttataatctatttttcatcttgaattataggactggttttttattctaacttttaatttagaaccaaaaatacatcataaacgatggttttcaccgctattatagtgatttttggctaacataggctttattaactaggcccagttccatggttatggacctaattaaatgatacttcctccgccctaaaatataaagggttttggtttgatgtgatacatcctagtactataaatttggactagaagactgtccaaattcgtagtactagattgtgtcccatacaacctaaattccttatattttaggacagagaaagtatctgcattagaaaaatatgcaaaagtattattctagaaaaacagcgtacatttcaaacaaaatcactacaacatatgtagaaggtgaaaaacaaccgctattgttgtgcagagcgaaaaatggactgagtacaagggactttacccaatcatgagctcacctcgtagaagtacgtacgtatataggtcttgtttggatcctccgagctattaaatagccctctgaaatcttgctatttagaagtattaaacgtagattaccgacaaaaccgattccataacccttaggttattttgtgagacgaatctaatgatgtatattaattcatgattagcgactgattactgtagcaaatcatggattaatatacctcgttagatttgtctcgcgaaatagcctatgggttatggaatgggttttgtcactaatctacgtttaatactcctaaatagcaagattccggagggctatttaatagccctccggatccaatcagagccatagtactaccatgcttgcacgtacggttcaagactaaagtgttgtggctctatcattttatctattttaaaatataaatataataatacataagtataaatctatatttagatttatagaactaggattaattaatagaatacagccgtagaggcagcccacacgcgtcatctatggggaaaacaatgtgattagctaccaaggagagccaacatcgccgaatctatccaccaatcttaagattaaatgatagcataattttgataataacatgttaatttgatcaccaatagtttttaaatgatagcataatgcttgtgtctagaatttagcacaccttagggcctgtttagtagagctataactcctaaatttagcttcagtaattaggtttggagtggagttgtggagcagccaaaactcagcttcatctatcaaattcattttgtgagagcgctctactcagctccgatcttattttaggtagagctcaaactgtttaggtaggctccagctctagtagggatggagctggggctataccaaacatgcccttaatttgttttaaaagcatcaatggtgtgggtgcatgacttcactcacctggtgcctacaactattacccttatataggtaagctttctacatgaatttagtaagatcatagatgtgtcactagttttcatctatttgagcatgtgttaggggtgtatttgtgagggtgtgagtctgtaaatatctcgcgagtctggtgttgcatgtatagtagtgtatgctgcgctgacggtagtattgaatctactccctccgtcccaaaaaaaagacaaacccgggttttcgtgcccaacgtttgaccgtccgttttatttgaaaaaattatgaaaaaaattaaaaaaaacaagtcacgcataaaatattaatcatgttttatcatctaacaacaataaaaatacgaattataaaaaaaattcatatacaacgaacagtgaaagttggatacggaaacccagggtttgacttttcttgagacggagggagtactactctacctaccccattataaattttacaaattatctcttaattttttatattaaaaacaaccaaatttaaatagatgtccacatataaaattaataagtgaatatttccaagataggtaacatatttcatgaaaatatatttttatttatttgatataatactttctacttttttaaaaggagtatagataaactattttttttacttcggtattaaatttttcacatacttttttaatatctatatctaagctaaaaacttcttatattttacaacaaagatagtattatgatactccttccgtcccatattataagggattttaggtggattgaacacatctagtcctatgaatctggatagactccgttcagatttatagtcttaggatatgtcacatccacctaaaatcctttataatatgggacgaagggagtacatgttttttatatctataataaagcacgtgcatttaggctctcgtggatgtgacccatcatttctgtccaacctcgtgacgtacaaagatcaccatgggcttctcatgcaagtacagattgaatcacgagt

SEQ ID NO: 44343 - DNA, 6403 bp, Oryza sativa
agcgttgtcatgtttaggttaacccagaagatgtttaaaaaaaagtgttcggttttgttgtcgtgttttttttaccaagtatagtaaatatttacccaaaaagaattaccatccctgcaaaaagaaaaacaaaaaacatgaaaagcatccctcaccatcccaatcttttcagttttcacccatccgagttagtagtagtaattttcagcatgagctccctgtgagccctcctcttacagttgttcaccaaaccaaccacatcttccacgttcttcttctgccacacccattgactcctcaagttggcacaagaagaaaggtatagcctcaaccaacaagggaaattctccgctgtcgcaacatgaatcctgcatagtacatatgccctctccctgaaccctcctcatctcttttgatgaagagaggcaggagcatcctcaggtgtccttttccatgtggctttcatcagagggagggcacaagaggaaggaatcggcagctgcagtattacagccacatgaatacacagagacacagtccaaagcagtatcgctcctgctccttgcctgctgctcttgccagtcgacatgccactctcacctggtctcgatgggtgactgctaccagcaagccaccacggagtagtctgtggctagtagtaggagcctggcaggactgcagcaaagaggcagggacctaggactgcaaccaaaaatgtaccagatttactactacatgttacacaaggggagattggtgagcatttgccattttttatgcttggcataattttctttcatggttcacactggaacccttttgtcaggcaaacgctcagcacctcagaaacaatgtggattgccctctcttctttcaggctttgttgtatgatgaagcgttcctttacctgtttttcgcctgagattcttttaggggttttcttagtacggtccggttttttctttcacttatgttgtttgatttttgttgtcatgttaggttttccttgaccggatcctgtccccgggaagtttactcacgacttcggatggtcccaggaagttactcacgactttggatggcaaacagggattcattgtcgtgttatttaaccgcaaagtcgagctcactggcacgccggtataatagagctgaagcttctaccctgttgatagcaaacatgataaggagtttgagtcatgcgataaaacaggattcaatcaaacggattatcaatattcctcaccatcctggatgaacaacgaatctgcctgttgatagcgcccaattcaccttgtcagtcccgagggagttggccacaacatgggtgacccgatcatcaatttggttcgtgcaaactgcaccgaactgctcagcagtctgccacaaaggatgcatatggggattggcctctccaaccgggaaaatccggctaaagacaatacggcaaccaccaagtatcctctgctgctcagatgctagtatgctccgcacatcagcatcattgagattaggatgagaaaagaagttcttgtgaatgcgctcaataacctatttcaagaattcaacaagtatgtatatcataatcaagttgtattacaatacttaaaagttcagatgtagcagaaaccatcataccgcgagtgaagaagcaagagtaccatcctctggtctttcatctcgatcaatttcaagaagtgatggcccaggaagcccaaactgacgcctgctgcaggggaaataggtgtatctagaggaaaaaaatggaagggggcgtagtaagatgaacctgttgtactgctgttacctcatgtagcaagaaacattagacagattcatacctctctacaacaattaaattgtgtttgttgtgggccagactctcacagagtcatcaatgatcaccgctgcagattccatccccaacaccccatcaagatctttactttttggcactcgctcatcactgtcaaaaggatcaccatcatcgcctcttgagataacacgcccagcaaacagggttccagtaggatcaagaaccttagccatctcagtagcataaaccttgttgcccattgtgtacagatgcaactcataaagtttacttgcctacagcataagtaccaaacaggacaatattcaactctacagtggaaagatgcttatggtcatttgagagatatccaagatagcaaaccttctcaagaaagttccatattccaggtctcagtttggtccacattcccatatgattaaaacagaagagatggcgctctgccctctctcgatcttgttcctctttctttcgtaaaatttccccgtgaatatggtccacttctataaactgaacaggaagcatgtagtgtgttaacaaagtttcaaaaagtaaagttataggatacaaaaccaaatacctttgcagaattgaggagcgtgtgatccaaatcaagcaccaagcaaagtttccgtgctgcaaacatcttgtgttgttccttgatccgccttgccctttccttctgaatgagagccttctgctgatcatcataaccatcaaggagatgatcaacatctccatatgggctagcaggcggcacagcatcaggtgctgttacaggaccagtacttgttgcagcatcatcattagattcattctgtccagcagctaatcttggatctgccttatttacactacttgaagtttgctttgtattgccatgaggaggcataagtgctgtagcagctaactgtgaatttgagacaggatttgcattcatggtgactggccgtgctgatgatgtaacaggtagagaaggcaatgcaatagcctgaagttgctctgccttttggtcttggttgagcaaatggtccttgctgctctgagagtctggcggagcagttccattgcttttggcttgctcaacaccaactggaggaactgtatcgttcttctgcactatgttactatggagtatgcgacgaggatcacgtggtttcatacgtataactccagtatcattttgtgagtgctacacaaaaaagcatttttaaacataatattagtacgagatcctaaatattataacaaaaggatttggaattggcattagtaacacggtggttcaccgtggtatgacgcacaagctaatacgacctactcataataaaaacttagttttacctcatttatgtcccttgatatgcatataatatatatacttctataaaaagagttggcaataatgcaatatgatcactgtctccacacaacaaattgagttggtggattctgttaatggatttttgcgtgggcatctcaaaagttctccatgactcattgacgagacaaaaactatgcatgcaagtgtttaatataaactttgtggatgcagttttttctaacttatggcatgtttatttgagatcttttgcaaacttgcaaagcacatgccattaacatcatatggtatataaaattgtatttgaacccattaggaagcaaacagataaattgtaagtacaaacagaaaacacaggtgcactagtaagagagttaccatgggagctgactgcattggaacttgtggtctaacagaagggactgctgcaacttctgtggtctttggagcattgccaagtggtaaaaccatgccaggagttacattactagtcatgccaacagaagcagttaccttctgctgaggttctgatgctgacatcttctgctgttccatttgaatccattgcatgagcattgttggattgacagcaatgtcttttaacatagcaggcaatgaaacagcaggagcagaactggtttgcggagctgaattagtttggggtgcttgtacaattccaggactagttccactattatttgtcgtattatttaagttactagcaagtgtactatctgtcctgatattatgatttccagttgtgttatttccaagtcttgtattttgatttggctgaaacccatcactagaatatgagctaatattacctccatctttagcccacccacctcgacctgtaggttgcatatctctcaggttgccaatgacacccctagatctttttaacgcgttctcatccaccataggttcatcaactgccttattcttacggctattgattgatactccaccacccatggtcctatctttagaaggatttggttctgcaaaattcacacgtcggtttgcatctgcaacaccaccagtatcacgatttaaaaacttaagccttggatctctacttttagctgtagcttttagcaggtggttggatcctgaaacagagttttcaatctgtttagcataacctggtggaccacctgcaaaactgtcactgttgctgctaactgtgctaggtcgagagggcatctgattcacaattggcaacgcaatcttgtttgaagcagaaaagctcgaaacttcaccaaatacatcaccccctttgtctccagatttatctccatcaccagaaggagttggacttggtagatcatcgcttgcaaagttagacttctgcccatgcttctgttggtaatagcaaacagccttcagtgcatcgttaaaggattgatacgaagaattcttcgcaggctcaactctttctagaaccgatggtctgtcaggtgccattggaagtgctccatatccaatgggctttggcacatcaaaaggtggtttactatctcgagttggtgagggtaagctgttttcgtcataatctgcatgaagatccaacaaggggctaaccattctattctttgctggtatttcaaccttgctaaatgaatttcctgctcctgattcaaatggtagtctctctgataaaacctgaccagatggagctgcagcattagttgaagtggcatttggaccatttgcattgtcttttccatcctcaaacactaactgcctcacacggctatccagctgacacaaagcaaaagaaaaataaatgagcatgctaccacagccaaaattaataatggcagactctaaaaccacaaagtacaaggtttacaaacctcatctcgttggtcaggtgttagcatgtctgaatatctgttttttatgtggaataacaacctacacattcagacgagaacattttagtttatgctgcaaagaacacatagcacattagttctcaatgtgattagaaaaggatgaacttatattacttaagaagcatgttcttggtctgctccctcttcggcatgtcatacgaatttgccacctacaacaatgcaacaactgtgagctttacagtccacaacacagagccaagtcaacagtcggtcttacggtggtaatggtgtcgattccaacaaacgcctgctgcacaagggcatcaagcatgggcattgggctcccgctctctgggaataacggcttcaggttctcgaagcacgttcgcagacgcgtacatgcaccctcaaacgacctacagaacatcagaatcgggtccctcagcaactgaatcatacaccaaaacacatcgagcacatgaactttgccatatagaagtatcatcagtccatacttctcagcttcctcaatggagaccatctcaagctcctcgagtatactccccacacgctggtcaaagtccacttcctcctcctcagcaccggccggcgcggcgccaccgccatacatggccaccatcgactcggacttctccggcgcgtcggagtccaggtcgatggtttcgggcggctgcgcgcacggcggggacgaggaggaggtggtggtggtctgcacggcctccccctcctcgatctcgccctcctccttctcctcgtccgaggtgtccacgacgtgctccacctcgtcctcgtcggcggcgtcggcggcgcggggcacgagcggcttgttctgcacggcctgcgcccacgcgaagctgtggaacgccggcgcgtagctccgcgggatgttgtaccccatccaaaccctagatctctgctgcgccgcggccgccgccgccgcgccgccggcggccgacgactccttcttgaagtcgtcggcgctgatctcctccagcgaccccgacgagtccccgtcggacccctcccctccccctcccccaccgccgccgccacccgccgtaacgaggtctcccccgggtgccacgaccgccgaccgcggccgctcccgcgccatgagcaccaccagcctctcctcgtccttgggcgtcaccgtcacacgcatatgccgtccctctctctccctctccctctcccgcctccggcgaccgcgcgcctccgcaaaaatcgagtcgagctcccgttccacgcggccaaatccgtcgacccggagctcgatccgcagcgccccgcgccgcctccccgaccaaatcgccgcgccgcgcccgtggggtaccgagctcg

SEQ ID NO: 44344 - DNA, 14158 bp, Oryza sativa
gggcgtatcaatgcggtacacggtggctggcctttagctcgtgtgagtacattccttctgtgatgatgcaatggttgtgtgtggttggtttcttgtgttatccatgtgttggatgctgtattcatgctggttttcgtgggaatttactgtgttttgtggttattgttttacgattttttttctctcttcatgcagtttgggaattgaattcgcctccccgtcacgcaaaacgaaatacacattattgtatgattaattaagtattaacttttttaaaaaaaaatagattaatataattttttaaaacaacttttatttttttgcaaaatacacatcgtttagcagtttgaaaagcgtgcgcatggaaacgagagaggtgaattgggaaaactggggggaagaacacggcctaaataagcattgtggtaatgaatttggatctttgttcttaaaagatgagttctgcctagcttagggtaaaccaatgataaaagttattcgaaatgacttagttaagtgcgcacttcaatcaatattatttgatatttcagacaacaaagtcatactaaatcgcttattaattttgggcttatttggaagagctacatgcaactgcactatggcaacaacctacaatagctacgatggctgcaagggcagtgtaggttcaaccgcatgacattgtgacacgctcaccgaacggctgggttgtacaactgtagcctagaaattattgtttagctcttttgaaccacacctttttctctcttctttttttttcgggggggagggggagggagaagggttgggggtgcaccattatgccttaaacatcgtataaaagtgattggaggaagtgtggctaattaggatgaattctagtaggggaatgatatttttcggggatatacaaaaggattgtgtgcttttgtattaagatgaataaaactcatacatgtagggccaagcaaaagaaaagccagaaaccaaaagagggggaacaaaagatgaaacagaaaagaaaagaaaggacttatatattaattctattctcacgaaatcatttgaaacgacctagcgacataagcaatatactaatagtgctggcaatgatagtgagacaagatactggaggtcagcttcccgatccattgctccaccgcttccggcaacaaaatgagtggactaatagaatactcgactattcctctccttccaaatggaccaagttctaagggttgtgattgtgttgaagccgcggcggcattccatgtgcactttctttcgactagcgcacatccattcgttgaaagaggagatgtcagtggggaagcactaaggaaggccgagaactgagagaacaatccaccaaagctagagagattcagggcactcgttcgtttcctcaggctgatcgtgcggaacgatcaatttgtgtaaactttgattgttccaaatagggtcataacggatttggatcatgaaatatacttcaatttgctacggtttagggtttacatgtaacgaaatttccgagagagatatttccaatggcatttgtagagtctacatgttgttaattagttggttagagataagttagtactattaatattgaattagactggccatacataaacggccccaaaagagcaatgatatcatgaaccccttacatgtgtgattgcaattattcttcctttatttttttcagctaaatatataataagaaattttgctagctatgaagcgtagatgcaatgcaatcactcctacaaaattgatttttctatacaagaccgtctttaggttctagacgggttataagtgctctcgtctacaaaaatcattcccccgtgataggtttatgggccacatgcgaaaattgattttcacagaagggcctcttaatagacccacgtgtgaaaataagcgtattttcgcatacagacctgttaagtgacccgcacacaaaaatagccatatacccacacccatctctccccactcctttttcttttctccccacctctatatttcccgcatatatattctccccttcctactcctcccatctccccttcccactccccccctctacccactcttgacgagggcggcggcatcggcgaggacggcgactgcatcgactagggtagtggtggcggtctcccggcaaccgtggggagagcggatccgtcgtcggccaccacggggacgacggtggcaggccttgggcagggcgttgacgacgacggcggtggcggtagcgttttcccggcaatggcagtgccacgagaggagcattggatccacagccgctaggccttgggaggctagatccctcaccgacgaccccggggacgacggcggtaggcctcgggttggacaacggtggctggattagggttccagggctagggtttcgattttcggggcttttttgttgtaattttctattttcgcatgcggatgacttaagcgccctcacgcgaagttagattttcgattttcgcgtgcgggtacgccacccgcatgaaaaaatcgaatttttgcagaccttttcatgcaaatggatggaagatccgcacgcgggaataccgttttggccgtatggaaaaacaaattttgtagcagtgagtgctgcctttcctatacgaaatttgtaccataatagcccctttgtgcttgttttgattgctctggtggtgggctatccgtccagtttgtttgtggaatttgttgcgttaaccattgcttctcttataaacaaaaacaagacgctgtaattttggtcattattctacgcaggtgacaatctgactcaaaactattgaggatttggcatttgtctggggccacttttgtttagacgtcaaagttgactcgaaaccaccatgtggtcaaagaaatttttgtcccaaaaccgtcaaacctctcattttaggtgcctttcctaggaagatgcgaacaaatttgcactgaacctgcatgtgagaaatgtgtgtctgtatagtatatgtgtagtactacatatggtgtgtttagtttgcgaaaagaaaattttttggtgtcacatcggacgtttgatcggatgttggaagggtttttggacacgaatgaaaaaactaatttcataactcgcctggaaaccgcgagacaaatttattaagcctattaatccatcattagcacatgtgggttactgtagcacttatgactaatcatggactaattaggctcaaaagattcgtctcacgatttccatgcaaactgtacaattagttttttttatctatatttaatgctccatgcatgtgtcaaagattcgatatgacttttttggcaaaaaaaaatttttggaactacacaaggccatacttaatgtccaatgttgacacattatatagctcgtcaagtaatgtctaatgttcttcatacttgctgattcattccctagacctttttaagatacagggtacacctagtagatctcggaatacaagaactaattgttgttctctgtaaatgctgtttgaacaaggtaaggatcgaatccaaacagtgccgtgtgttacactcgccatgaataatgaataaatgaatgaagtacaacctggtacttaccatgttaggaaagcagcccaaaaagggacttcatgtcatttccatgttaagcaaccaaccgaacaagaatacaaagggtgtgttcacactaaaattgaaaatttggttaaaattgaaacgatgtgatggaaaaattgaaagttagtgtgtttagaaaagttttgatgtgatgaaaaagttggaagtttgaagaaaaagtttgaaactaaactcggccaaagatggacaaaatctggaggagaaaaacgagtagcggaagccagacaataaccaaattataatttggccaggcagacattactttgctttatgaaaaccccatcatctaaaatttaaaattgtaccgaacaaaaaaaaaacggcagcaaaagtacataagtaaactagtactagtagtagcaatcaatcgagcaacctaagtgacaaaattgttcgaaattacacgcaaatacacaccgatcgatgactagaagcgcaaagaatcaacttctctctgatgacaaatgtgctactcgagctagctagactgacgtctcttcttcatcaaacagaagtggcgatggtttcagagcaagaagaagaagaagaagaagatcagattcaggcggcggcggggggcttgccgccgccgccggcgacgagcttgtcgatgaggtcggcggcgtcctggatggtggtgatgctctgggcgttgtcctcctccacggtgatcccgaactcctcctccagcgccatcacgatctccaccgtgtccagcgagtccgctcccagctccgtgaactgcgactccggcgccagcttcgcctcctcccccagcgccagctgctgcttcactatctgcatcaccttccccaccgtctccgccttcgcctaaaatctcgtcaggttcagaaaaacattcagacaacacaatagaaatgccccattgcattgcatagttaacattcagacaaagaaagaaaggcacattgcattgcatcattgaacattcagacaaagaaagaaatgcccgttgcattgcatcgttaacattcagacaaagaaagaaaggccattgcattgcatcattgaacattcagacagagaaagaaatgcccattgtattgtatcgttaacatttagataaagaaagaaaggcccgttgcattgcatcattgaacattcaggcaaagaaagaatgaaagaaattaaaggccatctgcattgcatcactagcgagcgagttaccgcgcagaagacgcggaagcgaggggatctgagggagacgaggcctctccttgctgtcatcgtcttcatggagaccaggtttctgcttgaaattctgcttccctgcaagttttcagatagagtggtgcactgtcacaaagaggtttgcactgacagattaaccagagctggagttaattacatctacatgagcccacttctggatataattcttatgtaaagatgacattggcagtttggcaatagaaactagattgcacaagataaacctgtaggacatgcatggcgccataggtcacatatgggacatgttattaaagaagggattgaaattcccggtttttaattttggtcatacactggaaagagcacaaggaaaccttcaaagagtagtgcaacagtgtgctaagaattgtaagagtggtaaaccatcttttaaaaaaaaacatagaaaaacaacaacaagtttttagcctttagggttagggcaggggacatgctttcttaatattgtcatgtgattactgactaggccaagaggatttcactcttttttggcttcttttcagaacaaaactttatgtatattatgcatggttaggtcaagtagccctcaacattattccccttgttaagcagctgcagagcaagaaagcagacactaaccaaccaatgcctttgctgccccactttattaagcccctaatgacaacaccctttgtggttttgtaccacaaacacccccattatctcgagattagaaaaagaatagccgcaaattatgcaacactctcaccactaccactctaatcaagaaaagaagcaaatctacagaaacaatttgtaaataaaaacctacaaatcggaaaagatatctactgtagtaaagaacagcagcagaaataactctgtaacaactaacaagctgcaaggcatcagaaagtgcagggaagtcatcagttcttcaccttccagctaccgagcgccgccgccggcgggcagccgagcttggcggagacgacggcggacagcgcggcggccatggccggaggcggaacgacgaggaggaggaggaggaggaggaaggggctgggtgctcgacggagatggaaatgggaagagtaggagtaggattagatgagggggattagtaggggcaaatggaagctgacgtggcgtgaccgtggccgcccgctccagctcatcccccctatctgcgcgtgtgggcccggtctgacgaggcggtgacatgtgctgtgtaccgtgtcttttagagcaagtttaatataatagcaactattagctccaaatcatttataactaatgtaatagccaatttatacaatagttgtttattatactattaatatttggtcctacctatcatacacatattacatcttgaagtcggtactgcagctgactatagatctatagcccgctgctcttctctctcttcctttatctctttaaaatatatttataactggtttatagcatgctattatacctgctcttatactgtagcaagctcaacaacgattgaatttactgttgagtctcactgcaattcaatgcagaagaggttattgtcgctatacggcaagtgcaacgacaaatttaagctaagatcatctctaatagaatgtgaatttgactctccacactaaaatttgatcaacatagagaaaaaagaaagctatacaatagattctttattcgaatggccaaacgtagctaacctcctccactagcctaaggtgtgtcccacccccctctcccatctccctccatgttcctacaccacctcctctatctcttgtctcacccacaaataggcaacaacaccatcgtcgtcagggctactaaccgctatggatgtcgtcgtcgtctggcgtcggccctcatcgcgcgaaacaaagcccttgtgtcacgcaaaacagagcaatcgttgtgaatccgtcgtgtgagccacggctgacggagcgtggggctcctcaccgggagaccgcgcaggcccccctttgccggttcggccggggactcagggtgaaaatctaagctctctgggaatggaaggttcgcgagagtcgaaagagcataagacacgggcgacgtatacaggttcgggccgctgagaagcgtaataccctactcctgtgtttttggtggatctgtgtatgaaggagctacaaagtatgaaccagcctctcccttgttctgggttccgaatctccccccgtcccctctctaagtgggcaaggtcctccttttatatctcaaggggataccacatgcaccctctctctctttccaaactggacttgccttctcttcataaatggacggagatttgtatggttgctgtccgaatgaccttctgatgggacggcacatacctacctccacttccgccggaggcaggcgcgacgtgggaacgtggctgtctgctgacgacatgaccagtgtcagactgatcacaaatcggtcattcttgtccacgatgcgtcagcttaacagtatgcatgttcgcccttcttcacacaacatcttgcctgtaatggttaggatgaagcctggcgtatatctgacggggactaacgtgccatctctgggaggtaacacgctagctctagctggggacgcgtgcctagaagctctcgtcctgacgggatggggcgaggcgtgcgtcagaccgcctgtcgccacctaacccgtgatctgaccggtctgtgactggtcatagaccggatatacgagtgcactgcactgcgttacatgcggcgtgacacgctcagccaaaccgcaataaatgcggttaggtgagccccgctgtgctcacctaacccatacacgcggagcagaacccacgaggggtcggggcgcctcggccctcggggccgaggcgggaatggtccgaccccctcggggagactaagaggagggcgaacacatcaccctcgggcccgacgtcccccgagggtgccaggccacgtgggcgattgtgtctgcctcaagcctctagtcatgatactcccggtcccatgtcgccgacagtagcccccggcgttatgccagggcgatcgccctcttcaaggggagcggtcgggcgtgacgccactcctaaggcctggtgacaggtgggaccggtctccacaattgggcagaaacccaacggtcacaaatttcgcacatcggcaatggtaactcggctgtcaataatgagcggtctcttcaagactgccacattactcgagtagtacacgaatctggatgagccgattcgctttgccaggagatatggtaacgtcgcttcggtcggcgagcgtaattaacgcgcgcacgatatgatttatctcgactgccacaaccgcatatccacctcatgcgccgcaagcgggcgaatgggattagtggaagcgagggcgcgagatacgagggggcgaaatagtgggcacgagaagcgaggagccgggcacagcgttggcaagagtataaaggcactgaggaaaggatctgcttccttcctttcgccatcattccccttgtcttcgccgcttgcaccctaactccttctttcctgtgtcctaccttcgccacacgcgctcgctctcaatcttctcttcctccggcgccatggcacggggctccgctctgctcgatggtagcgtgctgccgccttcccgcatcgtgagcgagaggcaggctgggctgccacgccgcttcatgccggaatctgccaccggccgggagatagtcacgctgggcgagggacgcccggcgccagtctacccggggcggtccgtcttctttctcccctttgcaatggcagggctggttccgccattttcttctttcttcatggatgttctggagttctacgatctccagatggcgcacctcacccccaacgcggtgatgacattggccatcttcgcgcatctgtgcgagatgttcatcggggtgcgcccatcccttcggctgttctggtggttcttcaccgtgcagtcggtgtcgccgccgtcggtggtcggtggctgctacttccagccgcggaggccggtgttgaaccgctacatcccctgcgtcctccgcaagaagtgggatgactggaagagcgactggttctacacccccctcgccgacgaagcgcgcctccgacttccgagccagcccccggcgcaggcctccagctggcgggcgccggtagatctgggagatggctatgacgctgtcctcgaccacctggcgggcctgtgatcccaggggctcacaggggccatggtgtacggcgactaccttcgtcgccggatcgcgccgctccagcggcgcgcccggggcgcctgggagtacaccgggtccgaggactacatgaggacccaccagggggtcagatgggattgggctcctgaggacttcaagatagtggtccaacgggtgctgaatctcagctccgtggaggcatccctcattccccaaggagtcctccccctctgcagcgatccagaccgcgcctccatcctgaccatcatgcaggcggtcggggcgtcggaggagcgggcccctcgaggccacgatggcgcgggcgggagccgtaggggggaacaatctaccccgagagggggtcgtgcttctgggccccgcgacgggggcccggggagcagccgccctgccgacgcccgggggaagaggaagcaggaaggaacctcttccccatctcctccccgagggggcggggcggcgcgtgtcagtagcaggcgcccggagggggccgcgccgacatcgcagcccgagggggagcgcaagaagaagcggctccgcaagatgggggagacagaaccatctcggggaaacctcatttcccctccaaagtggtcgtttaaccgaccccctcgcaggttcgtctctcacccattgtggctgtattcattctcttaacacgagttttcactcacccatcttgttcgtcttctggtcttttcttctgtttcagcgagatcccgtcgcgtctctcccgccattccaagtccggccagtctgaggccgaggatccggcggccgcagaggctcggaggcgggaatctgaccggcgagaggccgcggatcgcctacgggaagccgaggagaccgcccaggaggccgcccgggctcgccaggccgaggaaaccgctcgggaggaggccgccctagcccgccaggccgagaaagccgctcgggaggaggccgcccgagcccgccaggccgaggaagccgctcgggaggaagccgaatttcgccaggacgaggcaatggcgacttccgaggcagctcgcgacgaggtcgcgggcgcgtcgcttgggcccacttcctcgggcgacgctcaggcgacaacttccggggcagctggcgacgaggctgcgggcgcgtcgcttgggcccactccctcgggcgacgcccaggaccaaccaggtccgagggacatccccgagtccggcacttccatcggcggcccgagccgcgtggcatcctctccaaggcggctcttccccacgccttctatcgccccgctgagcgcagagccccttctgcaggccttggccgccgcaaacaccgtggtgttggacgggttaagtgcccaggtggaggccctgcaagctgagcgggcggagctcgacgccgcatgggcgtgtgtcaaggaggggcggccctcggtggaggccatggtggaggtgggccgcaaggcacaccgccagcacgtctcggagcttgaagctcgtaagacggtgttggcggaaatcgccaaggaagtggaggaggagcggggagctgccctcatcgccaccaccgtgatgaacgaggcgcaggacaccctccgccttcaatacgggagctgggaggcggagctagggaagaagctcgacgccgcccagggggtgcttgacgctgccgctgcccaagaacagcgggcggcggaaaccgaagcggcgtcccgacggcgcgaagagacctttgaggcgcgcgccatggcgctggaagagtgcgcctgcgtcgtggagagggatctggcggaccgcgaggccgccgtcactatccgggaggcaacgctggcggcgcacgagtctgcctgtgccgaagaggagtccgcactccgcctccgagaggacgcactcaccgagcgggagcgagctctcgaggaggccgaggccgcggcgcaacggctggcggacagcctgtccctccgcgaggcagcgcaggaggagcaggcgcgccgtaatctggaatgtgtccgcgccgagggggccgcactgattgagcgggccgctgaactcgaggtgcgggagaaggagctagacgcgagggcgcgcagcggcggggcggctgcgggcgaaaacgacttagccgcccgcctcgcagctgccgaacacaccatcaccgacctgcagggcgcgctagactcgtccgccggggaggtcgaggccctccgcttggcaagcgaggtggggcccggcatgctttgggacgccgtctcccgcctagattgcgccggtcggcaggtgggcctctggagagggcggtccgtaaagtactccgccaaccagggaggcctcgcccaacgcctctcgaagatggccggggctctccaacggctccccgaggagcttgagaagacaattaagtcattctcgagggacctcgcccaaggagcggtggagctcatactagcgagttaccaggccagggaccccaatttctctccatggatggcgctggatgagttccctcctgggaccgaggacagcgcgcgcgcgcaggtccgggatgccgccgaccatatcgtccacagcttcgagggctcagcccctcggctcgcgtttgcccccaactccgacgaggagggcgatgccggtggtgcagacgacagtgacgacgaggccgtcgacccgggcgcatcagattgagcccccaggcccccgccaatcttcagtttcttcttcttttctttcttctaaggccttcgggcctttttttgtatagatcaacttaatctgtaaaaaatgaagaaattttttgtgtcaatttcattttgctatgtgtatgagatgaggatgatctgtgccatggtccttttgtgtcttagcttgattaagggctcgtgtccaagtcccagtcctcaaaaggcgcgggtcggggctagtgcctggggagatccacatgtcgagactggccaggccgggaacgtggtgaccgagggttatgggtgacccgattgtgggtttttgccgattcccccccggagctcaccacgccccgaggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaatactgaaataagaaaaataagaatgtgcatgtgtggcagcccccggccaaccctgcacgcccgagggggtgcggggttggcccgagcccgaaacctgacacccgaccccccttaggggtagaagcgacgaaggtgttcgatgttccacgggttaggcagctctgtgccgtcgcccgtggccagccgtacggaacccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtaacgcgcggctcggagggccgcgcgccgccttcgttcttccaagtaatcgaggtcatctctgcgaagctgatcttgatcagcctcgcagtacatggtggcccgaggagacctcagggtgaggtcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaagacctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggtactccaaaccgggccgtgatgcccttaatgaatttaagtgcggagtgcttatcgatcttgacgaccggataagcctcgggccacttagtgaacttgtcgatcgcgacatacagatactcaaacccgcctggggcccgcctaaacggtcccaggatatcgagcccccagacagcaaatggccacgaaagtggtatggtctgcaggacctgggccggctgatggatttgcttggcgtggaattgacacgctttacatcgccggaccaggtcgaccgcatcattgggagctgtcggccaatagaaaccctggcgaaaggctttaccaaccaaggtgcgcgagacggagtgggctccgcattcgccttcatggatatcggcaagaagcataacgccttgtttccgaggaatgcacttcaggaggattccataagccgcgcgccgatagagggtcccatctaccagcacgtagcgtttggagatgcgatggacgcgttcactcccttcgcggtcctcgggtagagtcttatctgtgaggtatgcttgaatctcagcgatccaagcaatcaatctaagggtgctgggagtgctcccctcgggtcccgaggcctggactccgacgggcctcgggggccggtcaggcgcgtccgtctcccctaaggggtcgggtcgcgccgacgactgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatgcgccgtacttggcgcacgtaggcgtccatctgcgggtcagagcaccggtactccttacagacttggttaacgaccagctgggagtcgcctaacaccaggaggcggcggatccccagtccagctgccaccctgagtcccgcaaggagtccctcgtactctgccatattattggttgcccgaaagtcaaggcgaaccaggtatttgaggacgtctccgctcggcgaggtcaacgtgactcctacaccggcgccctgaagagacagggag

SEQ ID NO: 44345 - DNA, 3846 bp, Oryza sativa
tgactagcgggcggagggccaactctggtcgtcgggggccttaagccaccgttcggctcgagggcctctcctccctgctctctcccgggccaagtcggcacagggtggggaagcgcgaaatgagaattgtcctcatcgcgctccacaaccaatgccgcactaactacttgcggggtcgccgctaagtagagtagcaagggctcgtctggctccggggcgaccagaactgggggagagcttagatacgccttcaactgggtgagggcattttcagcttcctccgtccaggtaaacggtccggagcgtttgagaagcttaaataagggtaacgccttctctcccagcctcgatatgaaccgacttagggcggccatgcaaccggtgacgcattgcacatccctaagtttgctgggggggcgcatccgctctatagcccgtatcttctcggggttggcctcaatgcctcgggcagagaccaagaacccgagaagcttgcccgcaggtacaccgaacacacacttatcggggtttagttttatgcgggcggagcggagactcgcaaaagtttccgctagatctgtgagtaatgtttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgtatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatatccgccggtctccatgcgaagacgtcagcatttgcccgcaggaaggagacgagcgcgtcttcctatttgccgtccagaagaccaccgatccgtgtggtcttggacgggccgtcgcccagggcaacctccttgaccgggacctcgtcgcatgtaatcatccgctgcctcggggtggcgggggcggaggtgccaagcctctcgttgccatcctcgggcttggacgcagtggcgaggtggtccgcgcgctgctccagacaagcgagcgcgactttgaggtcgccatggacagagatggggccaccggggcccggcatcttcatctgtaggtaggcgtagtggaccgccgccatgaacttcaccaacgcgggcctccccaggaccgcgttgtagggcagactgaggtccgccacatcaaagttcacccgctccgtgcggaagttggcggatgcaccgaaggtgaccggtaggtcgatgtgacctaacggccacgtgtgccccggcgtcataccgataatcggctgggacggccggagcaccatccccggggccttgatggcgtcaaaggccgcaggggaaaggatgttgagggccgctcccccatcaatgaggacacgccccaacttcacgttgcaaacggtgggggaaaccaccatcgcaatctgccctccccgggcaacgcacggtgggtggtcggtctggtcgaaggtgagggcaacctccgaccaccgcgcctgacgcgtcgcctcatgagtaggggccgcggccagaagctcttgcttcatagccttgaagctccggcgagaaacgtgagcacacgctcccccatcgatggtggcaatggtggccccaggctcttggaagcctaggtcatcatcgccatcatcgatgtcctcggcgggggccttctgcttggcctcacttcgccgattaccggagggaaccgccggggacctgccctcacggcgctcctgcctcctctacccctcccacttcctcgttcgctctgccaaacttttgactgcgcgacagtccataaggtcgtggagggaggtgttgtggacggtgcaccacttgccggctgggcgctccctgatgggagcgccggcctttttctttttgtcgctcgtaggcctccccttttgggtggcccgcgaagcgccctcgacggcgaggacatgaccctcgtcgtcggaatggactgacctcttcttcctcctcctgtcacgtcgccctgtctgagcggcggatccgggggcggccgaagctgccacaccggaaccggaggagttccaagtccaggcctcctccttgtgagccactcggtccgcgagctgaaaaagctccgcggtagtctggggctccttggaggcgatcttttcgagcatgcggttgtgccgcacgccccccctgaacgcgtagattaccgcgtgtgcagggatgcatggtatggtgttgcggatttgacagaaccgctgaatgtacgagcgaagtgactcatcatcccttcgctgtactgcgtgtaagtccgcttcttcacctgggcgcggatatgtgccctgaaagttcatggtgaactgttgacacaaatcctcccaggagtggactgacgcgggtggcaagttcattagccaaccccgcgcctgccccttcagggccatgggaaagaaattcgccatgaccctgtcgtcacccccagcggcctcaatcccggtcgtgtagacctggagaaactcggtggggttgacgctgccatcatatttttcggcgatggtgggccggaaccttgggggccaacggacattccgaagactcgccacaaaggctctacagccgacaccaccaaccgggggcacggagggctgattcccacgtccgtgttgaggtgacactctggacgaggaagcgccctccgttgcgtgggcagcacttcggtcattacgccggcgctcgatgctggtgcgggcgtccggccccccacgcagatcttctcgggtcgtaggagtcgacgaaggagtggcggccgaatggcgaacagcggctgccgctcgtcgtgcccttcgtcttgacgacgcggagccggtggtagcagcaccagaggccttggtggcggaggatcgcccaccagcatctaggcgctgccgtgccgtcatgactaatttggccacgtcgtccagccatcgttgggctggagactccgggtcagggacgacaggcgggtgacgtaagagcgcgcccgcagcttggagcgcgccctggggcgtgctgccgtcgccgtagacgaggagacgacgctccccatctcgccgttcttctccatcgcccgcgataggtgaagtcgcggatctttcgaccctctcgagcgcctccccccgcttaggactttggcgtggagggggcggcggagtacgagctcgacggcgtaggttcggctccccgtcgtcgccactcacactcggagagaggtcgtgcgcctttgcttgctcggccatcaggctgaacaggaaaagcttggcgcacaccgaagagcacaagagctcagaaaacacacactgagcccctacctggcgcgccagatgacggagcgtggggctcctcaccgggagaccgcgcaggcccccctttgccggttaggccggggactcagggtgaaaatctaagctctatgggaatggaaggttcgcgagagtcgaaagagca

SEQ ID NO: 44346 - DNA, 2738 bp, Oryza sativa
gtaacacgctagctctagctggggacgcgtgccctagaagctctcgtcctgacgggatggggcaaagcgtgcgtcagaccgcctgtcgccacttaacccgtgatctgaccggtctgtgactggtcatagaccggatatacgagtgcactgcactgcgttacatgcggcgtgacacgctcagccaaaccgcaataaatgcggttaggtgagccccgctgtgctcacctaacccatacacgcggagcagaacccacgaggggtcggggcgcctcggccctcggggccgaggcgggaatggtccgaccccctcggggagactaagaggagggcgaacacatcaccctcgggcccgacgtcccccgagggtgccaggccacgtgggcgattgtgtctgcctcaagcctctagtcatgatactcccggtcccatgtcgccgacaacggccattgcggattctgtcgcccatcgtcggaaccgagccgctgccgttgtggattcatcacgtgaaaatgtgctgccgacagcggcgctcccggtcgacgtgccacctcgtctcgagcatccatcgccgcctcttcctcattcagctgggttggttggggagggccaccggctggatggggaaggggaaagatgtggatggagagaaggaagaaaaagtgtagagattgatatgtgggtctcattgtcagatggaagaacttaataaagatgcagttagagtgaaagataaatttgaccctctaacttttctgacaaactagctaaatggacatttggagagtcggatctgaagatactgctgaagatgctagtatatccacattaacaaaaaggatgaaatggtgaggagagagaacatgagcggcgacaaggtcaggaaatcgaatggcacttaaatgtacaaatccaaaggaaacctataaggtcatgaaatcatacatatagcaaaatgcccatgctttgctatggatagaaggaaacaatatcataatatgtcatggaaaaaaatactccctccctcccaaaatattatggcttttagccctgaagatttgttaaaaatataacaacttctccaccaacgttctcttcccaaccaatcacaaccctctatcatttactttttctcacctacctccactactcatccaatcacaaccctctaccactcacttttacctactttctaataaacttgtccaaccctaaaactttttatattctggaacggagggagtacttttttttatcaaatatcttagtctcacttgtttgctcatttgattatctgttattcacttgtttgatcaaatgctggactatttcataatattaaaaaaatatcaggtgacaatttgtaaaaactgtaaaaataaactagaggttttaaagaagtatagataagacatccaaaactcagatacgaataaaacctagtatgccactcttgaactaaaatatgttgtagtatatatgaccaggggcggagacaagggtggggtaattatggcttgagccctagacttaggaccaaattcccattaaaatcttatacaaaatactgtgaaaaactgaagatataaagagatttgctggtcctaggcgtgatcaattattggctccgtcactgtatatgacgcatgttttgatacgatcgataaagcaatcaacgttttggactggtacaccactacacctaatggtggaccagcgccagcaagctagccgccatctaactaagcttatgtgtgtgtacattcaagtgccattcgaaggctacacaacaacagagttgacttcagttgatatgcaactcaagttaatttgcattgtaaaccacaagtacttgtactatacttcgtatattaattagtaaacaattagaattacctcctaaactgttgagatagtacgatttacaccttcaactcaaatactagatattttacaccctaaactattttatactggacaaataacctctcaagcaatattctagacggttttgatctggttttgactaagggtggcatatgtggtgccgaagtagcatctctaatcaacagaaagttttttttttaaaaaaagaaaacataggggttactcatttctatctccttgcacccctctctctctctctttctccccaacatgcgtggcaaggaacaccccagcatctagtgatggtggcggcagtgaggagtgcccaatagtggtagcagcgtcgacagctacgaggagcacccagtgacgaagaacgagcccaccaatggggctcgaggagggcacggctctagccttccaatctgtccgcttctcctcaccgcctctacctccactgaccgccatcgcctccgcctccacagaacacttgaggaagagaaggcgaattggagaggagtgcggtggtggtccccgatcagtagctctgaggcagggtcttgtcgccgccttcacctcgacctcccatatcaggtccgggatgcgcaggagccgcatctatttccaggatgaagacaatggcaagaagatggtgcctaacttctagcgcccaatctgcggagatctcgagctccatcaatactagcttccttcttaagcgagctcccccttcttcgccaccccgagcccaagcctctagcttggctccgcccaacccaccgcccctatccctcgttccgaccgctaccgttccttgctccagctgcctcccccatctggccatcccgatccca

SEQ ID NO: 44347 - DNA, 1201 bp, Oryza sativa
  unsure (1)..(1201): unsure at all n locations
nnnnnnnnnnnnnnnnnnnnnnnnnnnnnnnnnctcataaactacttgcgttactaaataaaggtcttgtgcaaccaagttagttcaatctgttacaatacctctgcactgtcgtccatggcatcaacttcttgcaacatgttaaaataaactggaagatacctttggaattcatcttcaaactggaattcaaaaccaataccaacccagatgacggttcaacattgagatgtcaaagaataaattgaagttaagagaatcaacctcccagttccactccccattaaactccattggagcagaacagaatgcctttgcacggagatcttccttttgctttgccaaccaacatgtaaagttattttcaacataagcattgcctttctctccccccatcaggtcctagtacgattaagcatacagtcagaatagtgatcaatttaaaaaataaaattcaactgattgtcacttgcctggctttgtgggtacaaattgctggaaatatagatgtatatttcttcacagagaacaataagatccttatcaacagtatcatttgtactggagttgaacttgaaaattaggtttctcattgcacatggtagttgatcatctaagcgccgaattatagatggaagcaattcatctgcaacaaacagcttgcacctctcattgtcggtactgcctgcaagtcggaccatagcaaggcaaaaggaaatagcacttgtagttgcttcatcatccacccaatacccaaacaagctcatccttgaactcccaagacaatcatgggttaaaagataatgtaaaagcccattgtttgattctggagacgataaaactcccagcaaatgagacacttcacgggtgaactcaagaagttgagtatcttcaaacttctcaatgttttctgttggcccagagagtttcccgaagtataaggaactttagctcggccatggtgcataaggctgaaccacgcaaagtaaagtaaatcctcacagtgatcaagtaagggtcgtagtaggttcaacatccacttcttccagaatttggaaggacaatatgttaccaaaggaacgaaaacaagattgataagtttgcttaaatgcctaaactccattgaccctaaatcttcaaagatagcatcattgaaagatgaaatatccaatagatcagaaaatgccccttgaatagataa

SEQ ID NO: 44348 - DNA, 1891 bp, Oryza sativa
  unsure (1)..(1891): unsure at all n locations
nnnnnnnnnnnnnnnnnnnnnnnnnnnnnnnnnnnnnnnnnnnnnnnnnnnnnnnnaaatatccaatagatcagaaaatgccccttgaatagataaagatagaccaatgatgttgtacctgtgacatggcatagcatatccaaatataagtttgataagaaaacaactccacagagccaatttataataatatatgcataaataagttcgactaaaatacatgtattctaaaattacatcctcatgtatcacattagatgttctcaagaatgagtaagtcacaatattacaaatagttgaaatacagaatgaaaataatcacatactgcatgatgcaagacaacatggacaaataaataagccatccatgttagaccatgcttatgggaagcatcccacaaaagatgcattatcacctaaatctcgaatttgtaggataccaagtttcgttttagttcattttctattttctttcaggttcaagttgttagtgccaatctctatttaagagatattgtgatccgcagatcgcttctactgtcccatcaggaccatgacacttcaagaataggaacatctagaatcatgtttcaaattcacaagtacaaaaccaaatagtacaaatctgtcaagttccaactaatcatcatacatcagagccattggtctaatagtgtaacatggaccccaaataccattctcctagtacaatagttactagttgaagacaagtatgtggacatgaaaaataatgcacaaattatgaccaactacaatcattgaatctaacaaaaaaatacaataaattaccaataattaagtcaataaaagtagaggttacatagatgaaaaaggcaatcaaaataacatatatgaaatgctataagcaacaaactcacccactcagtcggatttcctccaacaattttcttgtcttgttttgttggacatcttcatcactcatcttgcttttagcactttcaagttgatcaggaagactgccagagatttgtcctctccaaagagaatgtatgcattggagcaactgtaaatcagacaattaacacagttagtatgatagttaagaacgactcaaaggcacacaatattaaacaccgtttggtctatgcaattaagacatgaactagggaattggaattgggcttaggtaaatattgcagttaggatggaataggaacaggaatagattttggagctcaattccagttggatttgaggacaacaaaaacaacacctccacgattcaaatccccacccattggtttgggaggatacctccttatccaccctaaccagctaaccctctgatgcgacctcactggagccatgactgatccagcaatgctgaacttcacagttttcatggctactgaatctgaaccatgcccgcttacttagtgatatagtgtccaaagaccactgacgctgagctacactatgccgccaccaccctgggtaaaatttgatcatataccctccgcttagactgaaattgaggatttaccctcctgacccccatgtaattgaccatggttaccccacgtcattggcatgggaaggtaaatccttaatttccaatctgaagtgagggtatatgatccaatctcccccacgatggccattgcaaataccatggccatcggtgccaccatggctgcaactgataccaagttccatggaagctgccatagggaattgggaatttgaggcgtcgaactccatggtagtcaggggaagtgatctccctctcctacggtggcatcaaagtcgatggtagaatagagaaaaaagctcagactctaagttaggagaaaaaaattccactcgacgcaattctggtcaaaaatatacacaagcatgaaatggagtt

SEQ ID NO: 44349 - DNA, 3095 bp, Oryza sativa
cacaaaaaatgggattatacaattccctctggaattgaattggaggcccaattctatcaaccaaacgaagactcgtgcgtattcaactcaactatgtattaataatattaggttaattgaacatttacctgcaatagaaagggaagcatcaatcttaaaagagaatgaagatcgcagaattgcatctcaatagactccaatgtgctttgtcggagatcattttcgcagaacttcacaactttataaaccatctccaagaaatgatcagagaatagacaggttaggccaaatgcagagtgcagaaatgtacttctccactctgattggacccatattttgttgaggggcttaagaagatagtgaagtacccccttatactgttcagacctgtaaaaggaacttaaaggtaaggaatcactttttgttatataaagtaaagtcattaccaatactcctaaataagtgacatattttccttacaaaaaatgatcgctgacttctataatatcatgttaatggaaaatattaagaattgaacaatatcattctcatttaggcaacctaatatattatacgtgtatcaatagctgattgctaaatatgaccacactttttttagaaaatcatgtatttatgaatagagtaacaaaatatagcaaaatatcaaatgatgtcataccttaaacaggatgttacaacatcaaatgcttcacataaaatattatattctgcaagaagtagacagcccttaacttgatggcaaggtactgcaccattgttgcactgcatcatcaatgagaagactttacagaaagaatatgcttgacagcacattattataatgcatgttaaaaaagaaaaaaaatacccgcattcttgggtgaattatatcatcgaatttatttgacatgttagtactatcagtgtcatcttgatggatcaaactactgcaatcaaaactgctcaattcctcacgcctgaattttagaagatgctgcaaatggagaaaaaaataccacatattaatgtccactatatatttatgttcatatagttcctgcaatagacattttacacatacaaagcattattaataaaagagaacattcatatagacctgaagcatcctagcaccatgacgctggacctcaggagggaaatcattgctgaccaacagaagagatgcatccaccaacaagtcgacatagcctttctctctctcttttacctatccgtagggatcaaacaagatcagtagttatatatatagtttggtagatagaaggaaacaaccaaagaatgagcaaaattttgaagcgtgcaaatccaatacactagtagattcttaaaactgtgctagagaaccaggagatgcataatctagtgctgcataaccacattattttgcccagcgttaagcgcgagaaggcaagagagatacgaaccggctccggctccaattcaacagggtaggaattcctggcgcaagtattgacactgctacaagcccaagccgcggcgggaccagcggcgaccgaacaagtgttcatcttctcagttagctagctgagaattgggggagaaaaagggaaaaactaggttactagacctagttggcggcggcgcggggcggagacggaaagagagagagaggctccacctgcggcggcggaaggccggcgcgcgtccaggcggcggggagagcgccggcgcgggggcccggtgcgtgggggattcggggcgtggggttagggggaacgaactagtacaagtcgacggggttggctgttgcgtgcgcacctctctttatagtctcctcgcgtagttgcgtacatacgttatacaaatactctacaatggttgtacgtagatatacaaagtatatgtgtgtatttatatatatattttttatgtataccaaaataaattgacgtatacacaatatacatatatacaaagtactccctcaaatatgaaattagcatcatatgaaagtattttaaaatatgaatatatatatatatatatatatatatatatatatatatatatatatatatatatatatatattaaatttgtttggtgttccatggtgcccgggcaccataattgaaattgagtatatacccaattcgaatgagtatgaaacttttttaaatgtttaggtattaacattaactactgtaatatatatatatatatatacacacacatatagagagagagagatgggaggaggagcctacggctcaggcaaccgatccgattggaacaaaatcgggcattgatgtcagcacccgatttacgtggaaaactactttaaactgatttttctcctaaattacttatccaaatcattatccgattgcaccattaaattcattgcaattaaatcttcaaaacaagaccacacatggatatattccgatgaaaaaaaagcttattattgaattatttttaaatgttgcacgatgttccaccaggtatatcggaattgtttcactaagtagatcgaaaatgtttcatttgtttaaatcgggtgttgtttcatcttatataaaaacaatgtttcagtaaatagcgaaagaaagaatgtttcagttcactacaatattagatctatacatagtgaaacattatgagtacattaggtgaaacatttttcggtagaatggaaaataaaccaaattcccttaataggggtttccaaaatatgtgtttttttttacaatggaatgtctagttcactgcaacattagatttagacatagtgaaacattatgagtacactaggtgaaacattttttgtggaacaagtaataaaccaaattcccttaatatagagtttccaaaatatgtgggtttttcttttgcaaaacaatattttaattcactgcaacattaaatttataaaaagtgaaacattctaaatacactaggtgaaaacatcttttatagaaaaaaaggagggagaagtgatgggcccagtaggtagcacgtggggggagggggggagggggagcgcccgatccggttcccccgcgccgatcgtccgagcgtaagtattattgatatatatatatatatatgtgt

SEQ ID NO: 44350 - DNA, 3888 bp, Oryza sativa
  unsure (1)..(3888): unsure at all n locations
nnnnnnnnnnnnnnnnnnnnnnnnnnnnnnnnnnnnnnnnnnnnnnnnnnnnnnnacctgtggaagatatgcaatcaatttagtggaagttccagtaacaacctaaaaaaagttaacataaagctcttcagttaattgcaaggtgtaatctacattgcttatgatgcaacacctggaataaaactaatgtgaacaagatttaatgttcaaccttttcaaaggtttgccaagtgttatccttctcttgtaagattgcccaataatcctgacatcaaaatcaatttgaaactagcattattaattattaattgaaacaaaagagattaatgttcacgaagaaagacttacaataattccttgaatagtgtaacgcctgggaagggaatgtcctgtgaaaacttcatttttgaatttttctacaagctttgagaaacactcattgtcctacataaccaatcaataaaattaatactgtgtaagccttgaacataaaaaacttattcatttactaaacaaacatacccaattgacagagttactgtcgatgtcaaaaaaaccttcagcattgagctcactcatcaaactcatcagacgatctttaagctgggtttgttcatatcaattcagaacttagtcaacccaacaaaaaaggcaatgtaaaacgtgcatttctaattaatacttatcaaatgtttactagcttaacgaatataatacatccctgtattttggctggtatttataaaatggcaaataaataaatatttgtcagttttcttgtttactgatccagcttgttagattaggaaattcacatgcaccctttttcattaacatgctttgtgctatcaacatttaaattaagacctattatctagttgctgatgtcaagcgttcagagatcaaacaatcacaatgcagttgtgcatcatatacaagatttaaacaagtccctaggagtctaaacaatatatatgaagtttctatcaagcaaataaatcagtcagtggtactaaagtttttaccaagccaataaacagtcaatacaatatacttcctaaagtgcaaataagttttcaggaaaggaaaataagacgtgatataatcatagctttcaggatctgagcattcaaaagaacaggaaaaagtgaggatttcacatattctagggaaaaaggtttccaagatgcgaaaaagttgcccaacattaagtaatcttgcattcaatatgaccagatttttttccttttttgacaaacccagtgtcacgaagatatttggccacttaatagacaacggagtgatctgtgatctgaatatccaatgatgtgttagagaaagcaaaataactatgacatctaaatggttcacagtttctaagttgagcagattttgctctgcgcatgaaaggggaaagcgggggatgcctgttttccaaatttcaattcagcaaagcagacgaagcttaatatgtcccaaataaaacggtatacagcacttcgcattttttatatgctgatatcttgtaaagaagatgtacatcctaagaactccattttcaaaatatgcactcttggagcattttgactcaaacaaaacagatgtaaaaggtttttgctttataacttggaatggctgaagatttcctccgaaaacggactgagttggaattgcattaataaattctttttttctacgggattgtttataacctttctttagtatggttctgcttactggcttactgttaccaattaaaaaaaaaaactacaaagtggcacctacaagagatgacatatggaaaccaattaaccagatcactcgaacacaccccaaaacatcctcagttctgaatttgcaaaattagttttatcagaagatggaaactaaatgttattgtagttcagggtgacaactaaacacaagaattaagttgaaggaacaaaattggaattctcgtaaagtattattgcagtagtgttttgcatttcataccgactcattttcaaggaggtctcttagacacttcgagtatgtgcatacttgattatgcatatccacaatctgagctcttcgctgcaaaacacagatgtttttcaaggaaaaaaaaattcatcaaaacagatcttctaggaaattctgtaaaaattgcttagcaccttgagagataaatggataagatcatggtccaaaactgagaatttctgtggcactgcattattttcaacatcttcatcagaaaaatcctgcaggcaatttacagcataattaacatgtatttatgaaactctgaagtaatttattatcagcatttattagaaaaattgttgtttatacctctgagacatgtgagtagatatggctatccagttgaccagaagctagatagttgtcataatcctcgtgcaaatggatttgcattgcagccctagcatactgaagaaatagatatagtattcatacaaaaatggaagtggccaactggccacagaacaagaaacaccaaaaagtcgttccatctaatagactatggaaatacaaatgtcttactcaatatttaattattagtaatatatgtgtgataataactacggaaatatcatcaaagcgcacacaataagccatgcaacagtggaagtttgacggttacatgtttgatgagagagagaaatggacaatattacaagccttccaacatgaagtctactttcaccaggggcaaaaggtttcatgaagttgattaataaaaaaagacattcggtatccctacagctgtcagcgtcagggatgtattatttaccaaacttctttattagtttgtaatgttttattccttctatcttatagttaaaaatatgagcagcccaagttatgctattccttctatcttatagttaaaaatatgagcagcccaagttatgcattatgtgtaggactatagacaactaagcataataagtgtagcatcaaagatgcatccatttctaacccaagttacttcttacagtatcattctcacttccactaagaatagttagccatgttggtaggtaaataacacttatacgtatgccaaagttgatacaattaattgtgtggagggctctaggcagtgctaagccccaaactgactgaataattaccaaaaagttcatcaaaatgctgttactgacaagaaaaaagtgttataaactcatcatggtagcatgaagtatacttgataaaaaagaacatcattacaacaagcaccacctgattagcatttgtagtacaaaatatgcgcgagaaaaaaagaacagtatatgaacatggtgagtggtatttgtgacagcaactttcacaacaatctaaaaaaaaaactacagaaatggcacccattatatgatttcctagttatgcagctgctacacatgcagacctgcttggacttatgttagtttagtatacttcagttacagttggatcagaaccaaatgttctaagatgaaaaaaaaaagacttgcaaatctgaagtagatactaagccttaaacgaattttctaatctatttttgtgaacaacaaaaagttatactgtgttgtcttgtaagctgagaaattttgtcagtccagtgtttgagccagtgaagccaaaaaaaaaaaaaaaaaaaaaagggaggagtgctcccatggaccacatttgacagacttcaaatctgccaggatgcaaacatgataagcacaagaaaaaagtaaggcaagcacattcagtccattggcatcacagatactgtttattatcagctaaatggtgtggcatgggtggaagaaaggataacaaatatgtgcacgtgtggaggcgaggatcacatgtcatggtgggatttgttcctatttgtgacaaggggct

SEQ ID NO: 44351 - DNA, 1123 bp, Oryza sativa
atcactaagaaaacgatcccaaacaaacataactaattcatgcacccggtgcaggcctcatgtgccaggtggagtggctgatgttgccatagtagacctgttggaataagtattcctgtaaaggagttcaccacatcaaattgcaaaacataatttcatcataaaattgtttaatttatattcttagacattcatgggcatagttgttcatccaggcacagtagctttcaaaggagataaccttcatcagaaagaaattgtgacagtggcatgatatgtcgcttttggttttcattctgactcgattttattccaccaagaaatagtatctccaaagtttaaaagaatggttagcatatgaaaaatgaactaggaaaagtatatttatttgctcgactaaaactaattaaatattactcatgagcagagaaatataaaaaatcaattaaatggttgacaaaggaataaaggacatgaatactttatacaataccatggacatcttcagcttagtctgaatgtagaaacgtgcataaggcttcaaatgtggcgcaaagtctccagggtctggtgtcagtggctagaggaaagtgaaaatcagatttcaatgaagttccaagaagattcccatatgatatgtatatatgcatacctgaaactgcttgttttcttttgcattggttaattgaccaactatctgcaaaagcaagtccttgtgttcctaaacagtcagatcattatgcaggccattaaaaacaatcataaaatggatggatgaagatatagtactctaaaagacccataagttacttctcgtatcagaggatgaaatcgaggctcccagaaatacagcacatgacaaagtaggacctggcagtagaagaaatattcagacttgagaggagaggcaacagcaatatcatatttattgcctgtttgggattccaaacaagaatgttgcaagtacttcacagaaaacatggtgcccacattaataagcctcttataaaaaagtaaataaattaagatgacaaacactcacaccaaccgactgatccacttcataagcatcaaaagtggattgtatctccaagttttcttcaagacgttcaattacactata

SEQ ID NO: 44352 - DNA, 1100 bp, Oryza sativa
cgccctttgaccccgaggctaaccctgtgctgactcgacccgggagagagcagggagaagaggcccccgagccgaacggtggcctaaggcccctgacgaccggagttggccctttgcccgtttgtccgacgacgccaggagcccccgacccccgggacggccccgaggccactgtgggaaggccgcccctgtcatcctccgaccccgaggtcatcagcacagaagacgagtgcgccccacgaggccgcttggacgaagagcgccccggggatgcagcccctagcgaagaggatcggccccaccgaaaggtgcagcggcctgtctactttgttagtgaggccctccgggatgccaagacccgataccctcaggcctagaaaatgctttacgctattctgatggcctcgaggaaactgcgccattatttccaggcgcatcgggttacggtggttacgtcttaccccctcggtcaaatcttgcataatcgagagggtacaggacgggtggtgaaatgggcgatcgaactttctgagtttgatttgcactttgaaccgcgccacgctatcaagagccaggccctcgccgactttgtggcagagtggaccccggctcccgagcccgtctcaatccccgaggccaactcgggcccctcgcagttgcctcacaccgcccactgggtgatgcagttcgacggctccctgtctcttcagggcgccggtgcaggagtcacgttgacctcgccgagcggagacgtcctcaaatacctggttcgccttgactttcgggcaaccaataatatggcagagtacgagggactccttgcgggactcagggtggcagctggactggggatccgccgcctcctggtgttaggcgactcccagctggtcgttaaccaagtctgtaaggagtaccggtgctctgacccgcagatggacgcctacgtgcgccaagtacggcgcatggagcgccattttgacgggattgagcttcggcatgtgcccagacgggataacatgattgccgacgaactctcacggctcgcgtcctcgcgagcccagaccccaccgggcgcctttgaagaaaggcttgcccagtcg

SEQ ID NO: 44353 - DNA, 1918 bp, Oryza sativa
tctcttaccaagattgccatgctttgcaaacactcgtcgttacaagttttcaatggaacccgccaaacttttttctcccattttggacctgagagcgcacacgccctgagcactatcacaagattagtacagctaattaatgttcatttaatatcggataaagacacataaccacactcactcaggaccagctcttcacatgctgcagtttgcaggcgataaaccctcccttgtaccgaagtgaacgagcactagtgcacgagtacttagcctgtgtctatcgctttcggccgtttcgaaacgctcccgtccaagcaataagacgagacgtggctgagatataacacgattaattaatgtaagtatcttgcagctttaatgcaggcttgaatctttgatcgatagcagatgctgccttcagtttggcggatgcgtccgccctacctgtcccggaagccaatttaattactcccccaaagccacatcataaagcacagttttagttgataattcttcgccaaccttttgaaattgtagtcattgggtataggttttttagaagtcatttgctttttttattttcaatacaagatttgtttgaaagtgttctccactggaactaagataaaaaaaattacttcagttaataaagtttctgtaactaacttgttctttttttatcactaactaacatgtactctctccgtttcacaatgtaagtcattctatcatttctcacattcaaattgatgttaatggaaatggaggaagtagtactgtagtactgtattttttttttcttgaggccaacactggtaggcttaaactggcatgacttgtgtgtttctttcctttttcctttctctctttgtcatcatcaacaggagatcctgaaaacaaaaattaataactacaagatgactctaatggttgttgcttggcaggaaaactgcgaagaaaaattagtttgatacaatcctgaaattctgcaacagcagctcaactgctcaagtattatagaaaggaagcttaaattaagcctaaatgctaaaccgtttattttcaatcgtcagaaaacaatcctatgcgtcaatgcgtgtaaactaacgatagcttgagttgtggagaacttgcaaagtacttgaagataaagcaaagagtagtgtacaagcagttgcttgctaagacaacaagaatctactattaaaacaagtacttgttcttacttaaatgtttgatcaactctaccacattggctgattggcccacaggcatttctttcagggcaaagtgcagttattccagcgttgcaaatggtggatatccatagcccataggaaataaactagtatttttgttcataaatttagcctcttttgtttagtattgcaactaccaatactaattctgcagagtaagaaatcctctatatgaagctatttgttcatcatgaacacacgaggtgatgcaatcgaacagcaaaagtagaatggaacgaattggctatgaacagattgattaatacggtgttaaaaagatgagcagaattagctctgaaaaagttttgcaaattgcaaacacaccatggaaatcagcatcaggaagccccggggcttctcctcggccacggcagccggccgtccaccgccggcgagtcgtcggaggcgagcaccggcagcttccccttgccttgccgcggccactgccaaatcttggacaccgagaagctgtcgcccttgctgccggcgccgatcttcttcccgtcggcggcggcggcggcgtcgttgccggccgggttggcgccggcgagccctctcagcctcgccctgccattgccgtcgccgtgcctccggtgtacggacacctgcaagctcgcctcggcgaggacgtactggtaggagcccatggagaagcaccg

SEQ ID NO: 44354 - DNA, 6446 bp, Oryza sativa
acgccgaccaccacctcccggtacatgaacaccgggagcgcgtcgatgacgtcctggtccagcccggcgtcgtgcaggtggaacagctgctgcagctgccgttgcaacgccgactcctccacaccctccgccgcctccgcgtcgccgccgccgccgccatctcgcccacggccgcgcctgagcaagaatctgacaagaagatgcagcaacccggacacgaacagcaccacagccaatatcaccaggacgaacaccaccgccgggctaatcctcgccgcaccggacaccgtcccgccgccgccgccgccatcctggttgctcctgattactccggcgaccatcatctccggagcaatgcgactctcatttcgcgaggcgaagcacacaacgcccttttgagctgaccttcttcgcttgatgatgctactagtatttcctttggttgttttgcaagttgcaagtgcaagaaggatccaagcaaattaggtgcttgagaaaatggccaaagcaaaggggggttgtgaggtgtgacatgcccatgtttatatgcaactgggggacacacaagcaacaaactgaacaaaccaagaaaaccagcaaaggtggcagctttgggagactgattttttttaataatggttaacaaaataatactttctcctaatactggtccagattcgtaatagaatgtgtccaatcgggtattactttgcgatggagggagtacaaactttggctaaccattttcctattgcaacatgtatgtataacatggaaaaaattgtaatgtatatcgtaaaagtattactccctcctcttcaaaatatttgttttgtgctaagccaaacattcttaattttgactataattcttttttagaaatttatacaacacattaaacaacatgttaaaaagtaagtattttgaaatggaaagagtagcatttggtgatataaaatctacccataaatttttcatgtgtccaatctaaatatttaaagagatattgatgcttaacgcttaatgttttgagaagattgacatgatatgcactaaaaggacatgcatttcttgcagaagcagagatcagagagagtacatacatgtacatctgtgcatgggttcctgaacctttatgcaaggttggtactgttttcttttctcccttctctgggcaatagatttggctttggaatatatgtggggagacactggtgatgctgcagttaagaggccattttcttgcgcatcaacaggtcaaggtagattgcacacggaaccatggcctattgggatatcttgtgattttgctttccatttggtccctcttgtgatgtgaaacaaaagggaaaagaaagaaccaagagcgtgtcactctgacgaaaaaaagttgaaaattttctgtagatactgtggttgtcaatactgatcatagtggtctatgtatgtgcagtgtcattgcttgatgtggctgtcaacttgccgttcgttttcactgcaaattggaggagatatttctttgttattcttgtcatctgaaacgctgaaaccaacagcgttatccaacctaaaaagttcagagtttgtgagccagagttgttgtgttgtgcagtgatgattcagtgcttgattgcttgctgatgccctctctcttcaggctcaaaagctgcactataaaaaatggttcacacagtggaggaggaggagacagctgcatcagtgcgtttgccacctagtttatggttagggttcagtcccatcccatgtggctgataaaccaactttgcaactgaaaattcatggtcatagattgctcaaggaggcaatggaattgatcccctcaaaataattttgtcaggttattattgtatacacttcaaattccttttgagctggataattcatatggcaatgttgtcaccaccacaatttctcgactggtaccaaaaatgggttcactgtctgtcaactagaaatattgaaaaaaatcgagttgaaatggacagatttattgtcattttaaggtaatcacctaaaacaaggtggcgggcctgagaagtgatgtgactcacaaaacgatttagagtgcacgagtttacaaagaatttcatatgaaataactaaaaaaatagaaaagaaatcccacgtttaaaacaggcatcccaatatgctttgtgcttctacttctgacatttgctaccaccatttcagttaagtccatcaaaccatgggcagagacggcataggataggtaaggattagagtcactccataatccctattaaaatactaatcttacaaaaatactagtactatgtaatttgcaaatgtattttagctcagccctatgcataagtataaataggagaaaacagagaattaaacatatgattttgatataatttaagtgtaaaacaaaattgcaaaacatgtaaaaaaacatagaaatcaaataagagagatagactcaaaataaaatttccaagaggtaagagcttttgctaaatttcctccaaaatctttgtaggattgtctatcccatacgaatttcaaaggatatgatatgattcaatcaattcatataaatttttcctataggcttgaaaaactttaaaattttacgtttttcctccaaatcaaagggacacttaggccttgtttacttccaaacaaaaattttttaccctatcacattggatgtttggacacatgtatggaatattaaatatagacaagaaaaaaaactaattacgtagattgcgtgtaaattgcgagacgaatcttttaagcttaattacgtcatgatttgacaatgtgatgctacagtaaatatttgctatgacggattaattagacttaataaattggtctcgcaatttataggcggaatatgtaatttattttattattagactacgcttaatatttatccatatatatgatgtgacatgccaaaatttttcgtcttggagggccttagtgtcgacacgaaaagaaacgtgttacaacctcgacataccaaccacccagagatcacaaaattatcgcccaaaagcagcggagcacaaaatcgctggacggaatcgttttcttcctttttagaaaagagaaaaaaaccgttggttgcgctcaaccccaccaccccccctctggaagaaacgaaaatcaaaccaaccatggcgcgcactgccaacacgtccacaccactctggcccccctgcaggctgccgtacaacaccaacacccaacaccgcttgactactgctgctatgctatactactgccgtaccccaggtgttccccggcccgggccgcgccgttgacgacgaatctgtcgaaacatggattcggcaataataaaagggggtagcgcacgagacctaaaagtggatggatgcagagacaaaggatttagacaggttcaggccctctcaatgagaggtaataccctactcctgtttggggatttgaatccgccgagtgtgtattgatctgacgatcaggttatgtcatctgccccctagagggcctcctgcccaccttatataggatggggggcaggattacaagatagaaacattaaccaatacggtatcggtttcctaaatctactttacaatattatcaaaccaggactttaggccgttccgtaatatacaaggaaacgtaatacccgagtcatgatctattacatattccatagatataagttatcccctatgactagtcggataaccatgccgtatgggtatggggtacccacaatatccacagtagcccctgagaccttcgcagtcgaaaagataatcttctctcgaaccagattactccaaagccgagtgcttcaattatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaaccgctttgtaaaatatgatgagtgatatagcaaaatagctataaagaagcttgtatattgtgaataaagaaatttccaaagtattgggcatacgccatgcgcacactgctttaacagatgtacttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcaaaaagcaatgatattgtatccaatcaattgcttaaaaacccaaacagcaccatgactatataaaaaagtcagcgggccagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcctgagtaataaatcttccgggtaatatagaccaagtgtagctcatatgaatagcttctgatctgaatgattatcccttatgggatactccaaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtccattgatggtagctgatgcagtcggcatggagatgaaatgaccaacatgaagacgaaattgctcatcagaagtaacgaaagatgtcagtggtagtaaagatgccaccaatcaaatgtaatgaagttgcataaccacggaggtgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagttggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggcttatataaaatttgtcaaattttgagccttgtatttgtgtagcccccgactctttgattagttgggaaacaactgaacatagagtcgagaactgtagcatcttgtcgtcgaataattattgcttgattgaagatatgtgttgaagatgtccaagtagaaatcctgaatattggagagccacttgttgtagtaaaataacacggcatcgcatgccgagatgtcgagattcacaacaacgtcatggttggtgatgtagcaaaacttgttaagtagcagcaatagagtttgctggttccgaagataataaagatgaagtcggtccaccatgatgacaaagttgtgttgccgtgatgaagtgaaccggtagtgaagacgcgcagttgtgaagataaaagcaccagtcgacggcggcataacacgagtcggcggcagaaaacgatgatgtccatcagtagtggtagctgtataaaccagacgtagaggcgagggcactagtcaacagcagacgagatgaccggcggtgaagaagataaggctaatcaacactggtagaatcatgtagccatggaagtgaagaaaccagtcggcagccatggcaaacgtaggcagcttgtgttgaagatattgatgcctattagtagtgacagcgatgtagccagccgtgaagaagatagcatcagttggggttataacaggccagccgtgcaggcggtgaca

SEQ ID NO: 44355 - DNA, 26151 bp, Oryza sativa
atcacataccatatgtcgagtttggtgaatgtgttgcattcaacaatgaaaagggtggtgtaattgaatatctcaaggaggagaaaattgttgacttgaactcaaagcatcctagtgtttcttattcggatgtattatccacaaaggccatggttatgacctggctttcagatgctttgcaatatgagctctggctggcttctgatggaagcattccacatgatatctacttttctgatctctcctggcccattggaaagatactctattggaagaaaacgagagaagtgaagcaacaactgggcataactaagcttaatgctgcagaaaaagaagaggaggtttctacttccccactcatatttcttaaggctaatttgttcatcacatgggaaaatctcgtgatacaatttaagtcttttttgaacagatataccagaaagcaaatgctgcttatgatgccttatctacgagattaggagatcagatctttctctttgacaacaggtattatcactttatcttgttttgacttgcatgaaaatgtatcttcgtattattttatcagctttctgttcatactgactgataattgctcttcatatggtatgatatttacagaacactaacttcctttgtttcaatctgtgcagccctacagacgttgatgctctttttcttggacatgcgctttttgttcttaatgtattaccggtgagttctgacaacactcaatactcagctttaacttgccaaagtgattatatatttatattgatatatgagtatataattgcatgcatgccacgttgaaaattgtgaagcacctgcactgcaagcacagttgcacatctcaagttcttcagatagttacattagggttctgtttgtcgtggatatttttttttctctaacaataagcataagctgtcaagcacatttcccaaaatactgtgttgattatatcttgacaaaattcttacttctgccccataggatacgtctgtgctgcgaagctgtctgcagaagtatgacaacttggtaaactttaccaagcacctcaaggtccaattactggaagctgattctgattcatcagcaacaggattgggatcaactgatccatcatcatcctctacacccaggaaaagagcgtcttctggtcggagtaagttattatattgacttattttcattcagattgtgatgcagactgctattagtgtacatatttatggttgcttaatactccctccgtaccagtttagagggcgcctagtttttttttcccagtgtcccacaacataaggtgcatcttcaaattggtttgatttgtcctgagattagcccttgttagctgtttcagtgcagcctgtgcgtggagcatgcagcttcgcgcagcatgcagatgggctgggccctcaaatattctccgcttccgactgaagcgatgagattaaatccttttgcatgcacttaattaggggtataacagtaaaaaaacttttctatgcaggtcttagtaaaaataattacacgccttataaagtgggacggagggagtattaggaacacctttttttgttcatgagatatccctcatcttctgtaatttgttttcaatgaatgattctcaccggaattccaagattgcttgttgcatgacatccatatgctttcaagttatttttatcatttgtcaatctgttaaatttgatgtgggtattgtactgtgttccttcaggattttcttgggcttgataatgggagtaacgcacttctccatatgaattatgaaataaatgacatgtagtactactacttaagtcaactgtagtaaactagattggcacttaggcctctcacagtgcaagctatggggcccgtacccctagcccaaaaaattggtccaaagacacccacctcacagtgcaagcatccatatatgtgtggcttagttgaatagagacacaggtaaagaaagcgaagtccacagtgggcgggaccctacacgaggacacgggtagcgcaccgacggattaattttcctcacctaccccttatcctcagcggcgcatcgccttctcctcccccttcgcctcgccttctcctccctcaagttctccttcctctcctccctctcctccctcgcggcggacgccggggaagccgccgccgtgcgcgtcgcctcgccgtcgaccgcgccgcatgcgccgctcgcttctccttccgctcggactcgggagcgatgggggcggttgtagtggacggcgcgacgccgacggtgggagcggcgggagtggacgatgcggcgccgacgggcggacggcttctacacctccgcggcgcaggaggtcgtcgccgccatggaggtcgttgtggcgacaacggcggcggtggatctgtctgccgcccctcccctctccctcccccactcccttgcttcgaccgcttctgcctccggggacggatccgcggaggccgacggcgggggcggcgggaacggacggcagccgggaggagggcgcgctcctcctcggcgttcttggcgacggcgttcttgatttttcttgtatgattttgtgtcttgatttttcttttgtgattttgtgtgattcttcttgtaacgtcgccgctgcaatctgtgttcttggttttgcttgctgattttgaggattctcggcgcgggagcggaggaatcggtggcgggagagagaaattggtgcagcgggaatgggttttgggagggcgaatcggggatttcgcgctacggtttcggcgctagggcatgccagggcgaggctacgccgcccacagcgcgcgcgacccgggtcttctccacgctgcgtgccctcgatttcgcgaggttttgcgttgctcacctaggagacgaggaacctagtttaggcgcgggtccaagcgacacggcggcaaaattccgacgtggcacgactaaggcgcggtccagctagacgcactgtgagaggccttaccagtaatgtttggactgcaatttgtgcagcaaagttgccaatcgatattataagttcaatattgcctagatctttgcacagtagagtttttactatgttctggattatttcaaacatttatttgcaatttgcgatctaatcaacctgatactttctaggttataagccaaaacccagagctaagaaggaacgaacagaggaggaaaagaagttcaggcgaaaagcaaagtatttccttgcgacacagctcgttgcggttcttctattcctatcgctcatgggtggagccgatagctcagagctagacgatgaggacggtgtagattatgaagattaaatcctccctttgttgtactgcacgattctttctgaagtgttaatttgccaaagcaccggttgtggtgcttgaaaatgttcttcccatggttagtcagagagatcgcatacttcatcatattgtagttagcaatacactgagttggtcagcagccggcagttccatagttttggtacttcaaaagtaaaacataatctgtggaattttgtattggtttcgttggacgcaactgtaagcatatgcaaagtagttgtgccgaatgccctttgccctggagatttgctaaataaacgaagtaccttttgaaagtctatgccagtttttgttttgaaagttcatatcagccctttgccctggagtttacatacaaataaactcagtctcaatcctcaagcccaattatcagaaaggatgccagcaacttcgtactaatacaaattcacactaaattaaaatgcacagaatcctcttcggcgttcatctcttcgagccgggccagctggccggagaccggctcgccggcgtctatggccgccaggagatcgttggtgagctcttcaaccggacgttgtttctcgctgatgccggcgactacatcagtgagctgagtacgggaccatgagtccatgacgtacacaagcccagctcttgctcttacctcatgttttattcttcctgtgttgaattcctacaatttttcatgtatgactatcaaacagtagtttcgaagctttcccgtgtttccaaaatcaaatccaatatgaatccaatgaacgtgatattttattcctacgtttttcctattcctgtactttaacaatcctgtgtttcaaagggtacctaatcgatcgtgattgaaaaacataaactaattcaaactacccctaaaacaaacagaagcctcgttctcatcttgtcatgataaacggtaaatctaattggagaggccactccaattagtcttaaccagagacacccacgtgctagtactttaggagttttggttgctattaattcattgggcaagtaggagaaatattcctatcatctatacttcaaataaaattttctcttaaattactaatccgattacaccgttgtgttcgtaataattaaatctttacaataagatctcacatgattatattttgatgaaaaatcacaaattacttttatgatatgtctaacttacttttagatttcactaagttacttcttagacatataaaagtaaattcagtaaagcttaaaagtaatttacatatattatagaaataacttataacaaaaagaaagtaactttaattaatgccttttttcattgaacaaattatcatatatatatatatatatatatatatatatatatatatatatatatatatatatatatatatatatatatatatgttatttttagatttgattaaaatacttcctatacattcataatgctctgaggtgattacttttattattattttagttaattccataatttgtgctgattaatttaatttttagatagagtcatgtttttatctctacaacggatttacttcaaatgacatgctaaagttaccttcattttattctaagttacttctataatatatgtaaattacttttaggttttactgaatttacttttatatatctaagaagtaacttagtgaaatctaaaagtaatttagacatatcataaaagtaatttgtgatttttcgtcaaaatataatcatgtgagatcttgttgtaaagatttaattgttacgaacacaacggtgtaatcggatcgtagatcggatgagtagtttaagagaaaattgtatttgaagtataggtggatggtgcctcttatggatggagtggtagctggtttgccactagctgtgtagttacgtcccatgataaaatattgttctcactaaacaaaaaaaagggggatatatcatcgcctcaaatgcgtctgcacgagtcagggcccaacagtcggcgccgcaccggcagagccgccggcggtgggttcagggtcaccggcggcgagatcgacgacatcgtcgtcggcctcccgaagccgatagagttagatatcattgttaatctagattatatagcatatctaccatctcctagaggttttcatcaacatgtctagatattgtatttattcttatgcttaatgttgcatcgattgagttcgatctattaagtgatattcataactgcgatatctagtttgtcttatgatcgtcaaaggagatggtatcggggtttcagccgatcttacctcatttagctacctttcatccctacatgttcacttgatatgctaaatctgccctttatattaagattttattgcattaaagtatattagacttgctgtttgatatattttgtctgttttaatatcttgacatagagtggtatcggagtactagctgatacatgttagatctatttgatcggctatgctacgaacgtatatataatcttcatcttaaagtacttttaaacataagtgatttatactggccagatatttttcaaaagtagttaaaattaatttcatatttttagctttctgtaaatcatactctagaaaaatgatagtatcattagcatattgtaagatagataaaccatcatcaaccagatgagggaccactccagaaatttgaccatcatcttttgctctctttattaatatagttaacgtatcaacaactatattaaaaacaattggagataacgggtccccttgccttaaacccttatatgtttgaaaatttgatcccacttggtcattcactttaatgccaacatgtccaccttggataaaagacgcaatctaatcccaccatttttgtgagaaacctttcattctaaaagtttgttgaacaaaagaccattttactttatcataggctttatcaaaatcaatcttaaaaagtacaccactctttttttcggtgcaattcatgtagtatcgtttcatgaagaataacaacaccctccataatattcctctcaggtataaaagccgtctgtgtgggactaataaccttctgagccactccagaaattctatttgtagcaactttagtaaaaattttgaaactgatattaagtaaacaaataggcctatattgttgaattttcaaagcctctttgcacttggaaaaaaaatagtagtaccaaagttaagagagtaaagaggtaaattaccaccatgaaaatcattaaataaattaaccaaatcaggcttaataacattccagaaaacctgataaaactcagctaggaatccatccggacccggagctttattatgttccatttgaaaaatcgcatgtttaatttcctcataaaaaatcttgtactaaagcattattttctaattgagaaacctggggaatatcacttatttggctttcatctaacgttaaggaagaagcttcgggatggccaaaaagacctttataataagtggtgatatgcgcctttaaattcgcatcaccattaactacctgatcaccatcctgtagctgataaatccttgttttcctatgcttaccatttgctacgaaatgaaaatatttagtatttgagtccctttcaaaatatctttagtgttagctcgctgataccatttaattttctcttcccttagaagacaagataatctattcctcaaataaagtctagaatcaagctcttcttgagttaacaaagttgattatgcctttttataataaaatttagtatgtttggcccaacctcttaaaaattgtcttaatctacgaatcttagcctgccaactctctaaaagagtattaccatcaacaacacttaaccaaatttccttaaccatatccacaaaaacatctctttatagacagcccaactcaaacttaaaatttttgatggcgattggaagtagatgaagaatttgttcccactccgtcgacattaacactctatctaacttctctgaagaattttttcccactccatcgacattaacattctatctaacttctcataagttggcagtgctagattattggctcaagtaaaatttcttccagatattaaaagttctctaagattaagatcatctataatagcattaaatggaaagggctatctattatcaaaattgtcattattctttttcataggactacataaaatattaaaatcactaccaatgataattggtaaggttttatgactgcacatataaactaactcagaaaagaaagaaagtgttccttaaattcattttgtgctggcccgtacaccaaaactaaagcccatttaaacttatcaatcttattacaaagatgaaacttaatataataatcaccctcatcaattaagccaatatcaaaagtctgtaatttttatagccaaataatttgatgtgctcaaacgctaaacctttacttgaagcaccgctggtcagatcagcagctgcctgaggcgcaacaaatctgaataaagaagatacatttaattagatagaaggtccttattcagaacaagaggaaactggcgagaactttcactaaatcagatatgaaatccaatttctgacgtccatgaaccataatacactaaaatttcgccagcatatacaaggaatttcagtgaaaaaaatccatttcaccaaaaattctgcaaaccatattcaaggaattaacaaagcaatacacaatctacatcaaacagataagcaagtactgaattgcaacaaacacatgatggatatcttgtgattcttgcgaggaagaagaagaaagaatcgctgcagacctggaatctcgcgtgagttgccgaacaatttctgcccggcgttggtgggatcctctcgcctcaaaacctaccgattcaatggacctgaagagattcgaatgtgcaagaattagaactcagaatcaacagtttcaatggatctatcagaaggcacctcggcaggtgcagcattgccgagcggcggatcgcatggcacgacctgtcttctgaatcatcaagaaaaccatcaacgtagatcaccaactgatccttctcgcagttgagatataagaaagaagaaagaatcgctgcatcattgcagacctggaatcttgcacgagttgccaaacaatttccgcccggcgttggtggtctcctctcgcctcaaaaccaatcgattcaatggacttaaagagattcgaatgtacaagaattagaactcagaatcacagtttcaacggatctaccagaagagcacgcagctcggcaggtgcagcatcgccgagcggcggatcgcatggcacgccctgtcttctgaatcatagaaaaccatcaatgtagataactaactgatccttcttgcagttgagatataaagagtgcacgagctctggatcaagccgcttgggcatcgtcgatcttgaggagaaagcccctctatttgcgatcgtgccaagaaagaaaataaagaaaatgaacaacagaacgtgaatggggaggagatgcgtgagctctctgtcaccttatcaatccggaggtgcaactgcgcagcttggaggaggaggaggaggcagctgccggtggccggagtggtgcccgcgtggcggagcaggagggggaggcgttctcgtgggtgattgtcgggggcgcccacagcttggaggaggaggtggcgccggtggtaagtgagtctgagcgtggcatggaggaggaggaggcggcggtggatccggtggtcagcgaggcggagcgcggcgtggaggaggaggaggtggcgccggtggtcggcgaggcgaggcggggcgcggcatggagaaggtggggattgcgagcgcggacgccttcccttctctctctgcttcttgatttccccctctttctctcccccttctgtgttcgaaagcagaacacccgcggttgtgttgcgtggaagagggggattaataagggagggaagcgaggctgtgaggggcacagcacagctttcctttgggctttaggcaactgggctatgcaggcttggtgggctggaatgctactaccaaatcggtttttaatccgtgctttgaggtttttgccttgtacacgaggacatgttcctttagacggagccggcggcgacgttaagcccgagtgactaataaaatatttttttcaggatcgattaattaatttttataggtgttgatggcgaacacggtagcggtagagctcgagtggttgcccaacccgcccgtgaggtgactctgccactgggtttttataggtcgattcttaacgcatggttttataagtgtccaataagacctttttaattaggtctaaaattttcaactattaaaaccaatgcactatatttgtatcaaaatataagaacttagtagtattgaatatgacacgtcctaggactactaatctggacatgacaccaggatatgtcttatccagtattaggctaacactagcctcttatattacggcacaaagggaatatatcaaagtctcttaatagtttggatgacagtttcatcctacgtgacatgttaacttgcttatatggtactagaagaaaaacttaatgggatctgcgtataatcataccaaataatcaagatagaatctgttaagtaattacatcactaatttctccaagccaattaaactagtaacaagtaaataatcaaccaactcacaacacatgaaaccatttggtgccaagatgatactccaatcaaccaacccgtcatatgggacgccattatatagatttgatattaaaatttttgcccattagtttctcattgataatcaccgacactttctgccatgatcaacaaaatccaaaacattttctgatcatatacactacccactgtgaccgtggccgttcgatcagcgccgaggaagcgatccaaaccgttgctcagctccttctcgcagagtcgccgtcctcccctcccctcgccgccgccgccgccgccgccgcgccaccaaacactcgagctcgccggacttagggttttagcttccttgcctcgccgcggcggccgccgcctgcctaggggcttatggttactgctgctgccgcggctgcatcgaacaaccactagaagctggctgcttagggttctactagcttcctgcctcgccgccgccgcgatggatgcgctccgggaggcagaggccaagctgaccgtgtacgtgcacccctccaacgccgccgacgtccgccgcgccgtcgcccgccagctgagctcgctcctcttctcgtgcgtcctctctactgcccccctcctcatcctcgttcttggctccatgccatgctagttttctaaagacatttataaattaaattacggtacaaaaagaagaaaggaaggtgaaatgggagtcatagggactgcgatttctcatggcatgatggttcttgatgcttccaagcttccacgagattcgctttttccccgcggggtgattgattttcatatatgcaggtatgaagatcgcttcgatggcgtactattggctcatgaagcaactgtagagagtgaacaaggcaaaatcctgaatggtttggtaccatactttggcgtgcccgtgcacgcaaatctgctgctttactctccgaaaccagacatgatgctgggtaggttgtgttattacagaagcccttaacttgtagagtatttacactgtcctgcttaagtgcattttttgtatcagctgatgcctgcatgttatggtggctacacaaatttgcggcacttgagcagaacatttttcatattgtgttgtatcaagtgtggtgttgttttgcaagtagatggctccatttgttatatcttttttcaatggaacaaccaatctggtaaattatggaacatgtgattctgaatttttttttccttattgtttcctattagaagggaaggttgaaatgcttggaaaggaatcaatacatgccattgtattaggggtattttcagccgccatcatgttggatgatattcatgagaagttcaagttcaaaagagtaagatcaagtgatcagcttttctcttcataatgattaatgatggtttgaaagtactctctgttcttttcattgtgactttcaaatttatagatgaaactctttgtgtctctagtgtactaatcggttttattggtagcatccattttttatgtgtgcttcaatgcttcacaaattgtattcaacaaaacaactgccatgtgaaagggggaacatagcttggcaggaactgtaataactaagttcaaatactgtttgatcattgttagtagttggaagcatatcactgctgttgcaccgctttcaagtgtttttttttttggaaatattaggatcagtgcttactaaatgactaaatttattgtggaaagaattgattgtggggcagtccattcaatgcttcacaaattgtacgttttgtgacaatttggttaacttctgatccactggaaagaatcttatggaatctcatattatactgtgaaagaaatgccaaatacttccattttgtgtggtcactgaatagtgaacacaatatgtggctcacaaacttatctattctgtaaataatattaatttcgtaaaaacaatttatcttaaaatgatattgataattctatattttttacacagaaaaagtatggaggaaaatttgtaagccggtcggacaaacagcacgtgattaaaaagggaagcatgatacgattttctgtgaaaaggtatgggctgatctttagtccccttgacagtttcaaaattttcattcattgtttgctttccactgtgaaacacctttattcaaaagttatggcacttgtatgttactatatttgtaatttgttagttgtatgcagtacttgctgtacgttgttcacgaacatgcattgttctagcatgttagaattgtttttcccctggtgtgcttattatgacaggagccctgaaaaaagtcattttgatacaatggctcttaagtctaataataaaacaatgtgaatggttttctgaaatacacacatgcatttacatagcacagctaatctatatagcaaaagcttcttttagcttcctgtgttatgtacaagaaatgaccagcaatttattccccggtacaactgaatggttaaattagggactatgggatgattggaaccagctaatgtcaggctccatattccgagtgacagattgatcatgttctcttcttttgatgttcaatcacagggtggatgcagaaatgaattgtcacgtaactggttctttaatcccacctcacactggatccatgctttggttgtcagtacacgatgatgaatatgcattggaaatcaacaggtctggatatgcaacatagtatctctgctactttttgtgctggtatttcaatcgactcatgctttctagcttttgttttttacatgtgatgctcaaattttccagcgggaaaaggtcaagggataacaaaattaaaactgagcagcacgaacaagatcacagtgtgaagagttctggaagaaaacacaagtccaagtcccgaaagaggagttttgaggaaagatgataccgattttatggagcagattgtttgagtagaaattatagttgatagctgggagctgcgtctgcttcctgtgaatagccactgcagagatacgctgctccagttgaaatagcctgattaggaagctgcttcctgactgttttacagtgtattatcagatgtcaccctaattttctgttgtaccatcgactgccatgatgatgtaaaacaaatcaaggatttgatgtgtaacatttacctgttctaatggatgttgatcttatcccagaaacacacgagtcaagtgacaaattctatgttctggtgttactgaggcctgaggtgttgtggttcagtaagctccttagcactatgaactatgaatattatgaatgtggtacagtataagcaaaattatgcataagcaagctgcatgttcatctcttcttgagcctcaaccaacactgacatgtcaaggaaaatctgcaatcacaatttgagggcgtccatcgaagtgtttgggtggtgtagtggcgcaggatctaggatcagctatagcttatataggttgtgggatttacggaaaggaagccgaaacaaccgcccagtccgatttcaacaaaagatgctgcccagtccgatttcatcaaaagatgcacgctaacattttctcttttcgtgtaattaattataggcccatgaattgtaacaggtttttttttattaagtttggtggaaggatttggatcgattgggctgtttggtttttacgaaaaagctaatgggcggctagtcgcgcgctctcttccccgcgcgactggacacgtgtcgcgcgcggagaggtactgagtagtagtagtggatctggtggtcgcgcgcctgcgcgaccgcacgactgatcgcgcattagggacacccttgttttttacactgatcggtattttaggttgaacggtttttatgggagagaaggttttttaggtggaagtgggacagagatagaaataggcggtttttatatggaagtagggcatattggaaggaagggaggatgactccatctattagtagtatagactgtatagtaatatgtgtgtactttgtaacgggtcaggcccatataattagggtatattggaaggaagggaggatgactccatctattaatagtatagtctgtatagtaatatgtatgtactttgtaacgggtcaggcccatataattagggatgggctataaagataattgaggataaaatattacatccaatggttactttttgcatgcgcacacgctgcgctcggtgaaaagatgggatggaaggagaaagactttgcttttaaggtagtagattagttataggcctatgcatatcttttctttttgttctttggtgagaggatttgggtgggctgttcggttttttaaggtggctatcttttttttttgagaaatcagtttttcagggtgaaacggtttttattggagggaataggttattacatgaagatgatgaagaacaactcttttaagttatagagaaaatcaattttgagggtggatggtttatgggggaaaataggtttttacatggaggtgaaagaggatcactcctcttttagttagtagagatagagaagagaaaaaaacattctcttttgttttactaagcattctcttttaaggctcagttttaaataaattattgagtggattgtggctaccgattatttacttaattgtagggataaattaaatattgtaataaataaacttaacaaataatttaaaacaagtggtttttaacaacacatcgatcggatcaagaaaatatattctcatggagcaaatctgtttgaagaatccgaaaaaagaaaagctgtaaagaacttaaagccttcagacttcccttttaacaatttatcaacaggtgcttcaaggttcaaacaatctagcagcttagcagcaaacacaccttaaaaaagactattgaaccggtcgaaaattttgttttcgtcaaccacgtatgcacgtctgatttcttttgtcagtttcccgcggcgttccattcccttctctctcttttccacatgtcatcccattatcgtccttgaggctagtaaggctaggcacaacttgttctttcttttgaattctggcaatttgtttgtttattttatgatgaccaacaaacatttaatgatgttcaaaacaaatttttatatatacaaaaactatacttatatagaaagtttatgagcaaaattatgtatgatcaagctgcatgttcattatttgaagtacagagaactgaataagttcgcacccaaaatttcagagaatgtacatgacgcactaccacaccgtggcatatacacaactagaagtagaactgcacaaaagataaacattgccagccaaaatcgacatgaacatgatgcttctgagatgcaggtttttctacttagaccacggctttaaggagaggacgacgatgaggatgattatgaggaggatgacaatccctatgcaggtccatttccgtgtgttcttctgcagaaatcttgctttctggaggaggtttgttccagtctgaatatgttcagctgcacctgaaacctgaagagagatagataggtcataggttcagggattcagaagtcagaacaaaaatgtggctcacaaaggagtagcaaagatcctctgaaatggcatgtaaaattttacctgtgactctatattgtccaggatctcgccttgagcctcaaccaacacggacatgtcgaggaaaatctgcattcacaattgcaaggtaagcacagtatttggagcttcgattttctggaagattgcttattcattacctgttgcagctcaagaagcttctgctctatctctttcactgcatcatgccgttcctgaatttcttggagagtgtcaagcacctgcaaaagccataaattcaggttaaaccatgttttttttttcggcattaagctttctatgttagaattatcataagaggggccaaaagaatcggtacccttccacggccttgttcctgaatagctctctgaaaaatttgctcactgtccccagtttctatcagcttgtcaattgtctgaaaatttggccaggtgtaagcaacacaccatatgcagatttgttaacagatgatttgaagttaatatacttcttacctcttcgtcagcacgctcgccagtgactgttttggataattttacacaatggatgattacaagagtaaggctatcagtgcaattcaaatagaaatcctgataccatgttgagaatttaacataactgaccagtgaaaacgcgccgctccactacatcccggtattccttctggattgcctctcttaatgtctgcaaaaatagttcacagtaaggataacaaccacgcccattttacaaactgaacaatataggtacaatcctgatgcttagtgcttatttcagagtacatgagttggtgaattaacaaccatgtgtgctaaataatttctatcaggtagattgtgtgcaataattgatgaaattcttagtgaaaaggcggtacctgaaactcagatatccgttctctcaacctctttgtcaatgagctgcaataagattatcaactggaagtcagtgatgtgaaaaacataacaaaaaggacaagaaagaagcaagagaatgaatgtaggatgcatacacagtggttgtagtccgggatctgtccactcccgaacccttaccgaagcctggtttttctctgtttgcagcattctgtaacagaaaagaaaatcaaagtggcatatatcaaatctgtaggaagtaataaagataaagtagtaggtacttaatgatgtaccattgggaaaaaaatattgagagaaaatttactcacgtctttattcaacttctctacttttgattttgccagacgtgcagtttttgtcacctcattgacatccttctccatgcgctttttaatctctacagtttgaaaagaggaatcaaattagtgatgcaaaattgaagcaacgcaagtatccataagctatccaatttgcaggaaagaaccaaaatcccgtattgtacctttcatggctgatgccttggtaacaatttttgactcctcatttgagttctacatgaaattcgcagacttttagagagatgaagagtaacattgttgaataaaaaaatcattcaaacaaattcagggaaattaatcactattaatttaacagcatctggaatacacgtatcacatcgtcacacttgtatattactatattctgtaggtgctactgagatttgatgcatgttcaatatctgcaatttaaattcagcaacaggtccaatttgatattgcagctcacctgaaggtccttcagtaactttgtcaatgtttcatgtagcttctcgatctccctgacctgaatattgtgaatggaaccatttcaatcacttaagaaagttctgagtagctatgttgatattccgaaacttgaacgcacctgttcaaagaagccttcaaagccaggctgcgcagaactggacatgccaccctgcaaccctagctcgatatcaacatttgcaggggcttggtccactttgctgagctcaaacgaatcctgtaaaattgaagaaccacaaaatatgctgttagtttcacatttttctcaaaatttgaaagagataaaaaaaagtattatatcaggcttgcaatcaaaacttgggtcaagaaggtactgtggtcattccaaatatatagtcttgcaaaatataatagcatatctaatacaaattctgctctgctctattaattaacatataaaaggcaatcctcctgccttttcgtttcaaacaaatatctaatacaaaatcaggaacaaaattcaccgcgtaatcctgtcaagatttttttttaaaaaaaaacaaaaggtcatcaagatatttatgataatcatgtcttgacaaaagtcttaaaaagatatttcttaacaactcaataatttccacagatatcagtaagaacaccaaatccgatcctgtcacgaagtcgatcaagatcgatccaaacataaaccaggagtccatataacatgaagttcaccaaaattaaaatattcaaaaggcttcagcaaacaaaacgatcctcaataatcagaaaccggcaaaataataaaaaaaaaaaaccaccatcagaaccgagaactcaaaattttcacccccaaaatcaccacaagaacaaccaatcaacacaactataaaactcataacaggcaacaaggcgatcaatcataccgtgagaaggttcctcatcctcggagcaacaggcaagaaccctcagaattctcagaattcccacctcaaaaaggccccaaaacaccaaattttctcgcagggcgcgttcgccgggtggcgggggttggggttcttggcggctagaaccggtataaaaccgcggttttgataggaagtttcgtcgctgggaaaggaaacgaaaaatcaagagaggctatggagtctcgagagggtttattaacttcaaaggaaggaggagggatttggcggtcgtgtaggaagacttgccatccgatgtgtccacacacaacaccaaacaccgtttgcttcggccaatggatggtgttcttgtttgttttgtcatttgtttttccatttttaaagttgtcttttttgcatgttgaaagagatggatcgtttctgtctgggacagttttgatctttcacctgacataaataaaggattaaagtgtttgatggaactgttaacttcgaagaatgttaccataaccacccccaattagaagcagcttaaatggataatgagtgggggaaaaacacatagtcatggtactttgctactctctctgtttcatattatttatcattgtaacaaatctcacacaaattaaagagatatggcaaatcacattgttaaatacatcctattgtttttccaaagcagccgtattaactgtgatttgttgagatgagcccataagagttgtaaatgtgtattaatgaacgatagaaagggaatgtcatctttaaaattgttttagaatatgagactaataagtactccctcatttttttattataagtcgttttgactttttccctgttgaccaaatttataaagaaaatatagcaatatttcaaacacaaaataaatattttataaaaatatatttaatgttacattcgataaaactaattttatgttgcagatattactaattttttaatatttgattaaacttaaagaaatttcactagagaaaaattcaaaacgatttataatatgaaatgaatggagcactattttcattaaaaaaattgaatgccagatcaatgggagtagtaatatttttctctttcttagatacgatctaaatcgcacgaagtactttgtactagtagtaccttagtactgtgcgtgtgtacaagggtcaagttattgactaggttaggcaagaattagtccatgaaataatctgtcaaagctttgaatctgttattggtcttcattcatactaatccttgaagcttccagcccttgcttttctttttcttaagctactgtctgcatccgttacagttgaaatgcttaattttactggagattgagggaattaagaattagtgatttcctatcatgaaataaaaaattatttcaaatgattaattctacattaaattgttatagtacaccagtcaatatccatgtgcctatcaatcaagcagtcgacctagccatttttctggacttccatggggaaaatgctagttagtctcttgctaatattaataccatcatattgaacttacggtctgtttcggaaaaagtaatcatgttgcacacactgatgtacagctcctgataaattccattacagtaacaaattgaaaatatcacacagccaaagatgtgccactcgtaccacatcaaaaaatgataacgcaaaagcaaatacaaaaccatgagactcccaaacccaaagtaccattgccaacatggcaacaccacacgtcaataacgttaacagtaacacatatgtacatttgcagtaacccaagaattttgatgttacagtacaagccaaagatgaaattcagcagacaggggagccccactaccccccagtatggaaatcagctcatacaaactacacgaagggctcccttttcagttattgagaccaaatgatcagccagttgtataatggtgtcgtcttggttaaaaatagattttaactgtgtagtgaagcatctaacttccacacgccaagcactcctcccggttgttcaaggaacaaaccatttgagccattttagcttccacgtcctcttcctctgcagccttggtgccgttttcctgaacaatatttttaatggtgagttggctattcaggaatgtaaaacaattatggggagggccagaagacatactccattggccttcaaaagggcagtatcaactgtgaacttgattgcgtcagcagctgctcgtgttcgtagataatacatcccagttttcaggccctaaatcaaccaagatgaaaccatgtttacttgtagaccttgcaaaaacacaatctaaagacagcagttctttttcatggcatgacaaatacagaataaatatgggctgcatagagttcaggaatatgctttcacatagccttaataataccttggaccaagcatggaaatgcagagaagtcagcttcccaaagtttggttgttccatgtgaacattaagactctggctctgatcaatgtagcatccacgatcaacagccatgtcaacaagcgttttctgctttatctcccaaaccgttctggaacaattgaggttaaacgtttagataaatgaatatctgcatctggtagaacatagcattaggagtttaggacaatgaacaacatacttgtaaattgcttttagatcatctgggatcactgtcatcttttgaacagaaccatcttcataaattatcttatttttcagagctggagtccaaacacccatttcagtcaaatcatggagaagatgcttgttaaccacaacaaactccccactggaaaagaattaaacaaaatcaatcataagcacctgtagtgagcacgagcactaagaacagtgtagttacaaaccttagaacccgccggctgtatatgttagatgtataaggttcaaagcattcattgttgccaagaatctgactagtggaagcagtaggcattggagcaacaagaagagagtttcttaatccaactttagaaatagtactccgtagagatggccagttccatctgtcagatggaactacattccacatatcaggttggagaatgccctgaaaagtggatagaaaacagccttagaaagaatattacttgttgatatccaaccaacaatttagtcaaactacaccaataaataaattggtaaattcagctactaaaaaaagtgacattagtaaaagcaaaaaaccttgctgacagggctcccttcatatgtttcatagggaccttctttaccagcaagctcagcggaagctttcagagaatgaaagtaaatagtttcgaagatatccttattcaattgctgagcctgaaaagaggggatcacattttttacatcagttaagtgtaggaaggactactaactagtactactatattactgaactaggaaaagttacctctggtgaatcaaatggcatgccaagtaatatgaaagtatctgccaacccttgaacaccaatgccaattggcctgtgccgcatatttgatctttttgcggtttcaacagggtaataattaatatcaattattttgttgagattgtatgtgacagttgaagtaacctggtaaaatcaacagcgtgtcagaacattcactgacataggcaagagtatctatttttagaataaacagattcgatcagacagcagacctcagcaagcttgtcaaagtcaaaatatctatttttagaatcactgctcccgacaagtttagatggatgggactctatggggacaccctgcaacagaatcttatgatcagacatgtaaacatacaacatttagggttgaaatcagccaaagcactaacaagatataccttttcccttacaaaacgtggtaaagcaatagatgccagattgcagacagcagtttcagtagggcttgtgtactcaattatctcagtgcataagtttgaagatttaattgtgcccaaattctgctggttacttttcctattgcatgtatcctgtgggacaacaagagcattcggaatgaatacttggaacctgactatagccagcagcatatttggaggaatcttgggtccaaaatcaagtactccttgctactaattttgctaccaaatttaccttgtaaagcatatatggtgtaccagtttctatctgtgcctttaaaatgtcaaaccagagggtctgagctgggacaattttctttgccttgccctgaaagtacaaagctatgttattgtaatcttttccaacttcaataaactgtagtacaattaaatttcgtttccaacttacctctctctcatattttgtgtacagtttctcaaactcatcaccccagcaatcagctaaccctggagcttcattgggacaaaacaatgaccattcttggttattttggactctttgcatgaatagatcaggaacccagagtgcatagaaaagatcccttgcacgatgctcctcctattaaattgtcattcataaaaacatgcatttcagatctttcttcaggctaaagcctttaagttaggagaaatggcatatattagaaacataaacagcacaagcaaagcatatcaaattgttcaaagcatatcaaattgtccagtgatcacagtatgctggatagtgaaaagcttctgaacattataggaagaaatacactagagcctgctattcttctatccaccagttttttctaatggtataactaatttgcaccaaagacttgaacattcagctctgcatcataacatctattacatgtaagcaatccatttcaagttcagaaaatgtagatgcaaggatacattgaaatcagctcattgtcgcaacaaatccagaagatttaaatggttacagttttctatgcaaaggaattaataagaggatctggttgagaatttaccttcccatgattctttctcagatcaaggaactcaaaaatatccgcatgccaaggctccaagtacacagcaaatgcacctgatttttaggagggtatgagaattcctggagattatggtattagagtaattttcacaaataaaattgaccatagaacctaccctttctcttgcctccaccttgatcaacataacgggcagtatcattgaaaacacgtagcataggaacaatcccattggaggttccatttgttccacggatatagctcccagtagctcgaatattgtgaactgatacaccaattcctccagcagatttgcttatgacagcacattccttcaaagtatcatagattccctcaatgctgtcatctttcatgcagataaggaaacagctgcttaactgcattgcagagaataaaagagtaagcaagcaatttcagagtccaagactaggatttttctggtcaaatgtgcagtacttggggccttggagtgccagcattgaaaagggtcggtgaagcatgagtaaaccagcgctgagacatcagatggtaggtcttgatagcagactcaatgtcatccttgtgtatacctactgaaactctcattaacatgtgttgcggcctttcaacaaccttcccgccaagtttcaggaggtaagacctctccagagtcttgaaaccaaaataatcataatcgaagtccctatcataaattatctcgctgtccaagcgagaagcattctgaaaataaggatcagaacatcagaaaccgtaagaagcataacatacatcaataatcctaatgaccaataaattgaatggaacagtaaattttacaaatcagaacaagaacagctatcagtgcaagtccctaaagtttaatttgatatctcaccttcatgatgacttcatatacatcgtgggcaaccaaaggagcattcagcccagatctctcgttgaaatgtccatacatgtccttaatcctgcatccataacgaccaaatcccaattcacatcctaatccataaatcccaacacccttcgcatgattcaactgaaacaaaagcaatcaatcgcttacgtctccgagaaggacttcttggtgttcttgtgcaggttggaaaccgcaatcctcgccgcgagcttcacaacagcaatccacatgtcaggaggagacaaggtactaccgaatggggaacaaaaaaaccaacaacggtgaagttcagtggctgttaccgaggcgtagtcggggtgggacgcggtcatggcggcggcagtctcggcagcgagctcgtcgagctggctggtggtgacgcccttgtacacacccgcgcataccttctgcgcgacgagcaccgggtcgcagtgctcctggctgaggccgtagctgagcttcttcagccgcgccgtgatcttgtcgaagtgcaccgtctcctgccgcccgtcccgcttcaccacgtacatcttcgccccccacccggcgaggccttccgtcgaacacctggtgtgcacgcgcgcccgccgcctccgccgcggcgattggattgggagtggggaggaatcgtggtagggtttgggttgggagaaccgcgcggaggagggggagatttaaatgctttcccggcgcggcgagaggagcattaattaatttatcgctagaaaaaaaaatcggagaaatcgcgagagaaaataatacttcgatttggagcaagtttggcgcgcgggcgcggagctgtttcccgcgcggattttggcgtcgtggggtggggggcaatatctccaggtaaccaggctagtgggcaccaccaccgcccaccccgacagacatgtgggccctaccggttgtcccccacgcgtcagtgagtttggggtaggaaacgcggggaacatggcgagggggcagcgtgcagtgcaagctgttgcgggttttttttttttgtgaattttttgcggggcggccgctgaaattgagacggcggcgtggactttcggggaccgtatgattgtgggcgtagccgtccgatgccggtttcttctcggagaagatggcgccatgcgggcacgatgagatgggatcccgaccgttgagctgtggaggggaattatacgagtttttcgaattcgagagggaagtgtgcaggagaaggagatgcagaggcgcagagcactgcaacagcgtgcgtcactcactacgtcaccgatgcaatatgtgatgggccgtgctaaggccctgtttagatgggactaaaacttttaaacttttaagtccctatcacatcggatgtttgaaaattaactataaatattaaacgtagactattaataaaactcatccataatcttggactaatttgcgagacgaatctaatgagcctaattaatccatgattagcctatgtgatgctacagtaaacattctctaattatagattaattaggcttaaaaaatttgtatcgtgaattagcttttatttatgtaattagttttgtaagtagtctatatttaatactctaaattagtgtctaaagacagggactaaagttaattccctggatctaaacaccatctaagtactgcactagctagcatctaatgggctgttgcctgttgggccttctcattcttaactgcaaagctgaagtactgatgagcagctttgtcattaccatttggttacctacggaaaaccgatgtaatttggacgattattcacacaaaaaaatcgaaaactagttcagattgatatgcttccagtataattcaccgagagattcctcaattcgcacagagacttgatcataagtcggatcttttctcgtggattaattaattaaactacacttggattaaaaccggaggtagtacattaatacaacacaaatcgcagacacgagtacgatcgagagagtaaaggtagcacagtatagctagctagcgagggtgtagtatagtagcctccgccattgacgacgacgacgaagctttgc

SEQ ID NO: 44356 - DNA, 2602 bp, Oryza sativa
cgcgtcgatcgggcacgtcttcgtcgccggcgggctcggcggcggcacgtacggcggcggcgacggcggcgtcggcggcggcacgtatggcggaggagacggcggcgtcggcggcgggacgtacggcggcgtcggcggcgggatgtagggtggaacgtatggcggcgtcggcggcgggatgtagggtggcacgtatggtggtggagatggaacgtacggcggagttggcggcggccgtggcgtcggcggcgtgtagggcgggtggcacgacgggcaccggggagacgggggaggtttgtggtggtggtggtgctcgggcggcttgccgtggtgaccgccgccgccgctgccgctaccgggcggcttgccgtggtggccgccgccgctgctgccgctaccgggaggcgggcagtctttgttccagccgtgggcgacggagacgaggacgacgagcaggaaagacacgacggtggcgagcgccgcagccatagatgctggtggcgcggctcgacgttgcacggtggcgtgagatgggttggcgcgccttttatagagcggccatggacgcccacgcctccgctgatcactgaacactgaacacgtacactgaacacgaactactgtcagtgccactagctagtgctactaatctcccatggtcaacacctgatccaatcacaagttcacaaagcactgcactaaccaagcagcttgtatgttaatcaattaatcaactcagtctcgtctcgtcatctcgtgcatggcatggcatggatgcatgcgtggatgggcgccaggtgttcgcggcgagccggcgaggcggccacctggcccggggcgcgcgcgctagcggccacggcgcgggggcgctcacgggcgagcaccgcgcgcgcgcgcggacgtacgcgcgccgacgcttctagcgcgctagcactcggcagcacggcgcgcacaggcacagacgatgaggtcgagacgccgctgcggggagggggggagactgaggtggttgtcgccatgggacgcgccatggcgcccgtgacctgacaccgccagagcgcgccatggagttttccggcgacctggacgcccgcttggggctccacctagcactgcggctgcatttgccaccacgtacgtcgagattcgcactggcaatccacagatagggacatagggtgtgttcgctgctgatggatgggaacatatcaccctagcacgaaaacagaacagtccatagcacgattaattaagtattagctaatttttttttaaaaaaatagatcaatataattttttaagcaacttttgtatagaaactttttataaaaaacatatcgtttagcagtttaaaaagcgtgcgcgcggaatacgattgagaggggttgagaaccctttggtcagaacacaccctagggattgtttgtttcactaccacttattgcctgactattgctacaactcaagttagccagatttgactgtttggatgttatactaagtttgccaccattcaccgtatttttatgtcacacttatctaagttgtggcttacaataagtaaatcacaccttaactagcgaaataggattgcgccacaccttattgagttaatggcacgtggggttataatagataagaaggaatcttgccacaagtgtggctatgaaccaaacaataaattaacttggtcaaacttgtctaacatgaggtgtgtcaacgtttggcaaattttaggagcaaaccaaacaacctctaaggtaagattccttcaccatgatgtgggtcccatgtgttattggtatatactccctatgtcttctaatataagggattttaatattttgcttgcactgtttgaccattcgtcaaaaaattttagaattattatttagttttttacttaatttattatacaaagtactttaaacacaacttttcattttttatatttgcacaaattttttgaataagatgagtggtcaaatagtataagcaaaatatcaaaatcccttatattatgggatagatggagtaaaagtgtagcaaacttgctttcatacagctgaagtgtggctttaattttatgagccacatgttaggcatgttagttaaataaaggaaaaagtacgaattacccccccccgaactatcgcagtcgtccgaattacccccctgaaccataaaaccgaacattattcaccccccaactatgtaaaccggacgaattaccccctcgacccaatccacgatggttttggtctatgtggcgtacgcgtggcatcccagtcagcgttttttaattaaaaaaaatggtgggacctgcctgtcatactgtcccacctctctctcttccccactttcctctcaatctctctctctttccctcttcctctcaatctctctctgtctcagatgtggcccgcgagttggtggccagtgctaggcacggcgggcgtggtggagagttgggccgcgtccggcggctggcggccggaaatccactgcgggcggcgggcgccgtcgcccccacgcaccactgggagcagcttcagctccacgcgcaccacgggcaccacgggcatggtgcgacgcgaggcga

SEQ ID NO: 44357 - DNA, 26147 bp, Oryza sativa
agacagacgaagagagggagagagagaagagatgaaaagagggagaggggaaagtgaaagagtatgacaggcgggtcacaccattgtttaatttaaaaaacgctgactgggattccacgtgtacgccacgtagaccaaaaccaccgcggattggatcgaggggggtaattcgtccggtttgcatagttgggggtaaagaatgtccggttttatggttcagggggtaattcggacgaccacgatagttcgggggggggggtaattcgtactttttccttaaataaaatatggcaagctttggtaacgtgagtataccaatcaaacaacaccttacagtttgctatattgtcggtgttcctttggtgcgcaagaaatttaaatgatttctttatgtaatttagttcagttgacattcctctattcgaaatttgcataagctacggtgattctcaggcttggaaccaaaaacctgtgtaatttgacaaaccgcgatcttatttctatgagaaacagagagtgagaggcctgttagaaaatgatagacatacaaatgataaaaaaacaatagatcaatcatataaggcacgagatttaacgtggaaaaccctctcaaaacaggagagaaagaaccatgggcaccagacagaaaaatatattcactatatcggggcgaggttacaacgtcaaacggcggcttacaagaagtatatatgaaggtgaaacttaaaaggataacgatccgtaacgcggggcccctacaccccaggcgtcctcaggcctctggcccaagcctctggcgacggacctctgctttgctccagcagaagttggcctttatatatgtgcaaatgaatttagatcacaactcaacaattacaatgctacactttttaagtaatggaattacgtggatatatgccccatttcaaatagctgaaattatagacggatgagtaatctggttcttatgacagctatttaagagtataaaataaataaattagctactaaaaacatttcacaaaatcttatataaatttcttttgtatcaacacatcatttagtaacctgctgagcgagtaaataaagatctaaaatacagaataaaataaaaatatacagagctacaaagtgaggaagagagggaaagtagtattcgggaaaaaaaaacgagattggagggagagccatcccaaacatttatttttaaagaagaaattataagtgtgttggggattaaatatgagacgtgagggaccgagggttaaaccacacacccctttccactatattaccatgcatctcgaaagtagtattcggtattcacagttggaaagcatcaaccggatgatcagcccttgtcagaaaaataagttgttattacacgttgcagccaaccacacgtacatgccgtttttcgcttgtgcaaccagccaccaaacacagtgttcggctgatcatctaataagcgagattagacatcagggggcgtcacatctccagggatttgaggattatcaagcctagtttcactatacaattaaaaccaaaacaaagcacccggaaatgaccttaaaaatcatcaaatttcgctgctttttagcagtggatccggccatcaccgacgtgcctttcctgcgatgaggaaaaaaaattacagttagcttcatttgctaatccaaaagtttcacatttttaatcattcatcacgttctagctgtgagtaaagacagttcattcttttttcgcgaatatgcaaaagatctacagaagaagtttacaaaagcaaaaacaactgcaaagcaaagagagcagagaaaacagttcattcttgcagttcaaacaaattgaggtcacttcagtgatgatgaattaattctttctttgttcagatgataactcaccacgctgagatgatcgaggtctatatgatgcagacgccatgtcatttaggtcctgcaacggcgtcaggtgcttgacaacttcatccattgtcggacgagacttggtgtcacggctgaggcagtggtagcagatctgagcaaccttctgcacccctcttactgaatagttcagccccaagcgaggatctacgagctggtagagccttcgccgatcacttagatacggcctcgcccatgccactaggttctgctccccagtaggccgcttcttgtccattgatcgtctaccggttaacatctcgagtaacactactccgaagctatatacatcgctcttggatgtcaagtgtcctgaaaagtgtactttaatgagatcttgaacatgtatgcttgtttctcagagggagaagtataatctgatgtttgacattactttgtttttattattttaagtttttatgaagccagaaaagatctcgtaggaagtaaacttgtgggatgcatacagcagtaatattgaaccagaaaggcagagtagaacatgtaataccaaactggttcctgctatccacgttttcaggttattccaatgaattcggataatcaaatcatgctacggaagagtgctccaagatgaatgttgtctgtatcattgtctaaacaaacaagccatttgttacttaagtaaaaatcatcagctgttacttggtgatcatgtctagatactgcagtttatacgtcatcagatggaatcccgaggcatcttaatattcaatctagtaggaatatcagtgtgatgaaattagaagcaaagatgtagatatcacaccatagaaactcacagaaacataataaaatactaactggtagattcgtattaaagaaaatttgattcaagtagacgacaaaaaaccaaaagtttccgtaaaatacctgtcattacatactcgggtgcagcataaccataggtaccgacaacccgtgtagagacatgagttttatcgccttgaggaccagctttcgctaacccaaaatctgaaagttttgcattgtactcctgtataagcagaatttccactgctgttagaatagcatgcaagaaataatcttgtgaaaatgtgcaacatatttatgagcatgatgtgaatgaattgataagaaatagtaccgcatcaagaagaatatttgatgtcttaaaatccctgtaaattactggtttgggacctccatggagaaaggctagccctttagcagcaccgagagcgatcttcattctacagggccaaggtaggggaagagccccttcaagattaaacaaagtaagataacaggaactttagattgggaaacaatttgaaggcattaccaatcaagaaacttacagaacaaagtacaattgttagacaaggatgacctaatagatcagggaacaccatatagatcatcgttaggccctctttgtttaggcttaggcctagccaattttttggcttatatgttttataagctggtggctttgaagccttaagtttaatggtgaagtcatacctccacttcacataagccaaaaaagctactgcaacctagcttgtggcttaatagtgtaagagtggcttatgtccttaaaaaaccaaacagacaagctgcttatctgtttaggtttagacttttaggctcataagctggcgtataagcctaaacaaagagggcgtgtaaggataaacaggtcctagttttcaatgaactgttaacaattcaatggacaacacctagaaatgatattgttgaggtcaagtcttggtgttcaataaggcaagtcaacaacagcttttctaaaagagtattgtactacttattctaaaacagccctgcatgcattatcaccttggaagaaaaaagagtaaataaacaaagggtcactttcaaccattgttgctccttttgggagaagttactagtttctataaagcagtttaattacttcactacatcaagaaatatttctcaagacatgacaatatctaaatgtttcaattacatgattcattttattttaggacaaaaggatgtactaacacattggcatatgaaagtattcatatagtatatattttgcatgaattaaaaatgtgatgccaatcttatttgaattaaaaagaaatactaatgcatgtatttgattgtttacttctgaaaagatggttgtaaagattgcttacttctgaaaagatggttttcaagacttccccgggccatgaattcatatacaagcaacctttggtcatcctcgatacagtatccaatcagcttaacaaggtgtttgtgatgcagctgtcccagaaagtcaacttccgcctgcaaatacggtatgtttgtaagttataactctacctacacaaacacatgtacaggacaagcacatacttaccacccattctctgtgaccttgaagtgcatcctgcttcaaacttttgacagcaactgtaagaccagtaccgggttttgcaggagatgtgctgtttggatcaatccatcctttgaatacatacccaaacccaccttctccaagaatactatctggcctaaagttaacagtggcagatttcaactcttggaaagtaaaccgaagaagtttcttttcagttgatgcatttacaccattttcatcatcaaggtttgtctgaaaatgatcaccaagctctcgattgctagcatttagatatctggtctctgctgttatagagaaaaacaaaatgcttgagcacctcacccaaaaactgaaaaattcaacaacagaaagtacttagtagatatcatggctatatacccaaactgtcctttgagagccaaattaagcttgaaagaataagccaagatagaatattgtaagggcaatagttattagctcttggttaagtaagttgatagacattgatccaagatttattatatgatgggcatactcctaaccaatttttaatacaggaagaaaacctaccaagttgacttgaaataccatcagtgtgtgtttcttatgttatccaggttattattttgaaagtactactattcagcttaatcatttcccgtctctcaaggtcagcaaaaatgatcagcatgacattagaaagaaacacagcaggatgtattttgctcctgaataaaaggataaacgatttgtttcatgcttctgtcatatttacaacaacccttcttcagctatcacaaggataagaaaaatcccatttgacagacagtttaaatgtataccataaagagttgcttagcacggtatgatagaaagatgagcaaaacccattcatcctcttattgttattgaaacatgctaatccgaagaacacataacaacataaaacatgtctttttgttacgaacatggcaacagctaacaacatgcgaacactctcattgaaatctgaagaacacacggtgctaagataattctgatcaagctcatatagatgcaatgttccctagcacaagctttttaagattatgacactcaagcctgtaagaaatcattgctgtatgcctgtaccaccatgaatagcccttacagcactactataggcatgatccgttccatctcagataaaacagcaaaacagtatccaatttccgtttactctgaatctgtatcccaagttccaatttctcattataacatccaaaattcccacgtatattacatcactgacagtactaagcactaatcatccgatcaaatacacaacagatcagtccccagtgaacacgaccagaatttcccagaaacagaaaagtttcccctttcgatgaacatcaatcacatcgccgcaacaatagccaagcaaaaatatccaaccactagagaacaaacaagcaaaatcaccccccacagaaccaaacaaaaacaaaagaagatcccaaactcaccaaccagctacaaacaaaaatcaagaagaaggaaaaaaaaagggagagcaaagaagaagccaacctgcgtcgtggacgtggctccccttggcggagccccccgccgcgcccttctcgtcggcccccgacgccgccgccgccacccccgccggccggaagcatgccccacgtagcccccgcgccaccgccgcccagcacccgcacccgcgctcctccctccgccgggaaggcatctcttcttgcaggcccaaaatcggagctaaaaacaaacaaagaaccgcttcttgctgctgctagctaactagcctcgagtcctaccggcgctgaatccatcgagagctcgagatgaccggttcttgggcttcttcttctttgccccgtcgccgtccaaaccccaatagataagtgcgcccaaaaaagcgaaagcgaaagggaggagaagagaattaggagggacagcgctggtgcgtgcgtgcgtgcgtgggagtagacaagtaggcgaagcaagatcagaaagcgagtggagccgagctaggcagctagctactagcttagcttagctcgcgcgcggccgggtggatcagtgagtggcagtggggcgtcaccaccaccgcggccaccaccagtgcggctgccggtgtggatcgtcgtcgtcgccgccgtcatgatgacggcgtcggtggtggtggaaaggcggtagtagtagtagtagcttttctgcgcgcgcgcaggtgtggaggagtggtcgccgtcacccccagcgagttgtcgctgcctgcgcggattggagtggaggcgagccaaccaaccaaccaacgggcaaccgttgcggctgcagctgcggctgcgggatgggagaagagaatatgtgcggtgctgaggctgagctgctttttctcccggtggatcgccggattattattcgcttctccgcgaatcacagggttaccgtgaaaaccgtgtgattattatgagatatattgtgatttcaaaaacggataaggttaccgtatgtgataaccacgataagcgtgtgataaccgtacgattttgtaaaacctattggccggatagaagtgggagcctacacgacgatcggatccacgtcgctgtaaatgtggtaaaagaaaatatctttttttacggtgatcagatccacgtcgctataaatgtggtaaaagaaaaatgtctttttttttaaaaaaaaagatgttttcttttttgcttttcttgtaagagaatatggtaaaaatggtgtctttttcagataacaggaggttatatgctagtggttcaggcttcagactgttcggtgatgcgtattcttcgagagagcatttgcatattataaatacagtgttaatttgggggatcaattatggaattggatattagagattggtagtaaaagcgagttttctttaagactaaaaagatagattaagagaggcataagagagcatagtagtatattgctttcagtggttcagagtgttcagacctcacattgttcagagtctcttgtatttgcattgtgcagataaacacaatgctaaggaattggagattggagattggtagtaactaagtgtggtgaaataatcataaaaaatgttaaacttcacactgttcttgtatttgcatagtacaaatagatacagtgttaacctgctagtgatacagtattcaactatgcaaactggagattagagattggtagcaagtgtggtgaaagattcatcaatatgaaattgacaagatctgtgacagatgcaccttgtttttggaggagcttgtgctttaagccgaagcttcaggagtactagtagttaaaaggtggtccatttgctctaatcacagcaaccattgcacattgctgaacctgaacatcatcgaccccacgagcatcggcatcctgccatcctcttcagtccacatccttcgaatgggtagaaaaacggaacagcaaaaacagatgttctcacttctctctcccaccaaagtattcagatgtcactgtttatctgaagaaaagttgagatgacagatatatatgagattggaaggaaaagaaaagactaattcaaaaggaggggccaaaagggcggctttttatctgaacagacagagcagttctaaccaattgttagtatacttgttaactactgcaaagtgcaaagtgcgaagtggtaaacaattttggctacctttcctatagggtcccttcacatggttttcagttctttttagttgaagttatttgacagttaagctgacaattcccaacaacttctccagtggaaaatgcagttgcgtgtagaaattaaacaagctcaaactgtgtttagcatgtgctgaaaatgcagtcgtacttgtcttacctgctggatcatctgcattatatatgttggatctgaccagatttctctcttcttttcacaccaagaaacctgccagtccaaatatgtgctcactgcttaatctgaagcctaattaccatgtgcttgctgatgcattaactattaacacgattactgaatccatattcgagctgattacagttataaaaaaagattttcctagattcataaacttatagctgagacactgaacagatcaagagcagacgggttgatggagataaaaataaggtcaccggtgctccaagttgatcatcatcggcatggcgatgcaaaaaaaaaaaaaaaacccggctactaatggtgttcggagttgaaatctccgaaccccactcacgacgcattggagagaaaacggcggcggattctgcgacggcgccagcgtcgatgtgcccgggcgcaagcggcggcggcgccgcctccctctctcggcgctccttcttccccggcgtgtccgtcctgggcgacggcattggccggagcacggaggtcggcggccgatggagaaggcggcgacggtggcgtggccgcgttggtggtgggcccgcgagaagaattcggcccaattacctgccacgaggccgtcactgtgggtgggcctaatcttacggctccgcataaattatgggctttatatgtggcccagatttccaacgcggttaaagtgggtgggccagaagaagcaaccatactggatgggtgacttaatggaaaaagtccattttgactcccttaattattcatcgaatctaatttatgacccttaactggaaaactgggtaggacgattccccgaactattgaaaccagtgcaatttgactcctctaacggttttggagggcggttttgctgacgtggcgctgacatggcggtgttgacccggtctttatccaatatgacgcttatatggcattaaaattaaaaaaaatatatgtagaacccatctgtcattcacacacacaaaataattgtgagcccacatgtcatcctttattcctcctccctctctctcccttctctctcttctctcccccttttctcttccccaccggatcggcagcggcggcgtgcaggcgaccacctccagctccgcgccatctccatgtcatcgtcgtcgtctgtgtccccttccccccctttcgctacgccgcctctctcctctcccttctcggacggcggcggcgcttcggcagtacaggaccgcaggctcccgccgccggccgccgtggacgccgcctcatcgcctccgctcgccggcggacgaaacaaccccacgagcgtatcgtagctgacgcttcgtcttgacgccgtcgacgacgacgatggcgtcactcttcccgacgcccatctcgcgaacccgaaatcgcccaccttggcgcgcagcgacgacgtgagcagcacgttggaagaggcttgtcggccccctctctctcccggcggccatggacggcgagggggagcactgcgcggcacgtccccccggtggtggaggaggcgacggggtccggcgttgggagagggctcgagctcttgctgctgctgccaccatggtgattccgctgctgctgcgctgctgctcttgttggccatgtccactggctcaggtgaggccccaacccagacctgcatcctctgcgagaaaaaaaagaaaagcaaataaaactcgtgtttgttcagtttttcttgagtttcctgcccctttttattattaccaccatgtagttgcttgtaggaatctttgcctagagcaatggctcaatgttatcttgcgatttcttgcttagttgcatagcctctttccctttttgtttttgtgcacactagaaacatcaaagaggaaagattcacttcgaggctatgctagtgctagatttgaatcagattgagacatgcattcagttctgaacttttgagctactgatttgagctaacctgtgttcccatttggcagcggcgggcagatggggcgttctgcgtgttcaagcccgaccagagtccggcggcgatgcagaaggcaattgactacgcgtgttggcgcagcgccgactgcacccagatcatgcagtccggagcgtgctaccagcccagcaccatcggcggcgggggcgaaatcctccggcgcagacgcgagcagacggcgcacgacggggccgagcggacggcgcgcggtggggccgagatgttggcggcgatggcggggtggtcgacgaggaggacgacgactgaggaggcgggtccgggagccaacgctgtcgtcgtcgggcccagcagctgcaagcaacgccctcgtcatcgggccctcgccgccgcgcccttgccgccgaacgccgccgtcgctagcaccgagaagaagaaaggaggagagagatgttagagggagaggatgactaggctgccatatgtacgccacgtcagcgaaaaccacccttaaaataaccgagagagttattttagacgattttaataattcgagaaatcatcatatctggttttgtgatttagggatacgagtcagattggacgtatatttaagagagtcaaattagactttttcccttctttaattaacaattgagtttgacaatcgaaataaattaaatgcactgacatatgccctctccatatagtttttctttcaggccccttttttttcagggagttctttaacagttactgttaacaatctctaacaacttctccaatcgaaataaattaaattcacttacatgtagacatattaaacatgcccttcccaaagtgtgcatctcttgtgctgacactacagtcctattatacagtataggcacctagctgatcattagttttgatcacagaatacgaatttaacgcagagtggattaattagcctcagtttacgattagagtaaaggtttggtaggggagcaggtaatggattgattgcagggttgggatttgaccaggataaacctcacgcaaacggcagatgcttgcatcgatgaagtccatcgtcagatatatatcgttaagatcagacattagtccaaaatatagcagataatctgtctaaatggacgtgatgctgtttttatgaacagattaagctagccacaaaggaagatattaaggtcaactatgtatcacagcagttaagaagttgtgggagaggtgagaaaaatgttgcttctaaggaagaattaaatcttcacaattcgcaagttgataaacagatttttgctttgttgttttggataatatttgttatatgaatgcatgcttatccagcactataaataggtggctctgcatggttgcctacccgcacagaaccatagcagagcagtactacaagtagtcacacatacatagggcacataggatatacaaatcaaaatggtgggctaattattcctctcatttgcttcaatatatatttgttattttctgaaatgcatgcatggatgcatgttttaattgcattgttaagatttgcctctggacgtgtacactattttatataggatttttaattaatttttatctgtcattatcattgatgtgttcatttgcagagcacacaacttgttaagatcgggacatggggtggaaatggaggaggtcgtgtagacctatctgtactcccaaggagcttgaaaagtgtgacaatccgtagtggtgcagccattgatactaggggcaggagcgcgcaaagcgcgctgcacttgtggagttggaagttttttcatcgtttatatgtataggaatatagatagtgtagtgtatttcaaaaatctttccatcccataggattgaggcaatggagtttacttgtttcaataatttgtgctatttatcatgtaatccctccgtttcacaatgtaaatcattctagtattttccatattcatgttgatgttaatgaatctagatagatatatatgtctagattcattaacatcaatatgaatgtgggaaatgctagaatgacttacattgtgaaacgaaggaagtagtatattgtatggttcgatatagctgtagtagataaaaaatgtttgcgtataatggtgcatttgatatgaaggagacatgtttaggtagtacgcagccataactatattgggttccatataagtagtagctgtttgaacagcatttcacagcatagaaggtggcaaggtaaatataacattacttatttacaatgataatcatgacctaggggtcatgaacaaaaaggcttgcttcttagcctcctctgggcttgcagctaacttgttgcttctacacttctagcttgggtggttcgttctgtacatatacacaaaaggcttgctgatggactgcatatatccatatcattcactgcaggaatgaatgatgagtttagaaatttagtgaagtttactaaagaattgatgtgtatgtgtggagaggtgagctgagttattcagaattaacctgtcagtgggtttcttctgggtactatccttgaacaattttttttggcaattgtggtggtttctgcaggtctagctctgttcattataaggatatgtcaaatacaatgtgtgcaagaaatgtttattattgtaactttgaactgaaagttttacagacctttttttgggtgtgctctttggcgccagtgaaggatctgcctgtggagactcatctggagattcagtggtgacctttgccttgtagaagaagtattttttttcagaaattgatggattaggttatgaaaagaaagagcaggaataccttatccgaagtatcatggggaacaattgcaattaaagatgcactttgtgagatcttctcttcatgatgtgtgccaatttttgccttgcacagttagtcaataggtcagagtgtatctccagatatttaggaaaattaggttatagcagaggaagtgcaagagtaggcattgagaaggataccttactatcggtagaggtctttgcagtgtgagatggcatagagttagcttgagacaataatgcttttttttttggtaaatactaaggagcttgatttgctagttggtgtctcatctgttgcagcaggaggagtgtattttgttggtgttgaagtaccctgtgctggtatgatggctaattgtgattgggtgcttgttagtaaacaagttaatgttcatacctaaacatttaaaaaaaattcatactcatttaaattaggtatatactcaatttgaatcttggagcccgggctccatggtgccccagttaattttactatatatatatatatatatatatatatatatatatatatatatatatatatatatatacatacacacatatatatatatatacatatatatatatatatacatatatatatatatatatatatatatatatatatatatatatatatatatatacatatatatatatatatatatatatatatatatatatatatatatatatatatatatatatatatgtacacatatatgtatgtatacatatatatgtatacatatatatatagtaaatttgtttggtgctccatggtgcccgggcaccatgattgaaatttactatatacccaattcaaatgagtatgaaactttttcaaatatttaggtattaacgttaactactttactaactagttcaaagcaagtttgaactgaattcaaacttgcttttgttagattttgattctaggtatatagcatccaaacatataattagttaggtacgtaataatggattgtgaaataaagttaaatttgagttgttttgttgctaggtataggtatgaatcgaatacttataactaggtatatactcacaatttgaaaattttgaaaaatttaggcgaatttgtgtatttcataccatggtgcccgggcaccatggtgccccatatgagtgtcctatatatatatatatgtatacatatatatatatgtatacatatctatatatgtgtatatatgtgtatatatatgtgtatatatgtgtgtgtgtgtatatatatatgtatatatatgtatatatatgtatatatatgtatgtatgtatgtatgtatgtatgtatgtatgtatgtataagtggagagcgattctaacggaaatgtgaacggagcgttaaatatgagctatcttttgatgctattaaagtaaaccgtgaatgttcggtgctaaaatataaaaataggacggtgctaaaaaataaaaatgggaactttccatgctacgtaaccaattttgccgttatatggcttcagagatgaccacgtttgtagcatattgattgaaaacccgttcccatgcaatgtggcactcacattaattgtaatcttcatatttttctcccaaaggaattggctagcttgtactccagcatggattatgcatgtgttcacactgtgattgagattatacatgtagacatattaaacatgcccttcccaaagtgtgcatctcttgtgctgacactacagtcctattatacagtataggcacctagctgatcattagttttgatcacagaatacgaatttaacgcagagtggattaattagcctcagtttacgattagagtaaaggtttggtaggggagcaggtaatggattgattgcagggttgggatttgaccaggttaaacctcacgcaaacggcagatgcttgcatcgatgaagtccatcgtcagatatatatcgttaagatcagacattagtccaaaatatagcagataatctgtctaaatggacgtgatgccgtttttatgaacagattaagctagccacaaaggaagatattaaggtcaactatgtatcacaacagtaaaaaaggtttgtggaatgaggtgagaaaaatgttgcttctaaggaagaagctagtaaaccttcacaattcgcaagttgataaaacaaaattttgctttgttgttttggataagatttgttatgtctgcatgcttatatatccagcactataaataggaggcgctcactggttgcaaccatagcagtacaactagtcacagatacatagtaggacagaggctacaaattaaaatggttagctaattattaagtagcactcttataccttttttctttaatatttttttttattttctgaaatgctgcgtgttttaattgcatcgttaagatttgcctctgaacatgcacactattgcatatgtgtcataatcattgatgtgttttatttgcagaccacacaacttgttaagatcgggacatggggtggaaatggaggaggtcgtgtagacctatctgtactcccaaggagcttgaaaagcgtgacaatccgtagtggtgcagccattgatgctattgcctttacatacattggcacagatgggaaggaacatcttgcaggtccttggggtggtggcggtggaaatccaactacggtacatataatataataatatattatgtttttagtttcataaaaggctctgttttcaaccatgaatctggatttatagttaaaaataatctttcagggacgaaggtagcagttaatttgtaaaccctatagcgctactctttcagttatataatttttgacgttttgaacaacgatatggtctaaaaaaatgtttttaactataattttctgttatattatacataataaataaatatttacttttgtttatagtaatttttaggactagtttctatatatgttggttaagcgacttcaaattaaactaaatatttttaaatatttttaaagttattgataataaaagttataaaagttggattgaactttgttcaaaatattaagaattataaaactggagaaagtatatgtgtagatgcatgtcatatgtattgaccttaaacaacacgtagtgccagtagttagctagttagcacagttaaaattgaatattatgattgctgcccattaatattcttcctgaatataatgattgctgcccgttaatacatgttcctttctctcttttttttttcttatatatatgacattgcttagtgttaaaactaataagcatcatatataaagaaaataagggagtgttattcaagttcattcactggtggaaatcaattaatgatgatatttccgcacgtccttgcatacagattacacttggatctcaggaattcgtgaagggaatctccggaacttttaccaacgtcgtgacaaaccttaaaattgtcaccaatgtcaccacttataattttggacaaggtggtggaactgcttttagcctcccgctgcagagcggcagtgtggttggtttcttcggacgcgcgggagcacttgtggactctatcggagtttatgtccacatatgatatatattatctacatatgaatatatccttggatatatggttggatcagtgctcatgataaattcacccctaggtctattcgtttaatccctcaacaagaagttaagtgagatttgtaggagaataatttcacatttattgaggtgtggaattaatcccctcaattctctctaatctctctcttgggaatgaaccgaacaagacctaagggtgatatttctttcaatcactatataactatacatatatagtgtgcatgtgtatgtgcttggactaggtccaagggtttaccacactagtgccccgttatacctctgtcagtgtcgtatacatttatttgtgttgtattacattcgctatatacgtacgtggtttatatatgattatatatgaataaaagacttctgtgatgtattgtgcttaaatgtgcgcaagcctatttttaatgtacctaaattttgagaagctgagttgctagtacaataagttgcttcgacgtacaggaaacactatggttggatcttattgtgggtgaacccttgtgtcaaatccacggatatcatcaacaacataagggaaaaccacacacacaaagccacaaatgcggtaaaatatgtgtaaaagaagatttctttgtagagacatcactgaaaggggggaaatgcttttgattgaccatccgatgcgagagaatccctcggacaacggacgctcgtagaccccacccatcttgcccgcttctcccctctcgctcatttctctctactctatcctcgtcaccgtcatctaggacgtttcccccattgttctcctctctacccgctccctctcctctcctaacttcttctcctccttaatcttcacgggatctcctctgggcagatctagccacccacaactttagagcattggatctgcgggagggctgccatggagactagagaggggaagggatattgggagattgctttaggttggggattcctgcagtcaccgtctccatctcagtgttgctcaccactgtttgaggaggtggagaggttggagccggcactgatgaaagtgaggctggtgaagagctagtgaagatgttgcaaaccatgtcttattatatgttgcagacaatgaattttggatgttgcaatttctctattttgaatgttgcaccatctcctccgggtcatgctgcgcccatgggtgctgcatgaccttcctcagccggccaaatttgtcagcgacatctctcatcgacgggcggttattgccgatcatctccaggcaccggcttgcaaggttggcaacctcctcgagcaccccagcattctcatcagtttgaatgtgatgacctataatgtccatgagtcttccctcctccatggcacacaagaagctcaaggaaaggctcctctcattttcaggcccttcaaggttgaaggccatcttaccagtaagtagctctagtaggacaatgtcaaagctatattttttggggcaattgcaaatttaccactactttgaatcgttattgcaaaactgccactagaaaattgcaaaaataccactagaactgtcattcgaatggcatccttgcaatattgaaaaaaccggtagcaaatttgcaaatgccccatatttttttagataatggattttcattaatccggcctctatatccatgaaggatatacatagctaaaacatacatgggttcttagactctaaaccccctatagaggaaaacataaaacacaagaaagaaaagctactagaagacttagcttcaaacttcaaacatgacatactctttttgttatagcacaagaggaaagggagaactggaactagaccccatagcccgtcgctacatgtcgacccccgattttggaaatcggaaatcttctgtgtttatctgtaccaatccctggatcagtagttggtacacacatacatagttggatcacaacatatcacgaatgaatttaggctaaaagagttaaacacttacattagggccaggtaggccaacaactatcagagaacaacagcggaagacaaaataatataagggcccggttaacatgccacaggcagtcgactggggaacgagacctagaacaagaccgcactccaatcatcttgtgggatacgcaagcgtaccgacaagggcttctcttcaacactctcctaaaagatatataaatagcaagggtgagtaccaaccgtactcagcaagccaccacaacaacaatgcgtatgatagaaggtatttcaaggaaaggcttcaggttcttttgcataaagctaatttttcaattcttttcataagcctaagacctagcatagactgatcaaattttagtaccagtgttcactttaaacaacgacggttctgtccaccatccattgtgatcccaaggatagcttcccgccattgaatcgtcatggttttctgaggatgtccaccttccctcctctcgggatgtggctccatcagcataaaattcatcatgcaatatcccatcccccacaagttaagaatttggagtctagccaagtgcaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggtgacaccgatgtagggcacgcctctcggccctacctcaacggctgtcccattgtagcgcacctgcctcactcaggggtgaaccatctatgcagggatactgcctccgctcggctatctaatccgctaggtctatacccattcgagaagtacggttgtacgggggtcgtttcacgcttaactccatggctcggtccttaattgaccgggaacggtactagccttttccagataccacccaaatcctccgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcagttgtcataattgactagggactcatacgtaaacatggttacgaaggaataaggggtaaacaataatcaaggcatggcataatcacaagtaggatgttcatcattgcatgcaattttatttgtaaacaaaacaatttcgcaattgggatcaacatgttcaaggaatagtgatgacttgccttgctcaggatagtccttattcttgatataattcttgatcaaccttcacctcctggaagctgcatacgttgcctcacgactaaccgatatacaaattctataatacgcgagaaaaaccaatattcaaataacaatcaaatatgtacaaacaaaatatatttgttgaggtcgaacctaaggttgctcatattattcgcgtttgctaatggattccaacatgctaagggctacttaatctttctgttgtcttggtggtctattcaggagctaatcaatgtagtataaatgagatacgtatctggctaatatgtggtgtagtctagctaatggctatggaaggattatggctacacatgcatctacctaaataaaatggtcgtatactagaggttctgttgtcggatggatttaggatcaatcaaataatgaatcatttgtattattatttaattgatggaggctttactttaattatgaacatatttcacttgtcgcaataaattacaaaaggttaataatcatccatgctttctatgttagagttgtttaggttaatcatattatggttacagattatcccatcacataattttacaatgaataatcctaatttacagttgaactataattataattatatggggtcaagatttataactagtatttatccaatatacatttttgtcatacactccctcttaatttaatatatgcaacacgcaaattaatactataccgtactactataatgggatgtatagtatatgcgtaagcaacaatatcttattattggatcatatatttgagtagttgatttttactgtaagctatacaatacatgttgattttaagatggctctgtttggttaactaatggatatcaatcgattatatacatatgttctacttcacatgacattgtatcgacaaatttttaagtggtccaaatacaactagctctgtgattactctcctaaacaagttaaagattcatctatgtgtgtttatattttagttacaaaatatgaggctaaactttatgtaaacaatttataagtcatggatttagttatatttggacatagactagtaaatggcactaatattttcctatacacccataaattggaaggattgattataactaatttatttagttgctacagtgacaagacatgttaaagataattatgccactgtacaatatccattttcgatttatacatcctaaactattttgcgggtataaatattttgttagtataagtttttaatttaatctacccgagcattatatctataatctataggaattcatccaattatattttcattaatcctatatttaaatgctagtattttaggtatttaattagtaagatttcatctaattatattttcattaatcctataattaaattctaatatttgtaaatattttaaatttccccctaaatttttcccttttcttttccctctctctctcttttcttttcttctcttttcttttctttcctttttcctctcctttcttttcttttcctcttttcttttcttttctttcttttctccccttcctctctctttcttttttctctcttcctctctttctttttccctttcttctctttctttcctccctcccggcttctttctcccttcctctctctctctctctcggctcaggctacccggggcggcgacggcggcggaacgagggaaggggcggcggcttaccgacgacggcggcggcgacggcggcgcaaggcgaggcgacgctcggcacggcacacggcgcggtgtggcggcttcgagggcggcagcgaggcggcacgagggcggcggcgcagtggcacgagagcggcggcgcggtggagagggaagaggggaggaggagggaaatggagtgggggaaagtggagagggggtggggtatttatagggaagagggggagaaggagaggggaaagggcggcggcttaatggcgacgcgacagcggcgcacggggctcgggacgacggcgacgcgcgggcggcgacgcgatggcggcgcggggctcggagcggcgatgcgacgggcggcggtgcggggctcgagacgggcgatgtgacgggtggcgtggggctcgacgcggcgatggtgacggcgcgcggcgatgggacggcgacgcggcgggtggcaagcgagcgtcctgacagacgaggcgacgcgacgcgcgcggcggcacggggctcggcgcgatggaacgggcggcgcggcagtggcgcagggcgacggcgaggggacgggcgcgcggcggctcaaggcgcgaggccgacggcgacgcgacggtgacggcgcggcagcggcggcggcgcgcgcgacgagcgggcgatgacggggcggcagcggtggcgcgcggcacgaggcgggacgcgacggtgacggcgacagcgcggcagcggcggcacggggcgcaaggcgacgcgacgggcggcagcggcgacgcgacagcgggcggcgcggcgcggggtgcgatgacgcgacaacaacggcgacgacgacgcggcagcaacggcgatggcgcgcggtggtacgaggcgcgaggcgcgacggcgacggccgagcggcgcgcggcgcggcaggcgccagcggcacggcggcagcagggacgggacgcgatggcgacggcacgcggcgcggcatcgtcgacgagacggcgcgcggcgcggcacgatggcgacgggtgagggtgatggaatggcgatggcacgacgagacggcgatggcggctcggggctcaaggccggctagggcggcgcagcagtggggaggaagagggcggatggctaggaaccaaatcgaacacctagggggctaatgaacagtgccgttttctaattagtccgattttagtgtattttccatataaatttgattccacaattcctaattttgcatatatgcattttactcaatatttgtgttatcttaactaatgaattcaccctagattaatattactcatattttatttttatatatatttttctattatattatttaaatgaggtctaattctaaaattaacctagaaaaattttggaggctttgagggttccaaaattaattaaaatatcctaatgtggccattactattacaatagcacattgaatgaacttatttgtataataatgtattttacgtggatctagtaattcgataaatataaattgagactcggtacaatattaatctaattgtctaattaaacactcacatattcttatttatatataaagcttaatttatttatatgaccattattttatatgagtgattttcatgtcacgaggaattcggtgaaatgttgtaagtatcaatctatatattccggtgaattacttatttataaacacgatcattatagtggtgatcatcatttcatgtgttcctatatttcatgtgggattggattcaaatgaattggatttgattttactgtttcttttagctaatcatggcatcaagctatcaacatggtccgaatatttaatatttgaactataaattaaattagtaattaaccttccctttgtttgggtttgctttctttgtaattatttacggtttggcaagcaatagcaatcataacaaccagcatgatgcaaaagttttaaaaagttcaaaattttagtgatttttttttattgttgggaattttcagggatgttacactacaccatctccgcctccgcatatcacaaccaacatctgctgccatttgtcgtgccttctatccgttgtcgtcatccaaatccccttacgccaccgccgcattccgaacgcccctagtgcgccgtgaagctgcaatgccacttcgcattttactgccatgagctcgtcgaagatgttccaccgccgaccacacctatccgcagtcagatcttggtgccgacgtcacttgctagccgtcaccactagggcatcgctgctaatagcttccgcagccgttgtcttcaaagttgacgacaccatcaaccatctatgtcaccgacgaccaccgttctactatctggcttggctacagtcagatctggtgctggagctcgcctagttgccgccacaactaggacgttgccaacgagagcctccaccaccgccaacttcatctgccgtcatcgaaccaatcatccaccacggtcacgggatgaactggctcgccgtcacgggggagggctagccaccatcgctgtccgttgccagccctcgccatcagagacacggtaccatcgctgcccttcgccaccaccaactccattgtctccgccaacctcgtgtagctccgattcaacagccactagtgccaccaagtgccaccaccatcgagagatctccacattgccgccgccgggaagcttcagttccagcagccactcacgttaccacggagaaaattgcatatctaccatcgcataagtttggattcgctggaatatcatcactaaaaagtgtttcgctagaatacccctcttaactaggtgtgtttgtcaaaataccatcacagaggaaaatgccccgcttcttcatcttccaccttcgacacggcagcggcaggtgagacgaggacgcgccagctcgcgtcgtctcggccgcgcgccgtcgcgccgccgccccgccactcgaccggcctccgtcgcgttgccgccccgtcccgactcgccggccgccgtcgcccgcgtcgtctcggccggcctccgtcgcgccgccgccccgtcccgactcgccgcccgtgtcgtgtcggtcggtcgccgccgcgtgcgtcgtctcggcctgtcgctgcctcgctggcgtcgcctcggctggccaccgtcgacgtgccgcccccaccgtcggcgagttcgtccgcccgcctcgacgcgccgcccttgtcgccggtgagttcgtctccgtcgacccactccccggttgactccccggctctgtcgacgtcagctgcggtctcctcacaccagcgcggtgggcaggatggaaggcgaggacgatggggagggccgtgccagcatcaccgccggcaaggtggcaccaatggcacggcggtggatgccggtgagctcttctggttggagtgaggaagaagaagaatcagggctattttttgttggaaatatggtcatatatcggcatattttaatccaaaattttaagacaataatcatggcatgaacaatgtggggtgatcaagtgacaacatttagcataaccagaagtatgcttacagtatcataagcatcatgaacataccaagaacgcaatgcgactaacagaacaaacagaggtatgaacgacagtaggagagagacataccccgagaatggccctccgctggattgtgaggcagaactgcctccgtcgatgttgacgttcgcaacggctccggctcccggagcgccatctccagagacggcggcagcggcggctccggctccaggcacgccatcggttccaggtgcagacatggtggacgacgagacaacgatgaacagagcagtcgtgcgggaagcatgtaacgccccgattttcgtttgagattaaaaatcaattaataatgcatttcaagaaattatattaaaagttaaatcaatttaatcaagtgaaattatagaggaaattaaaaatttcctttaaaaattattggccgggaatattttgtaatattctttgtgccctaatgtactctccggaattttccgtgaattttcggagctcgagaaatagttttaatagcacaaagttcatttaatcaattaaaataaaaagaaaacaaataaaatcctcctttctctctttgggccgccccggcccaattccctttccctcccgcggcccgttccctctctctccctctcccggccggcctccctcccctctcttgggccgtcggcccgtttcccctctccctcgcgaagtctgttttacgtcccccttccaactctccctccctctctctccgacaggtgggatccgtggaccccacatgtcatctcctacctccag

SEQ ID NO: 44358 - DNA, 4340 bp, Oryza sativa
ccatccccaactgccgccatggccgcccgagccgccccacgacgccgccgtttccgcccacctcctccaccccgcgcgcgcgcgcttgtccgtgggacctcgccgcccacgtctgcgccctttcccccactctccccgcgaaaatcggcgccggttaacccctccaccaccccacgtcggcgccccacttcgccggccgattccgccacgtccggtcccgatcccgccttcccgagcccataaaaagcacccccgtgctcccctcgtccatttccccttgtttcccgagcccggcactctctccctcgctctccctacgccgctcccgcgcgccgccacacttcggcgaactccggccgccgtttcccgtcgctagggtcgccgccgcaccgctccgccgccaccgccagctttgccgccggacaggcaagctcggccaccgctccatttcccctctccacctccgtagcgccgtagccacgcgaaccacctctctccgtcgccgccaccgactccagccgcgtcgcgccgccgcttcggtcgacgccgacccgcaccgttgcctccctcagctccgctgggacgaggaggacctcggccgccgcccctcttcgccggaaatccgccggagctcctccttcctcggtcgtcggtgagatccttctcacattgtcgcggtcggccgtcgttaccggtcaccccgcatcggtcctcccctccctaactccctcttctccttctgaaggtcaagggcgaccccatccgccctccgtcctcgcaagccgccatcgggcaatcgtcgtcgccgtcatcttcctccgcgccggccgccgcttccggtgaggacctcttctcccttcctttttttcccgttcccctttcttgccgacctccgcctcttggggtgcgtcgccgtcccagtgcgcgccgctgtcctacggccgcccgccgccgttccacgtcgccggctgctgccgccggtggccgcatgccgccgccgcgccatggctcggccgagccggtttcatgccgtgcccgtgccccagccgcgccgcctcgtggccgtccgatcggctttgggccgatccgggccgtcggttcccgtggaccggcggtggaccgcctcggtggtcccggtccacggtggaccggcgcccttgtgccgctgaccggtggggcccgcttgccggcgccgcccctcccctttgatgacgtcagcaaccgtcttttcctttgtaaaaataaataataattgcgcaataaatcgagtttaattctagaaattcatataaatggctcaaaacttctaaaattcatatctaattcattcgaactccgaattgagccattcaacttgcaaaatgcatctaaaattgagctctacatgtttgtttactttttatgtactgtttccttggtttttattagagtttttcctcgttttgcgtgccagcgtgtagtttccgtcgtttcggaagtccgcggtcgcgaggaaaagagttcggaagatcaaagtgaagaagcgaggcaagtcacacattccccttgagcatgttgatcccaatttacaaatgttttactatttgcaaataaatatgcatattttgctaattacatggggtcagggtattacctatctgctcgcttgtgccatgtttacttgatatctgttctttgtcaactttgggtaatgaatcgactagctcatgttacttatgtgacctagctagaactatatgcttagccatgcttaattaccactagctcagttgatgggataattgcagtattagacctttttagtatcagagtgagctacgtgctcgagacatctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggttagagggggttatgcgaagggtcctgtcacggcctctttccggtatgtcgtggtggcatgtcggcgcacggaaacgtgttgtggggctgtgtcttgtgggtacagttgtacacctctgatcagagtaaaactattcgaatagccgtgcccgcggttatgggcggtcgaccagattcaccgtgattagtctcacacttaataaatcaacccaatacactgtagtttaggtgggttggttgggcctgttcaacgtggtgtagcgttgatcagtggagatttaatgttactttaattactcaacagttttactattttgctcaataaaatgttttacaaccgcctttatgcaaatagccacaaaccatccttgtatccctttgcacgtctgcgtcgttggtgtggcttgctgagtacggtggttgtactcagccttgcttttattctcccttttcagaagtgtagtgcttctgagctgaagatggagttagaggaccaaggctcacaccccagttgagttttgcctgtggagtggagctgaagccccgctaggatcgcctttttccgctgctgtcgttctgtttcggtgtgaggactaagtgcctcttccgtaagtattttacgctttatttacgtttggaactgtatattacttgtcgttttgtgtaccctggctggtcctggacagggatttactacgcaaaatagtctggaaatttgggttaaatttctgggcgtgacaaagcactccccaaaaacctgatcacccgcctacccggtgcagatctcaggcgaaggtgtggttccggaggccctgctccttccgatctctcgtgcgcgcaagcgatcagaagcgaggaagcgaaacagaggcagcacaggcgcgcggaggaggaagaacaccagcgagagaaagcaagcgaatcgttctgatcggactagcgggcgaaattgtggttccggaggccctgctccttccgatccgatctctcgtgcgcgcaagcgatcagaagcgaggaagcgaaacagaggcagcacaggcgagcggaggaggaagaacaccagtgagagaaagcaagcgaatcgttttgatcggactagcggcctccttatatagcaggagagatatccgccagttgccgcacgcgcgtcgtgggatcgtggtatcgtgcgatcgtgcacgcgccgttacggaggcagtcggaaggtgtggttccggaggccctgctccttccgatccgatctctcgtgcgcgcaagcgatcagaagcgaggaagcgaaacagaggcagcacaggcacacggaggaggaagaacaccagcgagagaaagcaagcgaatcgttttgatcggactagcggcctccttatatagcaggagagatatcccccagttgccgcacgcgcgtcgtgggatcgtggtatcgtgcgatcgtgcacgcaccgtaacggaggcagtcgtgggaatgtgggatcgtggtagcaaaaggatagagactgacgtgacgcccgccatgccccagctcggctcggcgcgcgcgtgtggctttccgattcccacctcaaccggtcaacagggagcctccgataactccctatttaagttgaggtacttctcgcttaattcctgaggtggtattattatccttaacacttattatgggcctttgagatttaatagaataaatcgggcctagcccaattgttctaacatttttgtctaagatggtattttagcaaagatgtcctggttgaggatggtattctagcgaagcctgatcaagggatggtatttcagcgaatccaaacttatgcgatggtagatatgcaattttctcgttaccacggagtcttgtcgctgcagctaaccctccatctgcaccgccgagctccaaccagcctcctcgccggccgctccccaactacctggctagccacctccgctccgtatgcgccggcgagctccaccctgccttctcgatgacggttccactccgaccagatggcgaaacgaggccaggaggcgccatccaagcgaggaaacgccggatctagccgtgccgcctcgccgatggccaccttcatgtgcccactgctcctcgtcgaccgccgccttgatgcaccacgccgctcctcgctggccatcatggacctcccagcgcctcaccagactccac

SEQ ID NO: 44359 - DNA, 1267 bp, Oryza sativa
aaggcatataaaacactggcatttcaattcagtcaaactttttgttggtgcaccacatattttggaaataaaaggcctcagatttacgctcatcaactcttgtatatactgtggagttcacctcatgattgaattaaacacaatttttggggcccctaattttttttttttgcctgcgcagctcgcacgtgcccaagacaggccagattttaacattcacaaattacctgcctttatattggtgctagttgcatggtaggtagcacaaaattatcggcctgttttatagttattgagaccggaccgacaattgaactggtgagtctcttggttcaatggttaactggtttaatcggttggatcataggtctaaagctctaaagcagttcattaaccaattaaatatattacttatttcttcagaagcatagcatcccatgtggttctgggttcaaatctcacttgagcttgttttgtagccggttctaataaaaaccggacagctcaaattgagaatgtttggttggcagtcaatgttttacatgccaaaccttaaggtgtgtcacaactcgccttttgttgagcttaatcaagccacactttattagcatatttgtcccatatatcatactccattttgaccatactctgtgtagctttgtcacatttatgacaaattagtctccaaccaaataaataggcacttatgatatcattttttttatgtactgtgcatccagagactatatagggatagagtaaaatgattatgaggccactctccacgaattatgagccacaacaagtttagaatttattttaaaattatttagaattttatactaaaattattttcatcaattcagtcgcttgtgtacagcttataagttaacatatcaattatagattcctatccgaacatacgtttttcaaagcaaccgtatacatatcttgctcccaaaagctggggttatctaaaatatactgtaaaatttgactaaaattccccaagtttcatgaaaaatattttgttttaaactgaaggatgttttactccatatgaaatgtgtcagcctgtcaggttaaacgaaacccccccaggcctcctctccaacccgatgacaaaagagaaaattgacatttagccatcgtcaggatggggtttcgccagaatgccactccggattgtggcttcgttataatgccattttcgaacgacgccacattgctactttgccatttcgaccaaattagctgatttgcaaat

SEQ ID NO: 44360 - DNA, 1701 bp, Oryza sativa
cggtctccatgggtgatgcattcccggccctgggatcctacccgcaaaagagctgctgtcccgcggtgggtaattggtttattctggttatcgagtacaaattcgattagctggtggtaatgatttgtttgtttctttccatgatgcagaggccccgctcgatttcgttcttgcccctgccagaaggaaaagcactgggaggggaataagtgcacatcaatggggattttctctggctggaaagcaagcaaggtatggaatccaacatcgatgcttgcacaacatgtcttttttgctttgctgatgtctcaagaaacggatcaaatttttttccatgtcagatagcagaaggcactcacatagcttgctaccttctgcagcactataaatacgttgttgctatcttccacaccactacacacaaatagcttacagcccttgtctgcgaacaagaaaaatggccgttgtcctagatgcttttgcgtcctacgtcagcgacctgctcttgcaggtggccaaagatgaggtgggcatgctacttggtgtctccgacgagatcaccaagctagatgaaaagcttcaatttctcaaggactaccttgctgatgctgaaaagaagcgcatcaccgacaagcatgttgacgggtgggtgaggaagctgaagggcatcatgtatgacgccactgacatcctaaagctctgccagcttaaggccatggagcagggttcttcagttgacttgggctggtgcaaccccttgctgttctgcctacggaatccattgttcgcgcatgacattggcagccgtatcaagaagctcaaccagagccttgatagcatatgcaagacaggtgccgagtttagcttcatgaagctggaagcctatcaagatcgaaggactgcctctccgctcatcagtcgtacaacatcaccggtgttggagcggtcacgtgtggttggtgatcagatcgaagaggatacatcagcattggtgaagttgctaactgatgacaaggagaccattcatgcggagaacaatagcctgttgttagccatagtgggtgttggtggcattggcaagactactcttgccaagaacatcttcaatgatgatgccatccaagagaagtttgacaagaagatatggttgagtgtcacgcagaagttcaatgaacctgatctcctgaggagtgccatcattgccaccgggggtgatcaccgcagctcacatgacagatctgtgcttgagctaagccttctgaatgccatcaaggggaagaatttcattttggtgctggatgacatgtggactgaaagagcatggaatgacttcctccagataccattcagtcatggtggtcgaggtagccgagtcattgttaccacaagagatgagagaattgccaggggggtgaaagccaagtaccttcaccatgtcaacaaactaggatctgacgatgcttggtccctgctcaagaaacaggttcctctttttccatctttcatttgaagaactgttctttctttggttatttacccgtctctgtcctatctgtcttgttaaaatttgctgatacaaaataaagttacctttgtagggtaaaatggactactggaagatattatttctagaaatacacatggcaagtactatcggcgctagataactatgacacaaaccgtgttaatgttgacatgtag

SEQ ID NO: 44361 - DNA, 1498 bp, Oryza sativa
agtatatcccccaacgagatcggaatcatcgccatcaactagtcgatccggccagatcgatcaaattccaagatatcgtcgccgcggagtcaacccaatattaagttgctgatcaagccctccgcctgcgacatcagctagtacggctggtgtacaagcgtcagggattcatctgtacctgtgccccttgtgttgccgtgttctgctcggagttggtcaactggagtgtgcttgcttaatcatgtctcgtgcacaattatgggcacacacggccatactactacaggtcagcacgctcccagtcatatgtggactcacgtcctaatccactaaatgcatgggacttctaccagagatgttcggcataaaaaacaaagtaattagtagattaatttaaaaaattgatctactaattttgtagatatatacagcatatatctacacaggtacgcaataatctatatacaatttaccgtacctattttttctaatctatacaatattggcagatcattaatttattatgtttagctagagcgtgtttttatacaatatctattgtgcgagtgcttccgatgttaggccaactacggtctaacgctgggggctcgctctgttctcttctgtatgaatcattcttgtttacggtctacataatgcctgatatttacatctgctcgttatatcctgataataatagaagattcattcagttttttgagtacatactcgatattctctgctatatatctcgcattctagaaaatatttttcaggaacaattgagcactcgagtaggttgtggtcgagcacaccccattatcgagaacgatctcgacaaatgcagagtcgtcgcccccgacctaccaatgacctatctcatagcaccggccatggctggactattcgagaaaaggtggttaacggatacttcctcgcgaatgttgtcggcttgatcacccgacatgattgtgaacgaacatccggatatgctataaggtgggtatgtgagtcatgctggccacatgagatgcacatgtaataacccaactctagctcttccattggtgttcgagagataattctactcgctcgctggttcccgaaccagtacgtagcaatctctcgcaccgcaacctccattggtgttcgagagataattctactcgctcgctggttcccgaaccagtacgtagcaatctctcgcaccgcagcttccattggtgttcgagagataattctactcgctcgctggttcccaaaccagtatgtagcaatctctcgcaatcgcaccttccattggtgttcgagagataattctactcgctcgctggttctcgaactagtaaaaagtagcaatctctcgcaccttaacttcagatggtcgaggtacgactacagcaatagcgtagcggtcctcgcaccatgacttcggatggttgaggaacaactacgactggtcttcgaccggcagcgtagcggccctcacaccatgact

SEQ ID NO: 44362 - DNA, 3642 bp, Oryza sativa
gttctcgaccaacggtgtagcgattctcccactatttccacttcaagtggtcgagttacgactactacctggtcctcgaccagaggtgtagcgattctcccactacctctacctcaacaaagttgatatcagtacacaataatgccaagtgttttacccagagatcccttaccacgacgacacctagcgttgaaacctatgctattgtccctttacgccgtcttgacaaggcctccgaggaacctaagggatcttcggctgggaacgcccagagccgataaggccttgtcagatcctgtagagacaaaagaccatgtaagatctggtcgtgtaagagttctcgccgtgcgtattaaccaagccgtgtaatcggaaattgagttttccaacttcacggctcggggctaggatcagtgcttgttcaaccaaggcaggtcaagggtccaagagccttatcctccgagaacgattctccaacgagaaggctgggggctagggagagtgtatgactctacaaactgactgatcgaagtcggtaagagagaagacgctcatacacaaaacattggtcggtaaatttgattcatttttagttttccatgcatattataacatgtcaccctttgagcattcactcgggggctatttctatttgatattcttttctgagtattgatttcaggaaaattctattcggcattgttgaagtctccatgtctctatggttctataccaagatcgactaaggcgagtacgaccaatgttgataaggctccgtcgcagactctgcgccttctcgatcactcgagaacagttggtggatctcgacaaggaatacagactgaagagatggtgtacccgccgagataaaatttcttgacttcaatccaaattctcgattacagcaagacgggagacttagttgtatgctctgtactttcttggttgacgtcggagattgactcagacaaaccctttaggtacccgcacgaggctgataaagcaagtctaacgttatctctgaactcaccgagaacggtcacttgagctcgataacagttactccatggttagcggccgagaatatgaattcgttcatttgcattgaagtcggggctactgtcagggttatggatactacatacctactagtagtcgactacatctcggcaggacccaccacgtaccatgtcttatacggaaactgacttcggatatggagggagttccagataaggaaagacaaccagagttctacatggaaacgataagtactcggattgtatccatattggtttccctagttctatttagacaaggggacacctatgggtataaatacaagaccccctaggaggagaggggacacgaccacctcaatcaacacccaccacaatctacggaacaacagaagccaaaacatacaagcctacatacggcaagacaaaacgccggatatcgacttcagggataagcacggctagtcccctatggtgtctccggatactatcaggagagacgaaagcgttatctctgatctcgctgggcatggattcgaggaggaagactaccctattgtcgactacgagtcagaccttcagaccgtcatgtcgacaacagttagataggttacctcacatattgtactggtgtaattatggtgaataagagcaatatcggcttcggctaacaggatgtagggttattacctgacaattcaggggcccgaacctgtataaaaatcctcgtctccgtctcttttacctcagtctcgcgtatatcctagtaccaacgatccccatacaatacaaataccggaatcgcgacatcaaacgtcgacacttcctacaaacgctctcaagccgccatgtataactcctataaatgcttctaagtcgccacatagcgttttaataaatttaaggaatatctaataattcttaaaaaggaaaaccatagagtggacccactttaaatccgtattgtgtatcaccagtgcacgttgtgtgcacgtatgtatgccaagtatatcctttccttactcctcttcatgctatattatgtagaaaatacataatacatcattagatcattagattatttaccacaaaatttatagttcaagacccaaactaactatatttagtaaaagaaataaaacacatttatacggaaaatcatatagatattttaacaatctatttaacaacacatatattttaatagaacaatatgcaataataaacaattttaattagaaaatagatatttaataagtacataactttgggttgggtcattattatgtttgtaaatatagataactcaaggtggtgaaaccattgaatctatctcaaaggaagcaaaactcctcttcttctaatgtcagacgtacatgtgcacgtctcctggaagcaagatcacgatatatacatatatctaatctatctttattgatccatatataaatatatgtataacaaattatgttaatatgacccaattaaaaggagggctagcttaatggtccattattaacaataatattttttaagatttgttaaaaaaaagtcccaaaacattcaatttaaaaagaaaaagcatcgtatttttaatttgaacttttagacatattttctaaataaactaagtctacctcctttttaaatgatgaagaagaaaataataattacttatagagatgaattaaatattacgtagtatgaagataacaaatacctaataaaaattatttaagcaaagctagcaaataaatttatgaagaaaacgtacttctaaagcttggcaagtgttatatggttgattttcaatccttaagtttttcaaatacatgcttatgatatacatgcccgcgtgaatacgcgggctaccatccttgtttttctaaaaagaaaaaaaagaaagagtccttatctgctttgaattctcatattttttattttactagaaaaaaatacacgtgcgttgcagcgggtgaaagctattttaattttattgttcttatacggtctagttaaggtgaaactcgctgtagaagttcacttagatatatattttattagaaattcataagctgcaattaaaagtccgatcgttttaagttagcatgagagtttttttaaagagaattcttatacgactctttctatattttcaaaaacgaacgaacttaaacccgacttaaaaacaatatgtattttcaaaagtgatcaaacttaattttgtatttccaaaatcgactcatacatggatgacttaccaaagtgccggcaaaaatatttttaatttttataatagtagatactttaagtaatgtgagaatttctaaactttaataagttaatagattggcaacgatgttatcgtgtctgcctataggaggaggtgaacagcggcgaatgctcattttctattcatcctccgccactatcggcgatgctatcgttctgtatgccacgccaagctatcgtggtatggcggtgacggtggacagacgacgatgacaccagcggatggacggacggcgcgtcttaagcagacaaacggaatggcagtttggcaccgaactacagtaagaaattcgcatgccggtgtaattgggaaaggcgcgcaaattactag

SEQ ID NO: 44363 - DNA, 8215 bp, Oryza sativa
  unsure (1)..(8215): unsure at all n locations
caaacccatggatggctagcacaccgcggttcttgtgactttggcttttcatccacgcctcgagtttctcgatggcgcgcgccacgccgatgggctcctttacggttatgagccggcgcccggccacctggttctctcccgtggtctggtcaccattgcgggtctcgccgcgctgagggggaatcgggttgaggacgacgccgtatcgcaagcgccgctcgcccacttgctgagcacggttcttgagctcggcgagcttggcggcgatgtcacagcgaggcctgcaggtgtagatctcgtacagcgccctgtacacctcgacgaggcatccgtccccgcggggatcgtgacggagacggtgggcgaagtcgtcgacgcagtcctccatgtcgtaggcgatgtcgcggacctgcttcatccagtccttggtctgcgcgtcgtggccgtcgtcgttgccagagctgctgagattggtgaggaaggcgtggatgctggccatctcgtcgctgatgtactggatgtcgccgcggacacccctgatgagcgcgtactcctgggcgaggaggtttcccaacttgcccaggagggccttcatggtggcctccgaagcgcctaccaccaactccatcgtctagctcgaacctcttgatttctctgtgcctgatctttcaccttcttggcaaatctctcgtattttgtttgggaatgtgctgaatgaggtatggagtttattcctagagaggtctaccagctgttcggaagtaaacaaacatgaaacatgatagtctctcaacaaactacatacgggatcggaggagcatcaatagagagcgtggtcttaacgcgttacaccttagtgtcctctctccctttaactttcccccatattccacacccatgtgggcataaaagaccaacccggaagatgtgacttttgtccagcttggttcagatcacataaaaagaccatctataagacgtactattaaataccgcccctagcgcccccttcccttttctcattttttcatcatttccacgaatcctagcacaggaggtatttgttcatgtggcatactgctccggtctccgttcaccagcaagttggattttatcgtcttgttcttggcaatggtacggtacggtatggatcagtttcatcagcagcaggcagccaggcacttgctctctcgccggcaagccacttttgcatcttctcttgcgccacggattacatgcaccttctcctgctcaaattggaatttagagtttgctcagatcctttgacaaattatagttgagtttgatcagatcctcagaggacaaagtgtattaacggaaattttcagttgatgatgctttttttcagcacctcgatggtgttcattttgtagctttggctgcccgggatccgctccgggtggatagctaatatagctccagcatcctgagggagaggcggtagtagtactcgttcgtcgccggcggcggctatgtcgtggtcggaattaagatcgatgcagatgaaccagcaaaagttggacagcgttttggttcgtatagtacatgcaggcgggcatcggcattccgatgtaacggatcggactacgagaccagatgtgccacgcgatggagctacttgtcggggagaaggtacgacgtcaagagggaattggggctggaacttgtgttggttaattttatcggagcccacgagtcggatgtagagcatctccagcagggatctcaaacctagcccctaaacagtatttgagggttaagataaaataactagatccagcagggatcctattagagcccccaaagtgaagaggccctcaaatcctgccctcaagccctaagttctgggggctcggagcacagcctccatcgatgttttttcttgcgcggaacaatttcactccgccgctctcatcttctacccgcgcgtactggttctccttcggcagccgccatcgacatcccttgcactttcagcaaggttgcccccaaagggtgagattttccctacctccgttgcccgtcattgcaaacaccccgacggtcgccctcttgccatccgactagacacacgccgccatctgcacgccatcccgttgtcctccagcgccgcggtcaacacgccaccngtcgtcggcatgcacacctcccatcggcacaccacccgcacgcctcaagtcctcccgccgtttgttgcctccacgccgcccctcatgccccatgcagtcggcttaccccccacgccctccacttgcaagccgccctcttgccgcacacaagcacgccttctgcccgcacttgcgttacttctgcacgcaggcgaaagggttgccacttgcacaccgccctccgtccccctgtcgatttatctgaagaactgcgctgctgctgctgcttcttgtaggcaccatgcggctatagtgaagtgaagtagtagtacttgtggttgtagtggacaactgaacattgattttattcagtgaacagcagtacagcacttcattatattggagtactacatgtagcattgaatttgaattgtgatgtttcaaattgtaaatctaaatataattgaatttcatgctctagaaatatttatgttttaattatcatggtcttaaactatgcatgaacataaacataaacataaagtctatcttaaaatagaagagaaaagtaaataggggctgagaaataagggttgctgctagagttgaatgaaattttgagatcctaaagaattaggggcagccctcttttttcctttaggggctctaaaataggtggtattactggagatgctagataaagagagaaattagtttttgcgattggataaaattaattttgactcctagtataggagatgagctcctgtacaccaccagtgctatataaagatgacttcgcagagaggagaggacgctctaatatctcaccaaaaccctaagacctaatagccactaatcggcaattgcactagaaggcactcgagacgctgtctctcaggccagattcttgtaatttagaactccaatattgtggtatcatagtagcataatcaatcccttattgatcacatcatccctgttagaagccatctaagcaatttaaaattcaattatgtttcggtttgttttagttagatcaaaattagggtttcaagtactactgttttgcatattcaattttcaagttatttaatcttctgcttagaagaagggaataaggcaattcaatctatgccaaaatccacaataagccggattgaatcaaaaccccaattccccgaaatccccaagactcaagaaccctaattcggcctaaagatccaaaatcccaatttttggtgaatcaaaattaattttaagttcaggttatttaccggattcaaaacccaaagctcgccggatctatatggcctcctcaggagtggagttttccccaccgttctcgccgggaatgggaagcgttggcttggcgttgcttatgctccgggccctaccgacgatacccagagccgcttggcgcccgctgttgcttgcatcctcacgcttcgccggaccaccgaagccgtggaacggcttggtgccgcccttaggcgtgacccctccgatgaagatggaaccgcaccacacgacgcttgtcgccgtgcgcgcgcttcacatcgccggtcgctgtcagcgctattgccactgtccgctctcacgcatcaccgggggaaggggatcggggagagaaggggagataattgaaattagggttagggttctcaccataaccacccaccggtggttactacgacgtggagacgatccgtgccatccatcagatcggatggctcagatcatccctgcgtcgggccatcgtcataatgggccaaggttgtgggcgacatgcctcttgcccgcgcattcgcaaaaatgtgtcggcccgattttgtgtcgattctggaagaaattgggccaaaattagaagtttaatttcaatcccatcaaattagatgtttaattttgtttatactttttcttagcttaattaaattgctaaaagtattatttgattaataagtaaattatttttggttaaatggaaccaccgagaagtttaactagaaagagtaatgatatgaaattattttttgaccaatgtgttagggttatggataccacatacccaatagtaatcgactaagctcggcggggtccactgcataccaagtcttatacagaatcaaacctcgtatatagaaggagtttcggataaagaagaacaagaaaagttctacatggaaacgacaaggattactcggattgtatccatattgatctccctagctagttccacttggacaaggggacacctatgggtataaatacaaacccccctgggaggagaggggataagccccaagacacaacatatacacaagccaacactcgttgccacatattgacatcaaagattagcctagacataccctatccggtgcctacggaggccggcaagaggaatctagcgccatctctgatcttgacgagttcatattcgaggaggaagactaccctatcatcaactacgagttgaatattcatgccgccaagtcgacgatagctagataagttatcccaaatattgtacttgtgtgatccagaggaataagaggaacaccggctttggctaacaggagtagagctatttcctgtcagataagggggcccgaacctgtataaaaatccttgtctccatctcttttacctcaatctcgcatataccatggtccaacgatccccataccatgcaaataccatagtcgagatctcaaccgtcgacacaatattattataaattcatgtcaaatatatttattatattatcccttagtattttctgcccaccggtgatataattaaggaattaactttaaatattgttttatggttatttctgctcaacagtgttttgtctatgaaaattctatatttaattcgcacgtaatagattaagccaatttaaatcaattatatgcattattaatattttaaatgtttatgtttagcaatgggacattataagactgttgttccctttgatggatctaattacacttaaaggaagaacattatgcttctaaacttagccttgttggatgctagtatttcttacgttcacatataaaatccgcaagcgcacaaatataccgttgtagcactttatccggaagtattccaaggtattgaatttccacattgaacgtgtgtatttaactcttcttcatgttcatccaaggacacaagataaatgttgaccaaaggggaaagaagattatctaatgtggtacatgatcatttagaaagcttaactttaatctaatcgctatgcttcaggcacttgcttgcttgctattattagaacgcactctactccgtagccggatagggaggactacggtgatctcgagggttattaacacctctaacgtattgtgggatacgcagcaaacactgggaattaactacataaacaccatgtctatgcaattaattactactctagcgttaactaaacactaaaataatcactatttcttaatgaacaatactgaacaatgatccaacaagctaaatataactaacaaagaagtataccacacaagataaatcttaattacttaattaaaatattctcaactagagcaaagtaattgctatggtacaaaagaaatagagagataccgacaattccggaactcctccaactctttcttcctcactctctcccttattctaagtataaaaaaagaatacaaagagcctcttataattcagctcatatcttggtgtgtattgaaatgaaggaggagaaggccttttatagcttcctgaaggcggttggagcatgggaaccggccacaaccgccgtaggaaggtcggcagtaactaccaaaggcggttttggctgggctgggctaagcctagatcggttggccgacacctagctgcccctctagcccactccttcctcctgggccctagcatgtgggtccttattctattggcatggtggttaattgggtccagttgcaggtatttcgttaggtttatgggcacaagactccccagcatgctaaactctgggtgctacaaaaaaaaatgagtatgttggaatgtttgtaggggtgtcaaagtctcatctagttactttgcaaacattaagaaactagttaacatgaaaataagaggttggtgaatgaatgtgaattgattgaaatttttgtgattatatgagaaattggtagatcttgccttttttttattgccaatatataagtgctggtttttattacaaaccggcacctatagtcattgtcatgtgaccaggccggtcaaaaaccgacacatatatactacttataggtgccggttgtttaaaagaaccaccacctacatggatagccatgtggcatcttagtttataaccgacaactatactaccatgtaggtgccgattattttctaaaccaacacctatatgtctgataggtgcctgttctacaacaggtaccgatgaccagagacatcaggaccaactactaggtgcccgttagtaaatccggtacctaaaggggttttcctacttgcaccaaagagcttttctttagtagtgcacaattcacatggaggatatatatagacgccaccgatagtgtctgcctttgttgagagtataccctgaccggttgttgtagagagcatgcaattataacatgcagctctccttgatttataagactgcctgtgactatttcctaaccacactttgataaagaacccaagttcgtctttaaaaaatatttcaggtagcaagtgggatttgagaaaactatagaatgatggcggcagcacacaaatttcagccttttccctttgttccattcatgcttggctaaagcttaagctagctttaacgattattttcaaacatcttctttctttgtagggactcgtgaatctacgcaataaaaaaatcacaagacctaaagacgggtacatgtcgccagaaaccttaactatgaccaaaatttgattttgaccacccaacgatgaaatggttcgctattgcctattggtccctcaactatcaaaacagttcatatttcattccttggtctgaaccgtgctgattttttatatttatggcattgtgtctacatggagcttacttagatgagctgtgatgacaccattgtccctgtcaataataaaccaaaacaaaataacgaaaatgcaagaaaccacatgtagcatccttgcttccttttcctctcgctcgcatcctacatatcttttgttattttgacttgtcaaccaggtgtgccacgtggtgccatgtcatcgaaaaacgattgcaagagtttgaaggaactatagtaaccgattcctgtgagggaaaacattagaatgaggtgatcttaatgtgaaaacagaagcaggatgaaaataattaaagctacctagttgtgttgcaacccggtaaacaagctgcagcagggtcgtaaacgtacgtgtctcagaaagtaaacggccatatgtcagtgactgtacaatatatgtccataatgctagctaacgacgtgactctaggatcgtacaagaccaaataaacctaccagaaaaaggtgaatggtaggaaaaaccaaaaacccaaatatcttttgcgtacttaaagattaccctcaaaagaagtcgatgacgaagccctgtcgccgctggtcgaaccacccacttgccgccggtcagactgccaaagcctcgccggtcagaccacccgaatacttgcggtcagaccgccgctatcccaacggtcagaccgtgcgcacaccagcggttagactgtcgggatccagaaacacaggtagatgacaaactcaaatatgtagattgaaacatttcgactttattacatcaactagtgtttacaaagtgcacaaacatcactcctcaccaaaatctcgaactaaactcgaaaccctaactttctctcaactctagtctctctacaaccgatactaggaggcctcaccctccctctctatttatacatgaggtaggctgtacaaagcccacgaatgtaacataacttaggactcctaacccacgtaggaaaccctctcctgcagatatacaactcatct

SEQ ID NO: 44364 - DNA, 4815 bp, Oryza sativa
  unsure (1)..(4815): unsure at all n locations
cgttgccacgcttatcaaactgacctaacagcgttgttttcccacgccagttcgactggcttagccaaaaggcatgagaatgtattttgaaaggcaaataaattttggaaatatttacctttcaaaatatctgccattgatcgctagctccaatataaattgaaatggaaattgaagtcttgtcttggaaataaattatgaaagggtttatttttaaaattaaaaatagaaaagttaaaaaaatatctaatggcgaccaatgtgagaaggaatgcaaggcatctcgtaacagcccacacgaccaatcagtccatcacaccataaattaaagtcaacatgcctcataaaattggaccaatagagtattttgctagtatttcatagtcatattagcatttcctttcaagtaaagagttaatacaaacacgaatttcaaagaaactcgagccaaacctacaaattttacctcgatttttttttcaatgtttacagtacgaatttcagttacaaatgcgacagaggccaagaaaactgaggaagtaggaattttatccaaacattgacagctataactaatggctaaaactctgaaaactattgatttgtttatgaggtggcctaaccatagctctttcctactagtcctaagtcctccctcatctgtatagtctaccaagtaacacatccaacacaacatttttcatacggaacatgtaaaactgatgctttttccacataggggagatgtttctaatgtaaacacaacaagaaatgcatctagggcctcaacgctctcttttacaaccacattgccagccacacccacaccaaaatgggataaacacagctacctacattgccaagttcacaatatgatcagatgaacgccaccacaaagacaagatcgaggtacagatatgcagaaaatgagaatgtatcgctagctggctacgcttcctcttagtcggttagcaatgtgaagaaggtggtcgatgttagtcggtggatagtgctgcagcagctggatgttggcagtgaagtctccagctaggaggcgcctccggacaaggatgagcatggcacagcatattcttagcaacgtgtcctgcacaagaacatgcaaagcattagccccctgcagttgtacaagtaacatggctgcaaacctagtttggaggcttagtccagaggttacataccggaggaccttttggatcacccaagatagcatcccaaatgtgaatacacacattgaagctgaactccattgtcaacagtagtgtgatccatctaaatgcatagtattgtggatatacctgtattttcaatatccatgcatgactatcaacaatggtgggtgacataccagagtgacttaatttacccacaaaaacaatttagcaggctatcaatattagtatcttggtcaaaagaataacctaaaacagttacatactggtaaattgacaaggaaataagagccactttaactgtacaatgcgagaaaataaaccaantccttgttcctttcaatggtaatactagcattttcacttaggacaagctaataaaatagaagggttatttggatttaggccattgtaatggcaaattgtaaatggcatgacttcaaatagccataggttaattacccctaaatggtggaaaagtaagaagaggtgacattacggatagtaagatgtccaatattagctattgaacaaataacatgacaagttttttgggtgcaattccatgcgcactttcttcccagcatgcatgctacagtagattttgcagtctgtgaaatatattactgaatattccctacctttgtagtgatctccatatgtcgccatagctcttcatcatgtctcttcaagagctgagacaactttgaaagtgtagaccgaatacccacttggctgttgtcaagatgcttacagtagttgtctttaaagccactgagcaattcaacaaagcaaaagaaagtgtctgcttcagctgaggcctgtaattccaaaactgaatggttcagctaatgaacacatttcagaaccaatcataaaacagaccaagttgtgaattaatattcatataaatgagctattctaattctccagaaagaattcatttagtgttgattttagaaactcaaaatatccacaataaagtttttgtgttccatgtaatgagcgagagagaaaagcagatagatatccttatgatagataaattcctcctttgtcaacattcaaacgttccatttaaaaccatgtgatcaaatagtaaaagaacatactgaattgcttgtatcagggtcattcttgaacacataaaaaagaggtgccaaaacttcattcatcccttgcacatatcttatggtaggatttaattttgagaagataatgagaacacgccttagagattcctgaaatgtgtttgaaaaatttagtccaaatgacaattacttgtagtttaaatggaaataaggaattccaaggcactgaagtgaaacctggttagccttggcagagaaaaacggcatttcaggatgtgttcttttcacatctcgatctatctgttccaggatttctgattcctgtaaatttacatttatcagaatataagaaaaagaacaaatgaaatcttgtggctgccatgccagaaaaccatgtttaataattaacatctagactatacagaacataaatgttcagtgcatatcaaacacataggcgagaaaacataaatgttttcgcatcgctcaatacagaattcagaaggactaaacagttgtgcactttcctctttccttgcaatatattcccttcatttatttttacttgcatcctaaaatcaaaatccatgaaactaaactttctaaaattgatcctccatatgttatgaatatatagaatggtgattaaaaaaattatcattacatttgctattagaaatacttacaaacacttagtattaacataaaaaaattacaattaaggtcaaagctacatcttggactatgacaaagcccaaaaacatcatgtaaataaaaatcgagagagtgcttgtccttagcttttcacaacagtgcataaacaaaatgtaataccctgaccattagtagagggccgtgtggcccatggtgttgtattagtaggattagtctcacaagaggagtttagataggttgggcccaataaataagctcaaatgttttaaccatggcacctccagattaaccattttatacagcaacaatgagaaaagtgtcaaagtggggtgctatgcatatgtggggcttgctcctaaggaagagatgagctaatgtagatctcagaagctgaggtgttacacaaaactaggtccagtgaaaggcacgcaattctgaagacggacaacaaatgcaatgtgggaacttaatatgagccccaacataccgaacagaacaaaatcaaaacctagtgaaaagaacaatgaccacagactggtgggaaatactggggactgtacacacctcacagaccacatgttatgcaaatactattaaaaatcccacagccagatcagaaaaataacaataacaagaaactgtacctaccagcaatttaactagaaagaattaaagattataatgagaatgaggataagaaattaagattccatatctagatataacgatcatcatgagcaaagacaaactcataataccaaccaccaaacaacttaaaagcagtccaaacaatttctcataaagtaaatacattataatgtttcagattaactaaacaaaattcaggtcttgaagggaccataagagttaagacacgtgaaggaaccagctggcaaccatgggttcccaacaagccttgcagatttatttaagatggtaataagtaatacctggaagtattgattccacaagctagatttaccaaagctcaaagggtgctcttcattagtaactttggctcttggtagaaggccaattttgtcactatttaattctttctttcttagcaactttgactcctcaaatctccgtattttttctgactggtcaaaagaaaatatcagtgtattcatacacaaccaattgacgccttgtttcgcaaggccaaaatctccaggtatggaccagggttttggcctagccaaacaaggcttaaaatgccttacaaaggataataaaaaaagtcttttggactaataaatcttcattgataatttaataaatattttagaggggcaatcataacttacaggatttaggagaaattcatctttatatgcactatactggcttcgcttcttttctagctcatgaagccaaaaagcacgctcagttggcagatatcccaacagaagctgcacactatttatataatagaataaatttcttgtgtatgaactatggaggttgccacatagcacggttcttgttaaaagctaatttagaaaccatcaatagatcataaataacaaataatatgctgaaagtggtcattttcctataccacttgggcattaaacttgatgtagttatagttacaagacatacttattcaatatacatattagattgggaaatagagcaatttcagatggtcatgtgattgcatgatatgagaattggcaaacaggatagggatacgcaccaataatacagaccaattcctttttgtttccatgccataagtaactagttcaaggtacttaaaagtaaaaaaccagtatccttctaaagttcactcttgaaaattagtacccatctaaagctcattattgaaaattgaataatggatgtttatt

SEQ ID NO: 44365 - DNA, 1982 bp, Oryza sativa
  unsure (1)..(1982): unsure at all n locations
nnnnnnnnnnnnnnnnnnnnnnnnnnnnnnnnnnnnnnnnnnnnnnnnnnnnnnnnnacttttccgtcacatcaaaagtttagacatatgtatgcagcattaaatgtggacgaaaaaaaccaattgtatagtttacatgtaaatcgcgagacaaatcttttgagcctaattacacaatgattcgataatgtgatactgtaataaacatttgctatcgacggattaattaggcttaataaattcgtctcgcagtttacaggcggaatctgtaatttgttttgttattagtctacatttaatactttaaatgtgtgtccgtatacttaaaaaaattttggcacacgaactaaacacagccatagtactaatgatcttattaatcaattatcatcctaatttctccctactttatcctacccttaactacccttcactcttacatataaaccatttaataaaaggtattctcatttttttctcaaaccttaatatatgctaaacaatctagaattacaattaatttgggatggagatagtagaaggttataagccaactatgaacttatatgaaaagataatttaaaaaataaagacagttggtccttatgtaaaagctagctattcacatactttaagataaatcattaaatgaataggtaagaaatggagagaggagaaaaaatagagataatcttatataattcatcaaatatatatgttaactttaatatgagctatttagaaattgcttcaaaatatcaaataaatatattttttaaatttatataactaaaacttaattaataatgagctaatggcttttttgccgtgccctaactttacattcatgcttattataaacgaacaccacataggtaaggccactaagaccattcccagcagatgcgctatcccatcctccatcgagaaaatcgtgctccaaacagatacaccatcgctgcctccaaatttagtgcatgggagatagaaacgtcaaatttggcgttcctctctcctcacgccatattgcaaccgcttgcttcgagaccgagcttccgcatctagccgaatcgatgctgtgtggggtggagtagtgaaggtgaagactggagaggtagaagtttaccagagatggagatgtggatggcgaagagaggcctacgaccactagaggcctacgaccactgcttcctcgtcccaccgcccgggtgccgactccgaccgctacttttccgcccgccgcgccgcctacgccacctggtcactggcaccaaccgccgcttctctgccggctctgcccagtcgtcacctcgactaccacttctcctatcatccttcttttttcttttttttcggtcactctctcttctttcaataggtacagataaatatgtttgagcataaaaatgagattatggtattagtcgtcttctactattttgatagttccgtaatgtttgtaaatatagcattataaaaaataatacaaatgtatggatagttgaaagatattattattaaaatataggaggatgtgatatagagtatgtaatatggatggtctattggaggaagaagagtatcgagtgggaatcttttttaatggctatacaaataaagatatgggtaatcaaatttggatgagccgctcaaaatagtagaaagaaaataactttcatgtgactgggaacagcagaaagcaccaccatcaccatgttgacgatccaacaaattgaaaaaaagaaaaactccgcctcttcaacaaatggagaatctttcttgcatgattcctttcaacgcctgcaccgtaagtactcaccgggtacaataaaatactgcggatcccgtcttttgttaggaaatgtttttgtattcgagtcgataaacctactggctttattctaaacctttgattagagatgtaataactatgttttcccatcaatagagctagccatatggcattcaaaaaaaaaaataac

SEQ ID NO: 44366 - DNA, 1390 bp, Oryza sativa
atacaatctacagccgtggttttggacattgctcaaaattgtacacaatggcatcaatcctcaactgtttgacaagtaatgaagtgagacagctactaccgccacaaatacaaccttgagtagcagctttgttgacaacagagatgtaggtgaagatccttgtggtggtgggtcgaccttcttcccccttagcttggctatcaacagaggaatcagcccacgcttcgcgggtgtagtaagatcgagattggtgagttgaaatttataaatctgagaagtcgattataaccacaatagtagtgtagtaatgcagcacccaaaacaacaacatgatgatagtgatacaagccgtaacaaacggtatgtactaaaaagttgttcatgtgtagaaagtgtatgaagatcaagaactacagaagatcagatgatagggccaatggtgcagcaaaaataattttattcttgatatccagtgccagaagcaacagatggatggctcaatgccacaacataataaccaaatacttgtgaatttttgggccaggcaagctattataaactgatttttcctgcgctacatcaaaacacaaggatagtcttgaaaactaagacaagagaactgaagaaaaaacaacctgaaaattacacctaatgaaactccgctccacaatggctatattgaaatgtaactccagaatccagagagaatggttcaaatcaaatcaaaagaagacaagaattgattgaacagattccagagaaaggtgtaattctataattgtttcctatttattacaaaattaaatggtcaactttatatttgccagaccatgtattgtttaaaacagcatgtatctgttaaagcagcgaattatgtaatcacccaaacacaagcatttctaaccatgttttcttcaaactaaattccttctatgccatcaagggttatctcaatcaattatttgccgaaggagaacttctcttgtatgccacttcttgtaggaccattacataagttgccataaccccttaaaaaggatatgttagttttttctaacaggtactgttgccttcttctgttgacttacctcaggtagctatagagataaagaggacatgcccttgacaggctgaacttaagtccagcttgctcctggctgcagaggagcagcttggtggacgggtggaggttgatgctagtggaagtagtgtcaagatgtcccagcacttttgtgaacctgcacaagcctagagtttgtggttctttagatgtttaccggcatgtataggagtgaagaacttcatgaataatctctgccttgtcaggacatagctaatgatgagaatccagctgatttgggtacaatcagtataatttgtcattttggca

SEQ ID NO: 44367 - DNA, 2087 bp, Oryza sativa
ttcgatttgcttgcaggaataaggttgatctgcatcggcagatcaacaacccacggagaggtgtatcgatcgctaaggcgcaacacaacgtctcgtacgggtgtagttggatcgtcaacgtttctcccaaatcgtagttatctcaactcaccgaaagatcgcgccaaacaactgccttgagtgtcgagaggaactcagggttcatcaggtggtatcagagctttcgttactcggtgagtttttatctacccataaccagaaaattgccataaaaaaagaattgcatcctttacctagccatacttgtgccattgcattgttcttttcagtttttgatttgttgaattttgtgttgcatcgtcacatcgtgttgctggtcatagcgtctagttcgtttagagtttcgagttctggtcacgttttgtaccacagtcgtcgccgcccgccgtgtctttgttgtcgtcgggacctaggaaaatggaattgtcttgttgttgggatttcgcttttctagtttccagaagtttttgtcggtcggttttggagttgttgagttgcatataaggttgctgagttggttgtctttctgttttggccgtgcttgtgttcgtgcacgagaggaggaagaaaagttaccaaatcattttttttggcagtatgcaagttagatctggaaagaaatagtagattggtttggtttctatctggggccacgcagaaaaggaatcggtatcggtttccttcttttagaattctcaccaagtcccaccaccttgcatgcggcattccttcctcagtccggctccctccaaatcacgtacatcacaaagtgtgagtcgtgttaaacaccttggtgaatttttgtttggtgtcagtttcgagatttgtttgggaaaacggaaccgacataaactcagcattccatttttgtataatttttatttttgtttagacttttacatttgagtcctagtaaattttgtatttacatttgagtccctataaacttgcattgaggtccttaagtctgtttttggtaaaaaaaaatcataaaaaaagtgagaaaaggcagaaaggtgcataaaaaaacaaagaaaacaaaagccgcaccgaaaagaaaaaaaagaaaagaaagtaaaaaaaagatagaaaaaagaaagaaaaggtgagaaaatcaattgctatcattgaggttgttttgatatatcagagttgtgcttttattgtgctatcttgtggtatcgtttgtgtctaggctcgcgtctctagtacgttctagcctaagaccagcacagtactgagtttgaacttttattcaactttgcattctctgattttaacatttgctattcctttgctagatacttaagcctacccagagctccacagatttgattgcagccgtacgacaggtgtttgccaaggcatcgatatatccaacctccattggggtgcttggttgagttggtgtatgtcaccattccgcttgcattggtaagaatttgtaagagctcgatataaagcttgagtgtgtgtgatttgtgagcttccactacctagtagttgataggaacgtatatattcttgtatatgtttcttgtttgctactaactatggcagggttacataaagagtttggagctgttcgtgctcaatgtggacattttcacctgggacatcacatggcaagtgaccaacatgacgcaaataaggtacatgatcataatcttgcaagagtagagtctgttttgacatcttttgatggaaagtatgattccgctgcatacattaattgggagctagcagtagaaaaacaatttgataagtatgatttttctaatgctcaaatgattaaggctgctagtaataagtttaccggttctgcatctttttggtggcatactggaaataagcttgaaacatgggatgaatgcaaaatactgatgagaaaaatatttgtgttttcatactatagacgtgctctccttgagaaattagaacatctaaaacagggtgataaaaccgtgcgggagtactttcatgactttaaaatttgtatcacttatattggtccaaaagaaagcaat

SEQ ID NO: 44368 - DNA, 857 bp, Oryza sativa
aatgatttaatttattccataaataaatcatgacattggtgatgtaaactagattgaacgcatcattagatctacacatgtaaattaagcagtaaaacatgaacagatcaaatatgcgcaacatgttgaacacgtaccgaggtgccggaaagaccggttgctccgcaggaactactcgcagttgcgggcgtcgacgaaggagagtcgcacgcgagcggagaggaagacgagccatcgcggacgaatagggagcagtcatgcgaagcgcttcccaaaaaccttattgccgccttctcccggtgcaggacgtcgaagacagaggttccggagatgtcacgcccggaaattcactagtaatttccgaactaatttgtgcattaaatcctcgtccaggaatcagccgaggtacacaaactgacaatttaatatacagattcatcaatataataacgttacatacttacaaaagaaaagaaaactacagcggaattacggtctagcgaagctccggctccactcccacaggcagctcaactggggtataagccaaacgtcttctcgttcgcaacttgtcttcaactgaagtttgattgattattgcaaggtgagcatatgacatactcagcaagccacatagcaaatatgcaagtgcacaaggataccaaagaatggcataatatagggctcatttgcaaaagcagcatttagcaaataattgaggattgtaaaactgtaaagcaattaatcatcaatattaatcaacactgaacagcacacccatgctgcacaggcccaaccatcctgaacaaccataccctgctgcacagatctatctccaaaccaggaatgtccattcc

SEQ ID NO: 44369 - DNA, 1566 bp, Oryza sativa
ttcctttagccccaaaaccctaaccctagaatccagaagtcgccgtcgtcaccgtcctcaccatcatcgtcgctcgaagccgtcagaagatctgggtgagtgggggggtggagagacgataggatccgcatgggaggggtaaggggcactggatccacacctttcgtcactgctaccgctaccggagcctaagctcgagctcgcaatccttgcctactgaaagtgcatctaggccccaattgttttgatgattaatgacaatacgattagagaggactaacacgtttgtttacgtgaatgtgaaggattgttagtccgtgacaatatgtagcgcaatacatatctcaatgaatgtgataattcatgagttgcggcaatgatcaaaggttatattgtacattttcaattcttcatgtcattaagagggattatgcattgacatatgaggagtgatgaatgtgctcaaaatcaatttttaaaagtgtttctcctcagtttctgtgttctggaaattttcgaagttgtctgaaacagatttttggaatttccaaaaatagacataaacaattttagcttctagaaattttcggaattgtccgaaaagtgattttttggaatttccgaaaatgaccgagcagcaaaataagtttctgtaaattttcgaacttgtccgaaactggttttcggaattttcgaaaatggcagtgaggagaaaatgtttctgtaaattttcggagttgtaggaaatcaatttccggaatttccgaaaatgtctgcgaaccaaaaatgcttctggaaatgttcggacttgtccgaagggtattttcggaatttctgaaaaatgtccagaaggttgttttggttctggatatttttggacttgtccgaaaagttttcagagtttccaaaaaatcctcagttgactttactatttctctaatctagaaattttcggatatgtccgaaattaattttcgtaatttccgaaaaatgcaattattgtgcataacgggcagatctggagctatggctataaatagcccactcgctccacttgtgagggttgctagactgattggatatttcgtgccaggcttgttcatcttaagattcacttttgagccttgctttcttgtgtcccctctctacttgtgtttgactcggatttggtttttgtgtgagagttgtggattcgagtttgtgtgagtgcttgttgttggcttcgtgaagatttgtgagcacttgcatcatctccggaagttctttgcatcatttgttactcttggaggttgaggactcctagacagctagatgtcactctcgagccaccgatctacgtgtggttggctgggagaagtttgtgaaggtcggatctcacatccgaaagggaagatataccactaatggaaggagtgttttgtggaacctcttgaggaaatggttagcgaagacccggctctttgtgagctcctcaacggagagtagaatcccctcatggatttgaactctgagaacaactcatcttgttacaactttgttgatatctcactcctctagctttgcttg

SEQ ID NO: 44370 - DNA, 1849 bp, Oryza sativa
ttagtggcatgacaaaaaaaaaagttgccaacagtcctcccgtctcacctctcctggccaccgccaaatcccctcctgccatgccttccccaatcaatgccggatccactcccgccaggcctcctctaaccgccgccggatctcctcctgccaatccataggcgacccccttctctttatccggaatctaacatgataggagcaggggttaggcacttctcgagataactcgaggtggtcggtgcaggaggggccgctcctgctatggcaggggggaagcaacgacaccagcggcaggcactaggaggggagggcccgtgcggcagcgaggcatacattggagaagatattgggctgatttggtttgaagccaaaacttcccataccaaaatattggtattttgaacagtaattttggcaatgtttgatttgctaccaatacttgtcaataccacacaaatgttgccaaaatattggcattaccaatagtttggcatggttggaaaccaaacaagcccgttattcagagaggtttgctgctttgacgggctttgatgggaatattgacggtgatggtatatttttaatttacgtaagtaccagtggtgcccacactattttctgctttattagtggcattttttttccagtacagcgattttgtaatggcatgatcaaatttaccatataaacaatgagacagagtagcatgtttaattatgcataccgatctagtgcttcccaacgaccccatagatctgtcatcatgttaccttgcctgtcaaattttattatgagaaccaaactaattaactactaccactgtttttttaatatatagcgccattaactttttgacaaacgtttgatcattcattttatttaaattttttgtgcaactatacaaattttgagtcatgtttaaataacatttgacaataaatcaataaaataaataataattacacaaaactgagggagtactggtttctagcgattgcaaacagacggcatgggcgaattagaatacaaattacttaataaaatacaaagacattgcaaacaaaatggattttgacaggcccagcgcagtggtagactgatggtgcactggtattcaacctgcaacagcagaatgtataagctcgtttggacttttgagttgaggcaaagtgcataagttaccattcaaagtttagcacatatacatattgtttaaaaaataaatgcatgacctatttgaggagaatgaatgcaagtttctagattgtttatgagaacagagaaggaacacatgtcaggagtattaaacaacagctataaaaggcatacttcagacagcttggcaacattagtgagtgttgattctggaatggattgtttttgcaatttcatctagaaaactcatacatagagttcacataaagatccttctcacactgctgttgagtaaaaaaatcagctgcgctttcggcaagagtacagcttttatgggcagcttacaactacaagtaaagaatgacagtcccagtcttgctaatcctgtatatacaaaccattgtttctcaaaataaacagaaaaaaaaatgcatacaagaaaggaaggcaacctacggtaaacactgcagtatatgagtataaaattgaggcctctgtgacagccaactcaacggcagtgccccttatttctgaaaaagcatattatgccagaaaatggttgctgaattgaaatacagtttgatttccgttcttcgcaacaacgaattatccaccctccaacaaggagtggggatggtggttccatctgccttgaccacccttcaacaatcatccctccatgatcatggaa

SEQ ID NO: 44371 - DNA, 2605 bp, Oryza sativa
tgccatgctttatatttaagaaattttatttcccacatttaacttcacttgtaaattaatgaacatttaatataaattctatgaacaatgtattaaataatttataaatcctgaaatgaaattcaggctgtgacaggagacctgctctcctgatcgctggtgcacgccggcgagtgggatggagtagtctacgagcgacggcgcagtacagagtaggaggcaaaccctagattgatttcgcgtatgttacgtgaaggcggcggctcggtttatatagagataggttgcctgatcagggcgcccgcgtaaccgaaccggataagtcgcgcgtaacctatccggactccacgccgttttcacgcaccggatttttcggaatgtttccaaaacaaaacaaatccgaatttcccgtagcaaaacaaaactgcaaaagaagctgcatctgcgcaagggtgaggagccaattttgcggaacattcgacacgtacgttatgcacgcgcgccgcctgccaggccaggcaaggcgagtgagcgcgcgcgtgttttccctcttttctacaccacacatgctttaagtggctaggagggcatcctcccttttaaggaggtccccctctcctaaaataagcaaggtggtactaaactccacatgcatgccatcccatgaggtgggcttttgtgattttccaaagaattaatcttcgaatgggccttagcccatctattaattccaacacaaaacacgagtaaatatatactccctctatcctataaaaacaaatatagcatggaatgtaacacatcctagaaatatgaatctgttagatcccatattaggtttgttttgaaatatgaatctgttagatcccatattaggtttgttttttatggggcgaaggaagtataaatcatcaaaagtaagaatccagaacagactcctagtcctaggaccaagcatacacctacccaggttcaactcctcccttctattttttttcgataatggaatcttcattaagactcagtcaaatacaccaacaccaagttgatacattccaactaagccaccctcggcctctacataaaatgcacacagcctacctagaccttcattacgataccgagatatcagtggctatcaatccatatactagatcgccacccatgctcctgagtaaaaactcccacctagtccaaacgtcgcgatactatcgcaatagtatcccgaagacccggtttgtggaggatagcctaggtgcgaagccaccgggtgactaaagtaataacctgcaaaggagaagacaccaacttattataaaaatttacctcgtttctgtttatctaaatggactaacaaagagctgctgcacccatcaaaagaagatttgatgggtgtaatttgtaatcctttttacatatgcaatctgtaagttttataattttaatatatttacacacggcaggaacctctcctatagtttctttttttcaaaacaaaaacagatttctcatttctttaggaacacatgtaagcaacgcccatgttagaaaaccggcctcgaaatcacatcggaaaccaaaccgcggacgaaaacaccataggagatccaaacatgatgacgacaccgaggcacgatatttgataacagagtttagccgaggcctacatctcaggggtactgattacgagcgctcctccccgatccagcatattacagcgtatcagagttacaatgactcacggccagtatacaactccaagtcctatactgtaaccgattacgtacatatattcgacacaaacaataacaaactccaccttgaagaatatgccaacctgaatttgttacttgctcgaacctctgtgtacccgaacttgagttgatcctttttcgccgctcacgctgaactgccccgacaagcctccaccaggctcaccgtaaacaagagactctcactatccctgtaatttctttctcttgactccacctgcaacagtgctccaccgtctctcatatcaccacagtcatcttaccaagcaaaattggattccttcctagctatcacgtcgtagacttccccaagaccatgttcacctccatctaccgtcttaaatttgacttgatctaatccatgaccagataaccgatgtcatcaccaaatagataaatcaaactcaccacacatgaagagaacattttcttcattgtcgccttatgaactaagctaataaatctaacatccacgctttcctgcattcgtagacttaattcctgataatttgagaaaatcaccgttgctttgaatcatccgaagaaattaccaccatagtgcttgctctttctcttcagtgacgtatatttcatatatcctcatcatgcaaaccccgcagatcctggatatatcctgtactgctaaacaacccgttgacgctctcaacgattttcacccgttgttgcccagcaaccatttacacctgcctgacaataatatccacttgcgctgcctttcctgccttaccaatactttgacttatcacgctaccattacttcgctgcatgtataaacttagcatggtcgcatcataccgtgacacttgggattg

SEQ ID NO: 44372 - DNA, 1465 bp, Oryza sativa
atgatatgtatcatttcgtgtcctgataaggtcacttaattagctagatcaaacaaagccttagtattccttaaagaaaacaaaaagagtaattattaagtctatttaaatgagtaagacacaaatagctaaatatgattttatgtgataattttttaattaaaatatagctaatatgtgatgtactcgtaatattttttaatagaaattcagatacctccttttcttttatatagtaggttcatatatgtacttggaaacatatatcttcccaatcgtaagtacattatgctcttattcgtttttttgttactagcaataatgcccgtgcgttgcaacgggtgaaggtaattttaatcatgcatactggtgggaaaaaagataaaggaatcataatcataataataatattaatgaaatgaaattgcagtgacctttggtcaaaaagataaaaatatataattgattttccgttaattccattagctaaaaataatataatatgaagtaggaaaagttattcttgaattttagcaattttcaaaaagcttaaatagaacaaactaattatgtaaataaaaacaattttaatcacctaaataaaacaattagaactgcaattaaaaaatctgttgccagcttgtttaaacatgagccggtgggtgcgtgtggcatatatctctcactcgtacatcgtggtaaattttttacatagaaaaaatgactgtgcgttgcaattataacaaatataaaaatattatatgattaaggtttagttttacatgatatgagctctttaagaaaatatattcataatgaaataaaaaaaagttcagctgaagggacctaaagtgaacttattccacacagagcgtacacgcggtccatgaggtggcccaatagtgtgggcggcatgggaatagaatcggggaggaacaacttaagcgacctaaggtgaacttattccatgtgggtgacctgggaatggcgttcagcctaacgtgggagaagctgaagctgtccgatgtgatagatggtcctgattgatcccgacctatataaaagttcaacatcccaaaccctaaccctaaaatcatttctcctccccctctctctctcaaaacaacatgacggcggcctggcatacctacatccctgcgacggcggtggctgttcggcagcgatggcaacaccctcccctttcacgcgtcggtgttttcttagtattgttgaatctgatcttgtattcttgtagtagtgttttctctagaatttaggtccaaattttgatgcggcctctcattattttttttctttcttttcttttttttttggccatcggagagggattaaagcgggatcgatcgcacgtgcgatgaaatttttttttgacggacgaaaactataacctgaagccatacaaattttttaattaggtatatatagaatcggactttcttttttt

SEQ ID NO: 44373 - DNA, 1631 bp, Oryza sativa
aagtgagagattatattttaatggatctaataatctaatggtccaaaatatagatccacagtttaagtgttaatgttcactttttctacattccttttctctttaaaaaatgtgttgatttttaattcccggtttggtttcccaaccccaaattggcgatgtatgagcgttcgtaaaaagccacataacaacttgagagtgttcgtaggatgtttaatagacttttagtatataatagatatattgttatacccgatgtttaatttaatggatatttattatttgctagctagaaattaaggaggccaaagtgagcaaggagagatgacgtaaaattatttgcgaccacatgatagtatatgttattattttttgctatttgtaggagtatttgtcaaacgatgtatttcttatatatcaaaacacatggctaatatagataaatagaatatgttgtagaaaattataattatttagttatctaattattttttacataataaatttattatctaaaaattagaagatggatgggatgaagaaaagagaggttgtgagggagtaacgtacgtacacgtacatgtacgtgaggagtggaggcccatgaggggagcgggagtggatgggatcttggtttattttgtttaatatagatctaatggtgtaaaataatgggcccgctatattaagtgaaaatcaagggtgagatgttttgcttttttctagaatttcttggatttctctaatttattagagcgccaagtggcggtttaggagcgtttgtaggaagtttaatggacttttagtatataatagaaaagatagatagatatttacagaaatataccattgtcgcgaaatgaaagcgcgaaatcgtgcgttactgcatgatgtcgcgcgaggtgtgcgcgagaccgctcggtctcgcccagcgagtgcgcgagaccgcgacttcgcttacctaacccgtgtactcacgctatcaataaattaattagtgtaattagcaattaattaattactattactcctttaactaacatcattagtaattaattaatcgttaatcacttgttaatcgtccactgatcatgagtcatgtcaggccatctcgcaaggtgatgaagcgagaccgccggtctcacgtcctgctgttgcgataccgtggcggatccggcggaatcacgccatgattctgcgagaccgtggcaaagcatcacgttgtcgtcattttcgcttaacggcttagcgatatcgtttcgatttcgctctttcaatcagcgacgacgatatatttgtgctaaaaattttacatctcggatatttataaaaaagaaataaataaatagtttactttcaaatttaattcttacaattgctgcaatctcgtggttctcctttgctggttttgtttggaaaatctgagtccgatctgtgtccaatacggaatcctcttcgttttcccttcttgtgtccgacgtggtgtcttccttgattcttctcttgtgctgccacaatcacgaccaaaatagaaacagactacgtgaccgagtccatatctatgttgcagcccttctagatcttagtcctgcacgaacccggcttttcccaagccagctaccaacaaaacc

SEQ ID NO: 44374 - DNA, 3731 bp, Oryza sativa
tgaaagtagctcaccggaaagttcgagccacctgcccgcagtgtcggacccatcgattgaatcgccaatcgctttcgccgccatcaacccgagcaccacgtctggtcatctccctgttgattgcggccatcgaccggttcaaaccgctgcctgaagtgtccgattccaccgatcaaattccgttgatcgccgccgtgctccaccttgcgtccatgcccgtccctggacaacctgtgtagttatcgcaacgtggagcacctccctcgcacctctacgatggatctcccgcaggctctgataccacttgtttgaaaaccggccccgaaatcacattggaaaccaaaccgcggaagaaaatgccataggagatccaaacacgatgatgataccgaggcacgatatttgataacggagttcagccgaggcctagatctccaggcactgattacgggcgctcctccccgatccagcatattacagcgtatcagagttgtaacgactcatggccgatcgccgtcggcagacgctccctctcgctatgctatgtcgccatgcagttacaataggcacgcccctctatttatgagagatcctaggatagagttcgagtcttactctaatcctatacctagtacaactccaagtcataaactgtaaccgattacgtacacatattcgacacaaactctaacagcccaaacatatgagtcacattttgaggaggttgtacgttataagccatatgaataatcgaccagaccaagtgagtaacatgacattggaagaacaaatgttgaatggttccgtccttatgacaaaagcaacatttcttactacctttccatttgcgcttggagcgcaagtttaaacattagcatcaatccacaaatattcaaaccacacgcacaaaagatttatctgtccactcttacaaaaatctcagaaactctaaatataatggcaggatgacagattcaccaccatggcaccatccccaaataggaaaaccattcttattgggtaaactcaaacaagcaccagtcactacaaaagctaaaacagaacagcacaaacatgaccgacgacgacgagcacttctgaatagagactagctataataattcatagaagactactctgggtcgtttggcgtatgtgacctgcttccgcgtccagctaactcgtaaacgaccactcttggtgtattggcgtatttacctgcctcggcctccagctcacgcactattgacttggtgatctcaccggctttttcaccggccgtcatgtgcacctcacgaaggctcgcgaggttatccatgccgaagacgccttccagcgtgttgaacttcatatcaagcctttcgaggttgcccatggccctctccgagaagacgagcaatggcaggagcggcgcgtccaagcggagcagcttaaggcagtcgaaccctccatgcttgaccaagatctgcccctctgagtccgacttgttcttttcaagaatgtccaccaaatcaaggtccttgctggatgtccaggacgaaaatataaggcagaacatacgaggtagcttctgaaggagctccaaggtatcagttcggagcaccgtaactgacagggttaagttcttcagttcagtgagatgagcaatccacctgggcaccttgatgaacatgccgtacagctggagggaatggaagtatctcggtggtgaggtcagagaatccagtgcgtcgatgaaaccggagcactcatcattgatcaagagattcttgagcgagctacctccaaggtattggatggaagagagcaaggccttgaagccaggagtaccctcctggatttgtagcttgtgtatcccgagcttcctaagggcagtgtacccgtggaaatcattaacggacgtcggctccccagtgatctcgatcccggacaggatgtgcagtgttcgcaacggcttcttcgttgcctccgctggcaacttgagtgttacctgtgccattgtgtttccaccgagtatactcgtcagccgttcaagctgaacgatggcatcaggcagcttctggacattcgtgtcccttatgtcaagggtctctaagtaccgtagcttcccaatcttggaagggatgctgttgatgtctgttcctcggaggttgagatatttgagaagaagcatcttgaagatgtccttgacatgctgcttcttgaagcccttgcagccttccaggtccagcacctgtacaatgccgagcttgagcgacatgaaaggcagctggttcaagctcccaaacactgtgactgatcggacatgggacaggttcattctgtccatggtttctttggcatgcttcacatcgctgctgtggatggacaggcgacgaactttattactgggtgtccgcatgagccagtgcccgccaaccacggtgataaagttctcctcgctggacttggacatgatgtactcgaggatcatgtcatgaacctggcaggtcttaactttcccgtcgctgctgtgatccacaggcttcaatatgttccttcggatgagcagattgaagtttgtttccgcgcgttccttcatgctctgcccgtgctcctcgctgataaagccttccgctatccatcgcctcgtcaaccgcttcctgctgatcctgctgtcctttgggaacacgctcaggtagagcgagcaggtcttgaggtctgcaggtaagctgctgtagcagtagttgagtatccttgtcatgccttccggggtatggcagtccacggatactggaggcagggagacgcaaatctcggcacactgtttctcgtatgcctgtggcttgcaagccacaagaccagctatggttacaatggccacaggcagacccttgcagaggtccaagattttcctcgagacatcaatgtgcgcctgaccgagcatcttgtcactgctagtcatggattcagacacgctctcttggaatagcctcttagcgtcatcatcagatagacgatccacatgatggagcatgtctttctgtctgtcaaggatgcattcccctgctacggcttcgaatcgtgtagtgaccacaactctgctgccttcttcatccggtagatattgtctgattgtctgccatgcttcggcggaccgtacgtcgtcgaccacgaggatgtagctgccaatcaaagttgatcaaatgcaggaagtcagtgatatgcgcgatgacggagcattagagccaagcttgttagtattgggattccacgtagtattgtttttcttttaagttgtatcggattgtatcgtaatatcaggatactatgaattttcttttttaagtttaatttaatatttatattaattatatatagctattctataaagaaatagagtaatagtaatagatgacataaaaaagagagatttgtcaatagaagacccacccactaatgctaatagttttatttaacattgattttatagatacataaacacaaaagcgttcaaatagttttgatttttaaatttggaaaaagtacgaattacccctctgaactatcacggtcgtccgaattacccccctgaaccacaaaaccggacattcttcacccccaactatgcaaaccggacgaattacccccctggacccaatccacggtggttttgatctacgtcgcagtccagtcagcaatttatttattaaaaaataggtggaccccacctgtcagtctctctcttatat

SEQ ID NO: 44375 - DNA, 2174 bp, Oryza sativa
ccgcgccgtgtgaaggaggagagagagagatagaagagataagagagagagactgacaggtggggcccacctattttttaataaataaattgctgactggactgccacgtagaccaaaaccaccgcggattgggttgaggggggtaattcgtccggtttgcatagttgggggtgaagaatgtccggttttgtggtttaggggtgtaattcggacaaccgcgataattcggggggggtaattcgtactttttcctttaaatttaaatattgtctagtttgaaataattagtatcccaatcccaacgcgattctgattatctcaatactagcgcgataccacccaaaaaagatcctaaaccaacacgtatcattttacccggttagtatcgtagtatcttaccatacgtatcccaatagagacaatcttgcttagagcaactccagcagagttgccaaatggctctctaagctaaaatatggtaagtttggtgacaattgcactccaacagcttgccaaccgatggctcccccactgaccaaacttgcctagccagaaccagcttgccaagcataggccccacgcggcctttatccccccctgccccatctctctctcgccacactgtttccttccccacaagcagagcgcccgccatcggtggtgtgcactcgggctgtctgtagttgcgcgtcatagccatagtcaaaggggactctgccaccgctgtatatggaggaaggggcggagacaacgtgggggcgggggggcggtggggaaaacccccctacccctaatagaccattagagcccccataataccctctaaaattttaatccatatatttatagatgaggggctaatatagactttgtttgaggttgttagaaggaccaaaaggctaagaaggccaaaaaaaaaatcctaacccaaccctaaatctcacttagttgctcttggtcattttggtttagcccctgctataatttcatcctagctccgccacttgcaggaggattctactgccattgccatcatccgatttttgctgctgatgttcgctctccatttttcatctctgtgagctccaacacctctactcgtgagctctgcccccaatccacgcgtgggtggataggataagctgttgccatcggtggcgaggatgggagggtgtggcggtgggtcggctcgacggtgagagagggaggtaaggagcgacagcggagtggcacgccttagacaccgcctccacagcgttgccaccgcctcccctgctggcgtgagcaacaacagcagtagcgtcgccgccgatgtaccccatcgtcgtggttggcctcgtctcgcctcgccccgtcatcgcccgcagtctcttgcgtcgccgtcatcaagatccgtgcgcgccctgccatcattctcttgtgcactagggagaggattggagagacgatggaagaagaaaaaggaagaggagaatgactggtgtggtccattggtatctagagaggtatgtggagagtttgttggagcgaagggcaaatctaactgtaaaattttggcaagctggtcaaataggtatttagaaagacaaaaatgacactctgttggagatgctctaaagcaatatgcacccaaacatgttgtctccaactctattggagagaggtgagcccctgttgtcatgtctgccctagacttaagaaatttcacagttttcccccgaatatgaacccaagagtaggaatctttgttttcttttacttttttttaaattaatacagatataaatttataaacaaatatacatgtatataaaaattttatatacgtataaattttatattcatacgttatacatataaactttataaatatacctataaaagagctttgtatttataaactttatatgtatatttcttaattggctaatataaaataggcaaattttgctatagaacattgtgccttcacggttttagctgtaggacaccgtacgagtgacttttgagggaagacactcttaaaagttagatatttatgggtggacatgacacctattaaaataataatttccaactaaagaggagagagaaattgcgtgaaatgtcaaaaataatagtggacccacatgttagctctcccatgagatagacagaagagacatgagaggtg

SEQ ID NO: 44376 - DNA, 1672 bp, Oryza sativa
  unsure (1)..(1672): unsure at all n locations
tagctgaagatccaagattgggtgaccgcaaagatggatgacgactcaaggccacaaatagcaggcgattctgttaaactgggagatcagtgaaccagattgattttgcttaggggtgtacttgaacactaaaaaaagtgaaaacggtatgtgggcagttttttgttttctttgcgatttgatatttttcttgcgcattcgtggttaccagaacatcacaattgtcaggtagatattgttcaggttctatgtattaatgtactcattactgaataaaaactctccaaccctctttagataacatttggtagaactcctagttgaagtaggaaacatatccgggtcacgaattcagatcaaatacacatgttatatgtataaaagtgtatgaaccgaaatgcagaaaatgagattgaggtacaggtatgcaggaaatgagaatgtatgaccaatgtaggcccagtagatatatatagttagagacggtttgactaatgattataggttattcaggtatctgtagaaagtctgttaattaacagacaatattcttttctttttttcctttttcctttcttcacaacatcataaaagtcccatgtgacatcttctcaagaagagaaatttcacactagtgttcatgctctatttagactgtcttggcttatgccgtatgatcgagttttttatttaagagtacatggtcggatggctagtatagtaaacagagcggagtggctaatgtttgtgtggctgaatatgtgttgtgatggttgtgcaaactgtaggtgatgctttgcaggtccatcttctgctcccctttatatatagagttagtagccattgtacctgtacaatcttgatgatgtattgtgcctttaaccgctgatgaaggttgatgatgcatcttttgaaaatatcgttcaccatgataccccttttgacatcttaggatatttattccaatatatcttattttcaaattaaaagtagcctcctaaactttcatcggggatcaaaggaattatataaagaagcttccataatagctaccgaggctttcataatagtactagctaccacctaccaaggcttttatacaaaggaatttcatcagcaataaaagagcactgtcatcgagattctccataatgggtagaattttgtttttattttttgcactttttattttttttattcttaaaaataaatcctcataaaacttatttttagaatctaaatcgtttggtctgacgtgacaaaacaacactaacacttagcaggcatgatatttttgttctaccacgctagtaaggttgacgtgaccaaataacgttgccacgcttatcaaactgacctaacagcgttgttttcccacgccagttcgactggcttagccaaaaggcatgagaatgtattttgaaaggcaaataaattttggaaatatttacctttcaaaatatctgccattgatcgctagctccaatataaattgaaatggaaattgaagtcttgtcttggaaataaattatgaaagggtttatttttaaaattaaaaatagaaaagttaaaaaaatatctaatggcgaccaatgtgagaaggaatgcaaggcatnnnnnnnnnnnnnnnnnnnnnnnnnnnnnnnnnnnnnnnnnnnnnnnnnnnnnnnnn

SEQ ID NO: 44377 - DNA, 1682 bp, Oryza sativa
  unsure (1)..(1682): unsure at all n locations
ccttacaatgctttggccctatggtgaaggcgtcaagacccttggcgaatccttcctgcttcgcctgatgttcgcccaatgtgagaacttgattcttcggttggtgcttcaccctggtccatgtaatttcggtagcctcggttgaaggcccttgtgatatacctcaaacattgggtttgtggctaggggtggctaggggctgccacgttgtgggtataaataaatgaggggttgaggctagaaggtattgactttttggagggaaaagttaggtttcgcttagaggttttaatactagtttatgagttgagagaggagtgatttagatacactttgtaaatacatattgatgcaataaagttgatctacattcaatagtttcgttgatacgtgctttctggatcttgacggtttaactgaagacagaggagtggtctgactggaggcttggtggcggtctaaccgatgacagggcagcgatctgactggcggtgacacggtggtctaaccgacggttaggtggcggtctgaccaatacatcttcatcaggtatttgagggtaatctttaagttccgtaaaaagatttggtttttgatgttcctaccattcatctttctctggtaggtttggttttgttgtgcgatcctacatacttgtcactgtgaattcatagctcaatgatgttttaagtatcacttgtaattagttcttgtaatgagccggaatgatcgtaataagaatagacagtgataccccaagtatcaccgctggtacacgttattcctgtgaaccggtttttatgatcgtaacaagaatcgaaagtgtatgaacgaggagtgatgataagacatgtattgatgagaaaactgaggaaatgttttctttggcatcaatttttatggtactaaccttgaagaacagggaccctcgatcttcagacttagtttgctgacttcgggactatagcagcttgcatctcttgagcgacttgtttagatcttgttgtgatgagaatcgggctgcctgcttgagcgttgcccacaaatgattttttaaaaatgtccaccacccctctagcttcccacacatcatccatcacaaggaaaactttctttcttcttacttcactgnaaatgatgtgctccaatactgcgctatcacgaataccttcatgctcacacccaagtccttgtataacctgttgcaatagactaatactattattacctttactaatagtgatccacagtctcttgtcaaacttcccttggatcatatcgttagtgaaaatttctctggcaagggtggtcttgccaattccacccatacccacaattgcgatgacttcaacgttttgtccagtcatccctgggcctgagatgcctttccctgtaagcttatcaaccagcattctagtctcctgcaccctccccacaacattagttcggggaatcggaacatggcaggcagtagtagcatcacgttgtgatcttcatcagatctgacatgagtgaggtcgaaaattttcccctcctccagaattgcatccgccttctggcgtagtgccttaacttgccgcctgattttgtggccctgaatcggtaggcataaggccaccgggctgttcctggagcgaccaccatgttcttcaccctccatttcgtcacagacatcaagaata

SEQ ID NO: 44378 - DNA, 4709 bp, Oryza sativa
tcaagaatatcagcggcctcgtacatgacatccttcagcttcctcgaccaagacctcactgtatcatctttcagggcactgtagtcagcatctgcaagtgtcttcttgatggagctcaccgtgccctttaaccagttgatctcatcagaaacaccaagctgcatgaacgcctcaatactgaatttccccatagtccgtgcctgcaacaaactaggaaatatcatgcattgccaactagctagctaagctagctactttatctagcaagtaagttcttgagctaaaagtagcgtagccgatacacacaacagaccattactgacccaaccaaatgattcgccgagtaaactgatatttacttatttcaatacgaacaacccggaggtcagaaaatgattttctgataattaatctaatatagtatgatataggtatacattgcatctgtaaatatatagtatttccagatctggatgtacattatgtgaaaatcttccagtgaagaaactgtatcttcttaagtttgagctctgttgatccatcattccatctaacaatatatatacaattgattcgcttggtcaggtagtaagtttaacgaactaagctgaccaaattttgcccgagggctcagtgaagtgagcaagcatcggcccaaattaaatgtgttcgagagctcaaacaaatagatcaaataccaagtgtaaaaattaagtagatctttcattgaacgaaaacatatattcttcgtagaaaatgatgagggagatatatcgcccaaaaaacaaaattctagaaccgcagaaacatgcatcctcgtatcaggaagaaaccacactggaagtggaaaacaaatcaaaagtccgacacaaatacctgagtggatgcgtcgtcctttggtgtgatcgatttggggaaatttgggcgtgtggctagctaggacactgtccgggattgggagttttgggagtgcagactgcgggggctgtgtgctgtatatgtagttcgaaagatacgatagagtgggttatagcctgcatatatgctgattcgtccgtccacaattataagggatatctttcaactgaaatttggtgcatacaatgttcctctgttaatgtatggaggtagtattttctatttgtaatgagataagaagaagaggaagattgattgccagctagatgtttttttttactacttttacatgtgctttagaaatacaatcttttattactagtatataatacgatgaattgtttcccactaacttacatttattgttttttatctactcatgtggccatcatcgattaaatgaattaggttaatgatatacgacagggtctttaaaattgcgagttggtgtcagttaacttactgatcttgtaaaatgcatatgtagaaccatagtcttaccacaacaggttcaaacctcgtctgatcatgtaggattgcccgacatgacgctccatgctagcatacattttgcatttggccccctcggttggaggacaggttgcacaaaaggacgggttgtcggctccatccacatccagcgaagccagtgcttgagcacggcggatccagcgattgctcaagcaacgtggagacggcctcgcttcacctaggattggcaccgttgatgctcaggggcagcgctggcggtcgagcaccatggatccggccgtgtggatgtcctcctctcctgtcctatagataatagatctggtagctggagctcaggtcgtgagatccgccgacgacagagctccaggtcctcatcaatgcacgtgcatctcttatgtgcatacctccgtcggcttcacctcatgcatacctctttcatcagcttcaccaccagtgttcctgcccgctctcttgtgcaacccgtcctcccgccgagggggccgaatgcaatatgtgtgacgatggtgtgatcccaatcgtctaattaggctccatatagattcgatgtcataaaaaaaatcaccgtggtttggacggaagaggatatcataaaaaatcgtctgagaaatgagggactaatagtgaacgttttcgtgagcaagtaactaaaatccaaccttggctatagttatgaatcaaatgtgaacttatcttgatgataaaagaatattcatttgggagaaatcgatcgaaactaattttgcatatcttggtgtatccggtgacatgttcccgtagtcttgagttttttttaagcatttttacggtccttgagaagatactatgaggtaccactttttctattgtaattttggtacctcttggtacttagtacctcttggtacttagatactatgaggtaccaaattttacgctaaatttttggtacctcgtgatagcttcttaaggaccatgaaaatgcccctttttttatagtgcatagattcacgaggtcctacattgaaagaagatttgaaagtgatctttaaagtttacaaataaagcagtaacgtgccaagatttggagagaagggaaacggctgaaatttgtgctagctgtcatcatcgttctagagctttctcaaatgccatttgctgcaagattatttaaagatcaacttgggttatgcatgcatcaaagttgtcagcaaatagtctaggctgtctctttctttagctttttgcatttgttttgtggtgcggtatgccccataaatcacgctgagagctggatgttgttgttgctttgcactcggaacaaccggtccgcattctccaggcaagacaatgatatctgtggaaacgtactagtattagacccaactcccctaatgcacacaatattaattcaacatgttgatttaatacaactaatctctcactgtgttccgggtgttgagtagaaacattcactagtagaaaaaacctgcctttattggtgcccgttctaaacctctcataggtgtcagttttcaaacttgtaccaatttagcgacactaatggaggtaatcattggtaccggtatggtgccggtttttatttagaaccgacacttgtagggtgaatccattttttacatttgcagatgtgaaaaaatcaaaaaaaatatttcacattttattaggcacctaccacatcacatttcacttatcacaagtcacataattcttttcaacccatattcatgaaatgtgccaagcttgattcaaacccaagacctctgtctctattcgaagcatctcttatgtgcacacttccgtcggcttcaccacagtgcacacctccttcatcagcttccctgacagtgttcctgcccgccctcttgtgtaacccgtcccgccgagggagccaaatgcaatatgtgtggcgatggtgtcatcccaatcgtctaagtaggctccatgtagattagatgtcataatacatcatcaccctggtttggacggaaaaggatgaaacatgaattattctgagagatgaggggcaaattgggaacgttttcgtgatcaagtaactaaaatctaaccttggctataattatgaatcaaatgtgaacttttcttgatgataaaagaacatgcatttgggacaaatcgatagaaactaaatttgcatttctcggtgtatccggtgacatgttcccgtagtcttgaattttttttatagtgcatagattcacgagatcctacattgaaagaagattttgaaagtgatctataaagcttacaaataaagcagtaacgtgccaagatttggagggaattagggaaacggcgcctgaaatttgtgctagctatcataatcgttctagagctttctcaaatgccacttgctgcaagattattattaaaagatgaacttgggttctacatgcatcaaagttgttagcaaatagtctaggcgcgctctgtctttctttagcttttgcatttgttttgtggtgcgttatgccccatacatcatgctgagctggatgttgctattgcctgcactccggaataaccggtccaaccgtccaagcattctacaggcaagacaatgatatctgtggtttctatattctccgctctaacttagaaactagtattaaacccaatccaactcctctaatgcacacaatattaattcaacatgttgattataataccactaatctctcaatatgttctggatcactggatgttgagtaaaaacattttgttctatttcctcctaattttttttgtcacatcactacaaatacaatgtgtcagcttatttagttcatgacgaaaatgtacttagtagagcactggaactagtattaatcgtgaaagcaagctacatgttgcatggttcaactatatatctattctagcatcggtggagttagttggcacatggaattagcactttagcaccgtggtcactgtaaaattaaggagttgatttaggttttgtgttgaaaatattaatggtttgctaatgttaagttggagattttataagacgattgattttgtgaagtggatgttttcggttgaccctggcggtcggaccggctgagtgccgccggtcagaccgccggtgttgcggcggtcagaccggccggctcgacggtctgaccggtaggatcctgatcgtgttcggtttcgggttgttttgttggatttggatatttccttcggggatttggcttctagatggtttctatgcgtatggttactgttgttatactaatgtgagtcaagttgggacg

SEQ ID NO: 44379 - DNA, 2794 bp, Oryza sativa
  unsure (1)..(2794): unsure at all n locations
gcgacatatccctaaagcaacaatgttgcatgtacgtccgacggtcgccccgatcccgccgatgaggccaattcaggctccaacacctcaagctttggtggaggccgcttcggctctccaggcacaattccaagctttccttcaacaattgagtcaaccccacatgattccaagtgtaaccccttcggtccaaggcaatgggggatcgagccaggacgctatggcatggcagccgacgaaccagctccacatgtgcgcaccaacccaagcgccttcggcaaatccttaaggaacaatggctggtcttggcagtattcgaaaagttgttcaaccaaacatcgtggctcagtcacatgacattagcttcgccatttgcacaaccatacctaggcctcacatcgcagtaccagcaaggcatggcgctgcgggcagagggtgacaaggtatggcgctgcgagaaatcatctgaatccccccccccctcccagttcaagtactcaccagtgacaaggtactcgggtgaaaccaatccaagcaagttcttgtcgatctatgagtcagcaatcgaagctgtccacggcgatgaaactaccatgtctaaggtaatacatcttgctttggacgggatcgcctggtcctggtattttaacatgcctccaagcagcatttacttatgggaacaattgcgtaatgtttctatcatgaacttcagagggacgtataaggagccaaaaaccaaaccagatttgttcggcattcggcagaagctaggcgaatctacaagtgagtacgctaggcgtttttcacaagcaaggtgccaagtgcaggaatgcaggatatcactgaggcctctgtgatcaatgccgcttcagcaggccttcgcccgagcaagctgacaagaaaaatcacaagaaaagagccccagattgtcaaacatctgttccacatcattgacggctatgcccgtggcgaagaagacaccaagcgaaggacccttcaccttcacatgcattgttctctagcctgagcatccctcaggatatccttgactacatagacctcaacttctcccaagcttagtctcgacccatcaccggctatactctcacggcctcaagtaacacatgcacataaacaacanagaaactccatatctgagtacaagttcgcaccaatttgactcacttcagtacgcaatagtatcacatacgaatagaaaccatctaaaagtcatatacacgaagcaatctagatatacatgaagacagatatacaaacgcaatggcaagaaaaacactccccttttcaaaagaaagaatttcttgaatctcttcccctatatttgcaatcaaatcacaaaatcgacatatgatcaaaactactacctcaaacacaagcatatgaaaaaactaataaacgaggaagtagaaaaaaattatatcaattcaaaagtatattgatgttacccagaaaagcaattgccgtatcaacattgaatgcacatggggagtttgtcgccgaaatacctccaaacaagaacataccgaggcctccatgttggggttagaaacaagaaattttgaaatccaacaccgagtcacatgaccaatagaaccagtaggtacatatgcacgaataaaatcaaaaccagaattacctgaaaacttatcttaatgtttcacaaaagtctgatttgaattttgcatataatttgccgagactggtctgatcactgttctctagccagtctgatcaagcctggttgatctgacggactcgcccatgttagtctgaccatactcctctaaccaaaactcgatttttgccacctttgtttcgcataaaagcaatttctctttattttttctattacaagcaagtccaaaataaaaaccatccaaatatccatcttttccataaaaagaacaagtgtacttctcatgcaaaaaaattttttgaagttgatggtgtagaaattaatagttctgcaattaaagattttgtttcttgtattgttgaagaaagagatggcaaaatactaacagatttaaaaactgttttctctagttcagtttttttcaaagtttcacctttttaagttatactcaaaattgcaggttggtgacatgtataatagacattagtttcaaaacctacacaatgattataggtgtgcacttttgatttatcaaaatcatatgaaatttctttttaccagcagaatacatttccaaagtttttttttcaaataagaaactttttttgtcaaatttgcacaattttcgcaaccaaccaaaacacctttgttgttgtgacacttagaacgagaaagcacttcatgagttttcaaattgttttacaaaagctctataagggaaagtgcatcttttaatttcatctcattccaaacacacttcgagcaattttgagaatccaaaacatccttatgttgtttaatcatttttgcactcaaaaacattgaacaaagaacttacataaaaagcttatatttattcaaaactttccttatcaaaactaattcattaacaattcgagcatgcaaagcaaatctaagagcaaaagaagactcgagctttttccttttgtcaatcttagattccaatcttaagcaatgtgtagtattaacttctcttattcgtgaatttcagaaaataaaacctcataacttttgcaattatcatcatcaggaagaagaccttttaatctagcgacttcagcattaagagaatcaccaatgaaatcatgttgtttaagtttttctcgtatttttttt

SEQ ID NO: 44380 - DNA, 1908 bp, Oryza sativa
ccgcctgttagacaacggtgtcactgccggtcaaactattgccctgccacctccaagcctttggtcagaccgctcctttacctttggtcaaactctcgggatacagaaaaacatgtatcgatgaaactcttgaaagtagatcaatcaatagtttcgtctaaatttgttgtgtgcgtatggaaaagaggagttgaatttgcaaagtgcatctaaagcactcatttctcaactcacgaactagtattgaaaccttgaagcaaacctgtcacgcccggaatttctatccaaaattccgaacgcttacatgcgtgttaaaccctcgtccaggaatcaaccgaggcacacaataacaaattgataatagagtacaaataaataactatttaatattcgtaaataataaatcattacagaggtggatagttcctctcaaagaataacattctacgcagcggaaaacaaaactaaaacaaactacggaacaactatggcgactccactccacaggcatgtcaaccaagaacaagcttaatcctccagatcatcaccttcgctgagatactcctcttctgatgaatgaatattgcaagaatgagcatatgacatactcaacaagccacacagcaaatatgcaagtgcacaggataacaaaggatggcataatatagctcatttgcataaacagcatttaatatttaagagaatagtaaaacagttaagtaattagtcaatattaaataaacaccatacaacacacccgtgttgtataggcccaacctcatatgaacaaccaaccccggttgaacataccaaacctccaaaccaggaatataccattccaaaccaggagtcacattaatttaacacagtttaccatttaatgtgtaatatgagactaatcacgaaaaacattgttcaactcacccataaccgcgggtaccgctatttcgaatagattaactcttgatcagaggtgtaccactgtacccacaagacacaatcccacaacatgttaccatgcgccttagtaccaccacggtacctcggaaaggaactgtgacattacccctcgcacaacacaactcaccacagtgcaccgttcctggatcataatctccccctcaaaatcagaggcaatgcagcgacccccacggacttctcgccgcttcacagtctggcacactataatgaatcatgctatacaaaagataaagccgttgcccacgctggcttgtggttggcacggtaaatgtttcacaacagtagctcgcgaaccggtccttaattgtcatgagcacaaccatcaaaaccatatgctcacaatccaccttaactaggttttaattatccattaattaacctcacacaattaaccatcgtgagctaccattgaatataaccataattaataataataatataatatagtttataattaaccccttgagttagctaatgtgtctaagcatggctaagcaaacatacatatagcatttagctgaaccaatccaatatataaggttcatgctaatcaaattataacccataggaaaataaagtcatcttcggccattacttatacgggaaaaggttcaccacccgatgatattcgaaaacaatgcatagttgaaataaaataatagctttaaatgggttcaacatgctcaaagggttgtttgggatctgtgtgacttgccttgggcttccgcaaacgcttcggaaccttcctcgacagaaacgctctcctccggaacgtcggaaactaaagaaaaaatgctaaaatcaataaaacagtacaaaaacaagcataaacagtacatgtggatatttttaacatgtagatcttgattttagaaaactttagcaacttgaaccacctgaaacggatctacggttatttagttatga

SEQ ID NO: 44381 - DNA, 4316 bp, Oryza sativa
ggaaatcaaaaactcggttttggagataaactcaaaaacgagttcgattcggataaaatactcaacgatttgctccgatttttgggggtaaagatagaggaggatgagaggataaaaacccctcaaaaatccggaagaaaagagtagagattggggcggattcggaggggaaagggggcggctcgggcggcatgggtgggctcggccggccggctgctagaggttagggaagcgtccgacatgtggggaccacatgtcggtctcccgagtgcagggggcggctggcgggttggctgggccggctgggccgacttggcgcgggcgagagagagagagagttgggccaaaaacggcccaacaacttaaggaagggattttggaactttttaattaaaataatttgtgaaatgttgttccaattattaaaaatacttcccttgctcaaataattcccagaaaattctagaaaatagagaaacaagcaaagtatttaataaaattttatctagcttgtttttatgttaaaaattttcctagattattagggtttagcttgtaggcttttaatttaatttctaaaaatgacttaaacaatgcgttttaaaattaggcaatttttagggcgtgacaaaaccctaactttttttttctcaaaagtcgatgcccttctagcctcaatcactcatctatttatacccacaacatggctacccctagccataaatccaactagaactagaactcctaatcacataggaaacccaccaaaccaaggaaacaatatcccatacaacttcatacttcaatctttctaaacttggactccaatccaaatttaactcctctttccatacgcacacaacatcatggaaacattcacctccacatgcattgttctctaccaagagcatcccacgtgatatccttgaatgtctgaacctcaacttctcccaagtctaatcccgatccatcaccggctatactcccacggcctcaagttacacctacacatgaacaacaaagaaactttatatttgagtacaagttcacgccaacttgactcacatcagcatacaatagtatcacatacaaatagaaaccatatataagtcatatacatgaagcaagctaaaaattccacgaaaacaactcgaaaccgatgccctcctgaagtttgcaaattcaaaactttcagttcaatttttttaaaactttcaagtcaaatattaaaaaattcaagtcaaaagttaaaaattttcaactcaagtttgaaactatgaacttaaaatttaaaaactttcaagtcgatatttgaaactttcaacccagatttgaaaattttcaactcgaaatttaaatttttgaagttaaattttgaaaactttcaacttttcatctcaaatttgaaaaactttcaactcaaatttaaaactttcaacccagatttgaaaactttcagcttaaatttaaaaactttcaactcaaatttaaaaactttcaagtcaaaattaaaaacttccaattctacatttgtaaagaggttatcagaaagaaacagcgctaaaaaaagaaaaaaaggtccggaggcaccaaaatcgggaaaaaaagtacgaacataaaaaaacgcacggtgaggcgggccaagtggggcgcgcgccagctaaattgctagcgcgtatgcgcgcattagcaacccccgtttatccccaaatccgtatgaatcagttccgtagccagttttgatcatattatcaccaagatcaaaagctacatcattcgcgatccaagatcaatatgctacctcgacaactgtatgtgcacacccaaaccttttttttttgggtccgccactggtcgtattaatggagataagtaaggaatctgatacaaatcaaatctaacctaaaatatcaaactaccaaatactgtaacaccgttagtccatttgagatttctcataattaatatcacatttattttatggatgaaatgaaacccaatggtatagtatagattaagagcttattaataatttgggatttaattggtgcaggtgattatgaggaagaccggccaagatgagaacgagagattaaaggaagttaaagagaagatcatagcaaaatgcaatggttcaccactagcaataatcatgctggcagggcggctcttggtaaacagaaaccgaagcgcaaatgaatgggagatgcttttggaatacgctgcagagccaacagatcatggagatattgacagcatattccacctgtgctatgcggttttgtcatttcctttgaagcagtgcttcttataccactcgcttattcccaaggatcatgtgatcagctgtgacaaagttgtccagatgtggattgctgaagaatttgttggggctgatgctacttcagagttgccagaagtcttggggatgaaatactacaaagaattagttgcgagacatcttttggaacctgttgacgagtatgatggccaaggtcattacaagatggataacttagtccatacatttgctaaaaatgtagtggaaagtgaatcattagtggttgaagagggagaggaaaatcctgacccgttcgacgtcgaagaggaacatattcgacgatcttgggcagcaaaagagaaaattgaatggaaagctccaaaggagctacactcattaaggacattaatcataattggaaatgttattgttcaggcaagcacaggcagaaccttgagctccctttcaaggctaaggacgctacacgttaacaaaaatgaacatgtacatatccttctcgatagtttgcatcatatgaaacacctgagatacttggacctgagttacacagatgcccttgctttgcccaatgatattggtgagatgaagtttttacagtacatttgccttcaaggctgtaaaaaattggtgaaacttcccaagagcattgtggaactgcacaagttaagatatctgaatatctctgagacaaaaataaagtcaattccagaagaagggtttggtggactgaagaatatggtgtcactgcatggtttccccagtcagatgatggaaagcgtcatagcaaaagattggtgcagccttggggagttaaagtatatgtcccaacttatgcatcttgcactagagggtctggagaactgtgcttccggctcaatggctagtcttgccaaaatcgatgataagaagaatcttgcatttttgaggttaaagctgcacaaagtagactgtcggttaacggcgaggtcgataaggagacagtcgaggaggtgtttgatcagctttgccctccacccaaattgcaggagctaaatattaagggattctttggagctcgactcccgagatggttgatttttaccaaccttgcggaactgagggtattaaagctagacaacttagtatgctgcaaccagcttccatctactttatggcagctcccttgtttggagtacctctacataaagcatactctgaatgtcaagcacatcgggcatggattcctcctccagtcatctatacctggtcctcgtgaaaccgacgttgcagcgacaacaccaacagcagcaacatcagcaactgcagcaacagcagcaacaacaaccaccacaacaattggaggaggtagtacccacaaccgggggccctatcatcggctttctggtgctgggtcagttggttctggcgaggagggagagattgtggctgagagcgcaacagaagacgcagcaacaactacgggaagcagcaatgcaattggcttcccaaagttgaagaaacttgttatgtatggcatgatgaaatggaaagaatgggagtgggaagatcaagtggaggccatgcccaagctagagaacatgcatatcagctggtgcctactgaatcaacttcctcctgggcttgcatcccaggcaaggtctctaagaattttggttgttgataatgtcaagaacctcatctccatcgatggtttctgttcagttgtccagctccacgtctcctccaacttcaaactagagaggatcagtgatcttccaaaaatggaaagcctgacagtttccagatgcccaaagctgaatattctgcagcgtttgccagcattgcagagcatggagttgaatgaccaagagatggaaaggctcccagattgtcttagagatcttccagcaaaactacgtcatctgcggatcacttgcaacttggatcttctcaccctgatctcccgggggaaaggcacccccgagtgggagaagatcaaacacatccagcaagtgaatgcctgtacagatgcgga

SEQ ID NO: 44382 - DNA, 1510 bp, Oryza sativa
agtagtaggaacacagtgaactacacatggacgagtacagacagattttagaaacacaatacatatagagaacatatccatgacagacatggctatgttaattattttaaacggtgcaaactaaataccatttacctgttgtaaacttcatctgcaatggtatcacggagtgtattcattgccgccgctctgttaggtacatcgttccagccacgtagggtggagcatctgaaacgatggggtatccattgtacaatgggttctgtgtaaggaaatacatgtcggagctgtcaatcctgaagttatgtagaactaatgcacaatgtatgatcttggtatggtcgtcactcctaaggaaataaggtatttccctcaggattctcactggcttttgataactccaaatgtcctttccactatgttacgctacgaactgtgcatttagttaaaagtatcttcctttccatggggcaaggctgctcccttattacccgcaaattcatccaagtggtaccaaacatgtgggtaaggtggtaggaatctataccggctagcatatcccgagtccacaaggaaatatttccctgcaccaacaaattagcgaagtgattatttctggaaaatggacactaacatttgcaattgttgaacctaaaattcaaaacataccccatggtagccttgggaaaacaaacggatagccccgtactgcttctgttaggttgatcatgcacagaccctagccacccaacatctgcaaaaatgacacggtcgtccaatccaatagcgacgaacattcctagaagttatgtggtgacggttcctgtgttgaatggaatcatccactgccacaatgcaatgaatgtgtgctccatccactgcaccagccgcaccagcaaatggctggaattcttcatcattctggacacgataatgaactcttgcaaagttaggatctaccggcttatttatgtcagcagcataaaccgcattaagcactctatggatgtacttagagacagtagacccagatcttaccatcctattattagtggccctatttgaattgccccccgccatgatgtacaaaaatattccaagtgcttccattgggcatacctcaattgatccatgaagattgtatcgattagtaagtaacccaaacagagcatggatttgatctggcatcagacggaaaattgcttggcattgagatgggttttccattgtctccatcacccattccattccagattgttgcgatacccaacgtgctgccctcacacatagctttgccttcaaaaccgcaaccaacatgtccagaaaggagtcctccccccccctgtagtagccatccttagaaccatatgatctttcagaagtgctcatgttcctatatcaatacatgacaaagtaaatcatggttaagttagaagcctatgtgctgcaatgacaaaatgattctaagtaggtagaaatcgaaaggttagttcacattattaaagtactg

SEQ ID NO: 44383 - DNA, 1964 bp, Oryza sativa
agagcttgagagttcctaccctcttgagaaggccgaagtgttgcaaaagatatacatgcccttggaatccagttacaactattttgaaggggatgagaaaaaatctttgttcttgttgggtagctttgttcctggaggacacaaaataagtaaaaatgagctaacaagttactggacaggagaggacatcttcaacgagttcaatactttagaggaaaccaggcgaaaattacacatgaggatcacagatatagaagactcttttctgctgttgccaattaattataccaaatgtgtcatgatgcacgatatagtgagagatgtggcagtttttattgcctcaagattctgtgaacaatttgctgcaccatatgaaattgctgaggacaaaataaatgagaaatttaaaacgtgcaagagaagtatcatttataaataccagcatcgagaaacttactgcaccagtatgcgagcacctacagttgttactgctcaggaataactcaagtctgcatgaacttccagagaacttctttcaaagcatgcagcagctggctgtcttagatatgagtaattcttccatccattctctgcttctctctactaaagacctagcagcggtccgaacactgtgtctaaatgattcaaaggtatctagaggcatttggttagtcagtagcttggagaacttgcgagtacttagtctagctggttgttcaattgattcacttccagaacaattgggaaatctaaagaagcttaggctattggatttatcatcgatggaatcccttgagatactggagggactaatttctaagctacgttacttggaagaactgtatgttgacacttcaaaggtaacagcatatctcatgattgagattgatgacttactacggctcagatgcttgcaattgtttatcaaagatgtcagtgttctctctctaaatgatcagatcttcaggattgattttgtgaggaagttgaagtcctatatcatttacaccgagttgcaatggattactctggtcaagtcacaccgaaagaatctatatctcaagggagtcaccaccataggagactgggtggtagatgcattgctaggcgaaatagaaaacttaattcttgacagctgctttgaggaagaatcaacaatgctgcatttcactgcaataagctgcatcagtacatttagagttctgaagggggattcaccagagtcgaccggcctgacacaccttgtctggtgtgacgaccagaaacaatttgcatttcacaacctagaagaactccacataacaaagtgcgacagcttgaggtgtgtgatccacttccagagcacaagtaagaacttgtctgcgtttccttgcttgaagataatccaactaatcaacttgcaagaaactgtcagcatttggagttgggaaggaaatccaccaccacagcatatctgtccaaacctaaaggaactcaatgttcagcgctcagaaaacttgactttgtccttgttgcaagagtagctgctatgcttagtaatcttgagaggttgacactgaaaagcaacgtggctctgaaggaggtcgtggccgatgattacaggatggaggagattgttgccgaacatgttgaaatggaagaaactgttggaaacgaaattgtcagtgctgataccagatatccggcacatcctgcagatgtcggtgactcgttggatccagaagcatttcctagtctaactcatctctctcttgtggatttacctggaatggagtacttctacaaggtcggaggtgaaatcatgagattctcctggaaatcactagtaagtctcaagctgggaggttgccactccctgaaagggttcccaatccatggtgcaagtgctccaggactgaagaatgttgagttagtacataatggtgataaaagctggtaccaaacgctgatatcacaggatgcat

SEQ ID NO: 44384 - DNA, 1381 bp, Oryza sativa
cggttcttccttttagcaatcccattagactcgggagaatagggaggcgtcctctcatgtatgatgccatgttcctcacagaataagtcaaactcgtttgagaaaaactctccaccacgatcaaacctaagcctttttatctttctatcaagttgattttcaacttctgccttataaattttaaaatagtctagtgcctcgtctttcgtttttaacaagtacaaatagcaaaatctagtagcatcatcaatcaacatcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaaaacatgctggaaagccgagacatcaagccaaaattgatatgacataaacgtgagtgccaaacattagcctcatcatccacactgccacaaatatggttcacagatttattgcagaaatcagaaagggaaaagcggaacaggcctccgcactcataacctttaccaataaaatatccatgtttagacatgactactttattagactcaaaaaccaacttaaatccgtctctagtcagacgggagccactaacaagattcctgtcgatagaagggacatgttgcacgttcttcagctgcacgatctttcccgaagtaaacttcatatctaccgtgccaacaccatgaatagaagcatgtgacccattccccactaggacggtggaaccccgtgcgacctgataagaagaaaacaatgagatgtcagcataaacatgtacattggccccagtatcaacccactaattagtagactgattaactgaaaaaacaataggtaaattaccatacccgcttcgatctccagtgttgccaatggtcacattagcagacttagaagtctggcttgtaggtgtcttcatccccttgcgctgtggacacttcctagccagatgaccaggttggccacacacaaagcaagtcctctcatcctgattaggattattgttgttcttcttctgcttcttgaagttggtggtctgttgagctttgtatttccccttctcttgttctgggccttatgcacaacattggcactgtactgcccaccatcgcccttagacacaacatctttttcccgagctttctcctcaacatcaagagacgctatcaacccctcaacggagtattcctatctcttgtgattcagtgcagtaccgaaacttctccaagatggaggtagtttcgcaataatgcacccgaccacaaatttgtcgggtaagacaca

SEQ ID NO: 44385 - DNA, 1273 bp, Oryza sativa
gaagtcgtaaacgcccaccagcggcggcataataggccacccgtgtaggcggaggcaccaatcgccggcgacgaagccagcccggtggtaaagtcgtaaacgcccaacagcggcggcataataggccagccgtgtaggcggaggcaccaatcgcgccgacggaggcaagcccgtcggtgaagacgtagacgcccaacagcgccggcataaaggccagccgtgcaggcggaaacaccagtcggcagcggcgaaggcaagctggtggtgaagtcgtagacgcccaacagcggcggcataataggccagccgtgtaggcggaaacaccaatcggcggcgacgaaggcaggccagtcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggtggtgaagtcgtagacgcccaacagcggcggcataataggccagccgtgtaggcggaggcaccaatcggcggcgacggaggcaagcccgtcggtgaagacgtagacgcccaacaacggcggcataaaggccagccgtgcaggcggaaacaccagtcggcagcggcgaaggcaagctgatggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggtggtgaagtcgtagacgcccaacagcggcggcataataggccagccgtgtaggcggaggcaccaatcggcggcgacggaggcaggccggtggtgaagtcgtagacgcccaacagcggcggcataataggccagccgtgtaggcggaaacaccagtcggcagcggcgaaggcaagccagtcggtgaagacgtagacgcccaacaacggcggcataaaggccagccgtgcaggcggaaacaccagtcggcagcggcgaaggcaagccgatggtgaagtcgtagacgcccaacagcggcgg

SEQ ID NO: 44386 - DNA, 30849 bp, Oryza sativa
tgaagacgtagacgcccaacaacggcggcataaaggccagccgtgcaggcggaaacaccagtcggcagcggcaaaggcaagccggtcggtgaagacgtagacgcctaacaacagcggcataaaggccagccgtgcaggcggaaacaccagtcggcggcggcgaaggcaagccggtcagtgaagacgtagacgcccaacaacggcggcataataggctagccgtgcaggcggaaacaccagtcggcggcggcgaaggcaagccggtcggtgaagacgtagacgcccaacaacggcggcataataggccagccgtgcaggcggaaacaccagtcggcggcggcgaatgcaagccggtcggtgaagacgtagacgcccaacaacggcggcataataggccagccgtgcaggcggaaacaccagtcggcagcggcgaaggcaagccggtcggtgaagacgtagacgcccaacaacggcggcataataggccagccgtgcaggcgggaacaccagtcggcggcggtcgaggcgagccggtggtggtgttctgactgatccattcctggagcgtaagagataagcttaaagccatgaatcccttttatgcatatctggatctggatcctgcagaacaaacatataggatgagtagtatctgatataaatataatactcgagaaaaattcaagcagtttaaaatatttataaatatgtatttctcctcttgtcaattttgatttccccgaacagatgactcattacgtttaagcactctgcccgactagtcatagccaccaagcactgggagtcggcctaagcacttcccaaacatgcatatgagtgtcatgagttcgtcattaatggaacaaagtttcacggatcggagtttactactcgggtacttttgcaattattaagagcagaaaataaattatcttatctctatgcttttgatttattctgaataatacttagcaccttgcgttattcggtccatccaacgagcccccgggtgctaggaatcggcccaaaggcaaccatccattggcaaaccgaacagaaagcataggaagatagaactccataactcgataggtacttttgtactcagattatgtcgcaagcaatcaagataaatattatgaaaattgtttaaaaaatacgatataacatctgtagcccccgactcactactcaatggaagaccaattggtgtagtgaggcagaggaaaaggcaaaatatcatataaagaataaaataaatgatgacttagctttgtaatattccccttggtgatggcagaagtggccaatatgggaacaaagtcgtccatcaataacaatgaagacaccagtcggcggcgacgaaggcggtcgacggtgaaagcgaagacgcccaacagcggcggcataataggccagccgtgtaggcggaggcaccagtcggcggcgacggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggtggtgaagtcgtagacgcccaacagcggcggcataataggccagccgtgtaggcggaaacaccagtcggcagcggcgaaggcaagccagtcggtgaagacgtagacgcccaacaacggcggcataaaggccagccgtgcaggcggaaacaccagtcggcagcggcgaaggcaagccgatggtgaagtcgtagacgcccaacagcggcggcataataggccagccgtgtaggcggaggcaccaatcggcggcgacggaggcaggccggcggtgaagtcgtagacgcccaacagcggcggcataatggccagccgtgcaggcggaggcaccagtcggcggcgacggaggcaagccggtcggtgaagacgtagacgcccaacaacggcggcataaaggccagccgtgcagacggaagcaccagtcggcggcggacgaggcggccggtcggtgaagacgtagacgcccaataacggcggcataaaggccagccgtgcaggcggaaacaccagtcggcagcggcgaaggcaagccggtcggtgaagacgtagacgcccaacaacggcggcataaaggccagccgtgcaggcggaaacaccaatcggcagcggtaaaggcaagccggtcggtgaagacgtggacgcccaacagcggcggcataataggccagccgtgtaggcggaaacaccaatcggcggcgacggaggcaggccggtggtgaagtcgtagacgcccaacagcggcggcataataggccagccgtgtaggcggaggcaccactcggcggcgacggaggcaggccggcggtgaagtcgttgttgttatcagcaatggcggtggcgaagacaagccggcagagtggacttgcggccgatcgaccggaaagctgagacgcctcgagtccatgaccagcatcaatcgcctcaatagtgccgcgtaattatatgcgaacaacaacaaaaaatagcaagagattaatctaggattaaaaatcagtacgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgcttgttgataggaaactcgacgcaacccctacctggcgcgccaactgtcgaaacatggattcggcaataataaaagggggtagcgcacgagacctaaaagtggatggatgcagagacaaaggatttagacaggttcaggccctctcaatgagaggtaataccctactcctgtttggggatttgaatccgccgagtgtgtattgatctgacgattaggttatgtcatctgccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaatacccgagtcatgatctattacatattccatagatataagttatcccctatgactagtcggataaccatgccgtatgggtatggggtacccacaatatccacagaatcctgcgtcgcccgctcgttttcctgcgttttcccctctcgttttgctgcagatcacgccattttcccccctcgctcgccctgtcgcgcagtctcggactcttggtgcgttgcgtgtgtgtgcgcgcgaaagcgatcgcggcggtggtagtggtggccgcacgcacgagcagcgtgacgcgccgcgagcgaggccggtgacgcgcgcggtgccgcggtgtggtgtgcgaggggaaaggggaggattggccgtgttcgattgctttctcggcctcgctgagctcgggccggcctggttccggcagcccgatgcttgcaagataccacccgttccaaaataaatttatttttcactcgttttatatctaccaatacaaaattaaaataaatagaatatctctactttgtaaaatcccaatgtaactgtttcagcactttatctacaccaaatacaattattctctatttttataaactccgttacaaaataaacttattatgagatggatggagtattccttgtggtaaagaaaaagggttaaacgtctattttttttcttttgttgtaaaccgcgacttggagttttgtactagtacaccactgatctgttaagacattgcaatgttggaaggaagaaactccaaaacactgatcgatgtctcaaatgataaaggggctgtttacttcggtgtcatttttaaccatggtaaagttgctaaaagaatagttacgtttagcttgttgttaaattgataaatacataagaaatcctgctaaaattattttggtaaggtttattttagctacaatctgaacaccatatatttacgaccgtaacatatgctaaatttcaatagagcatggcgcacaaacaaaagtgaaaacgaaaaattaaaaggttaggcggacccttgtttaggcggacgtacatacgacagggtatagaacatctgacatatacgaatgtggtggcaggggacaatcctaattaaggagggagatgagcaattagtgtctctcaattatttctgtcactgcgaaagaaggacagcagatactgtagtaaattcatgggtcttgtttggagccggttgattggcccccgtttgtcaagtgcagtcagggaaggtctgttggttgttgcactgaaaggatgacactcgtactagtaatccttaattttcatggcatcatcctccggtatgaatgctgaacagttaacagtgatggatagtatatcatcaattcatcattagctgttgagaccaagaccctgtaaatctttaactcgaagttgccaaacaactgtaaatcttcgctaacgcaagtgaaagtgggcctcgcgcttagcatgatctgtatttaaactaattaagtatacttaaacatgtcaaataattttgttttagttaggagtcagttgggccgtgagagcctgcaatgagatgggcatgggctgcgatgagatgagcctgcaacgattttgctatatctcactcgaaagatttttttcttatctgtccctcgattttctcactcaaatttatagtgtattttcttgtatgttataatataatttatgaaacttacattgtaacttttgtaagttacagtgtaatttttgaatcttcgtatgtaagttttgaaatttatattggatttggtctttttctttgaagatatggtaatttagtgtccattatgatgtttcttagttactttttatcttttactgtgtctattggcttttaatccaaagaataaaaatctgtgtgatataatcataaaaatctttcgaaagatgcataggtactccttgcctgcaaatccctgtgtaaaaagttgagttttaggtggcccgatcccctttcttccccgcaatcgatcattggcctcggctcgacgacgagccggtgcggcggacaacctgccaccgcccgcctcctcctcctccggagccctaaaaggaaatccagctcgaggtggtcgaatgaacccagcttggtggcgtcgcggagacgcacccaacctgctccatgtaactagaattttggatccgagttttacacacatgtaactagaatttttaaatcttagtaatgcatcgtgggtcccgcatgtctagatggcttaaaatttgtacaaagttgcttctccatataataaatcatctctgcaaaattcaattaaatttgataagtttttataatgtgaacgcgagtttaaaaattttgagcccaagttttacatacatgtaataagaatttttttctctatagtaacgtagatgatccatttagatatccatggataccccattgatatagtggactcatgatagattaaccctattaaacaatggatcaatgaactcacttaaaacggtttaggttcgatccatatcctaaccattcccatcctgaaagggagagaagagaggaaaagagagaggatgctgatttggcatcctgacatatggggcccacgtgggtcatattctgactcagccgctacgttaggcaaaaccggagtcaaaactaatgaaggacctcaagtgaacgatcttgttagttgagagacgtccgatatctggttttacggttagaggacgattttataactcgatgacaagacttgccctgtttggaaaacggggacttattccaagtccctgtcacatcggatttttgacactaatttgaagtattaaatatagactaattacaaaaccaataccataaccttgaactaattcgtgagacgaatcttttgagcctaattacgtcatgatttgacaatgtgatgctacaataaactttttataattatagattaattaggtttaaaaaattcgtctcgcggattagctctcatttataaaattagtttttttattagtctatatttaatactctaaattagcgtccaaacatccgacgtgacagcaaatagaaagttttacccgcatctaaacacaccccttggaaaagctgagttttaggtggcccaattcccctttcttcccccgcaatctcccatcggccaagccccgacgacgagccggcggacaacccgccgcctcctgaaaggaaatccagctcgaggtggtcgaacgaaccaagcttggcgccgccgtcgcggagacgcacccacccaacctgctccacacccgcggggggctctccgcgacaccgcccgtttcgccactagtattttttactagtacttttcactggcgcgcgcgcgggcgcgggcgcgaggcgagggagtggcggtggcgcgcccgcggggcgagcaccaccaccaccagcagccaccaggaggcacacaagtcgacataaaaaaaggagacgtcaagacccaaacaaagagaatcttcgcgacggggatgcgaggcgaggcgcctcgtggtcgtggcgcggcgcgtcgcggtctttccctttcccccctcctccgagtcctcctcttccgtcgcgctcgctgggggtggactggggtgtttggctgcgtgagtgcggagcggcggctataaagggggaagaaagaaacagcgccaccccgatctcctacctctaccgctgctactcaccacaccagccgccgccgcctcctgagccacgcaggtgtggatctctctctctctcattctctgtgcgctccgcttgctcctcctcggggttcttgatttgctactcgcgtttgcttgctcaccacgtgttcgatggaatacctgtgaggaggtgcatgtgctcaggttggttctttttttgtggggcggatccgagggtgtggctgtggtttggttgatgctaatccagctgttatttgtgctggattgattgctcacttgtgcttgttattactagtcgttgttagaagcttctggctagaaattcctccctttttgtgaaagctttctttagcctacaagggcatagggatttcgatagctaaaaagtgtgcttatcttgttaatgaaagagaagtgcaggtgctttatttgttgtcttgtgttccaaactctggaaaagtatgctatttttgcctttatcccatgagtattacatcatcataacttcagttgatgggaaatcttcccgatatacacacgtggattggagccccaacatctgcatagctagccatcatctttgtctcactttgttaggaaatttaagtgaagtcaatcaaaatatagtatggtaaatccaaaggctatacctttcagtttaactatcaaatactccctgctaaaactttgctaaatataaagagtttgatgtattttccagagaacttatattaaatatcaatcatttttggtatccattcttctgaaattagtattccctacaggaaaacatgcttaaaatagatagtaatctatagccttttaatgtatcctgttcttatggcaaacacgtgccccttctttttcttgacccgagcaagcaaatctgaaaattttatttcttttccagtttgcaggtctgatactgcttgttggttcctccccatcaaaatgcttggctcacttatgtcttactcaccttcagtggtatgttttagattcatatgcagtgatatatagttaaatctcttatgtagaacaagtatccaggtggaggtattattagtcatgtaaagataatcaaagagctgcgacttttcctttgtgcttagctgtgtcattcgctgatattcttatacttgagttttacttttttggtttaggattcaaagacggagaacactgatgagttaattgcgactggtgttcttgctagtctgcagaatttcatccgcaaatgcattgtagctgtcctctcgtatggcccaatgcctaagcatattgcatttattatggatggtaaccgtagatatgctaaattcaggagtatccaggaaggctctggtcacagggtgggcttctctgctctcattgccagcctgctctactgctatgaaatgggcgtgaagtatatcacggtgtatgcatttagcatcgataattttaagcgagatccgactgaggtgaaatccttgatggagttaatggaggaaaagatcaatgaactgctagaaaacagaaatgtcatcaacaaggttaactgtaagatcaacttctgggggaacttggacatgttgagcaaatcagtgagggtagcagctgagaaactgatggctaccactgctgaaaacacgggactggtcttctctgtttgcatgccatacaactccacttctgagattgtcaatgcggtcaataaggtctgtgcagaaaggagggatatactgcagagggaggatgctgacagtgttgcgaataatggtgtgtattcagacatttcagtggcagatctggaccgccatatgtacagcgctggttgccccgatcctgacattgtgatccggacctcaggtgagactcgcctgagcaatttccttctgtggcagacgacgttcagtcatttgcagaatccagaccctctttggccggagttctctttcaagcaccttgtctgggccatactccagtaccaaagagttcacccttctattgagcaaagcagaaatctggctaagaagcagctgtaatcacatcctccctgggaggagatagaaaccatcatacaagatatctgtagttacacaataatctgtattctcctgtggtatctcctggaatatgaaatatataaaggatagctatgccattgtatgcttgaacatgtgtatgcttgagttggtccaaatgtgtgaaatgtaataacatttggtctaagcaaagtgccttactttccctgaagcaattttgttcgctgtgcagatgtgctaccatatccttcttgttacagtatgcatgcaaacaaactgagaacattataaagcttaaagcatccgtaaattacctagtgcttcttcacacctttgagtgtatgctttactcaatcaaacaaattggcacaaatactgttcacattttatccgggaaacttttgtgcttctcatctctgaatcaaaagaatttgtactccattgattcgaaagattttgaactagcatatttcattctaaaaactccatatggaattgctgactttgctgtgttagggattaatatgattcttttcttatatatttaattttagaaaaacattttgcttagcagtttgaaaagtatgcgcacagaaaacagatgagtagaagttagaaatatgtactctccccatccaaaaaaaaaaatcaaatcctaactatgtatatgaacacacattgattatgtatttggacaacatgtatgtttgtccatatacacagccaagatttgttttttttttggaacgaaggaagtatagtatactccctccatacttataaaggaagtcgtttaggacaatatttaagtcaaaccttagtaatataaatcatgaataactctcaagtttttgagtttgaaaatataaaaattatatgaatagatttgtcttgaaaaatactttcataaaagtataagtatatatatataaaataaatatttttataaaaacaagaagtcaaagttgtgttttggagactgcgttgctgtcctaaacgactttctttatgagtacggagggagtatatcacactcttattgtctatacatttttttttgaattgcatactatttttatttttattattttttggaaacgcatacccttattgcatacttaaaaaatacccatttggaattgctgtgttcgaaggggactcatgttgacaagttgggaggcaattctggaaaaaatgtccaccgcgccgcgtctcccgccgccgcgcggagcccccgctctctccgtctccgacgaccaagccccacgacctcgtctcgccgaacccacgcgcggtcaacctcccaaacccctcaagtctccactctccacctcctcctccccctcaccaagtcaatctccacccgacgccgccccgcccatggcttctcccgccgcccccctcgccctcctcatcctgctcgtctcgctcgccatcgccgccgctcagtccggccagccgtcgtcgccgccgagaaacagcaccaacatctctgatggtacggatttttctcactcgctcatgtgatgccctaatcgcgatgagttggctagctcgaagtcgtcgcggatgtgtgcgtgtgtgtgtggtgaccgagtctctctgtcgtccccgcagcggccgccctgcacacggtgttcgagaagtggggactggaggatggcaccatgccgcaggggtaccacccgtgcgggaagctcgtctggtctaattcgtcggaaatggaagcgtccatcaactgctcttgcagcagcaacgagtgccgcattacgcacctgtaagcgtgcacacctcaaatcctcgattggtttctgacgcctcactttgtgggggaaggaaatgaaatgatgggtgttctcaccctggatgatgcaggaacgtcaccggctacaggaacatcacctttatcccagcggagctcttcagtttgacggagctggtctctctgtgagtcctgtcatcggtatccgatatcgtaaaactgcttatcttaggaaatgctacaattgatctgttgtgaacttgtgataggttcatgatttcttcgatagagatgcgctttgtagttgttataatcattactcagaaggctgttacttgttagtatttactggggtaaaataataatatgtataactgacgtttccatgcctaatgtggacctgtcgatacatgtatggtatactccctccgtatcaatttacttgctgttctatgagaaactagtagaacgacaagtaaattgaaacagaggtagtaaaataaatggtgctatgagaagaatctattacgcattcttcttactccttactattcacgtacactagtttcttacttcagacacttctttcatctgtaccatattcacttgatactagaacaacccgttataggtgtaatgccatgttataatttaatggtacagattaataatcacaatcaaatagctctcaacacacaagtttgtgtagcaagcgacaagttgttactgtgttgtaattagctgccatgaagtgcatgatgtccctatacttggaataaaatctaatgttctgtgcacatgcattggaaattgatgattttctgaggagaatgagaatctattctgcactgcaaatgctctttacttgcatttcagatgctatgttggtagttcggtatacataggtcattttttttagaaaatggattaaaacccggcctctgcatccaaaaggatgtacacgacgctgctttcatatatttagagggtttttattttcatactgcatatatcctgccaacctactgaatagcgatttggagacaggattgatgtttgtccagtgtgcatgtcaaatgtactcacattgtgagtttgaatataatgaaagtttttaaaaacttgtgctatccaattatgcaacattttaaccaaactgctaagatccaaaactaatttaccattcttttacatattatccaactggctttagaaggtagcaaacatctttagtgacactcctttgcagtagtatggtgagatataactgctagatgcttgtagagtgacataagggaacttttgattgtaactagtcctcttttctttctgtagggatttaagtaataacaacctgattggtcaaatacctccccaagtcagcaatctatccaagctggaaacatggtgattatgaaacaactttttgttcctttgcagcagcattcatcaattttataagaacttaattgcgttacattcttgtaatggtacatccaacttgttgaatgccatgggacttcccagtattgcctaatgccttggacactttcatatttatataatacttattcccttaacgagaaactatctgcatgtacctaaggtatttctttttaatatttgaacctttttttaaagaattaaaataaactcattcacaacttatttccaaatctggagcctttctccagactacttcagttggcacatgaaaaagaactgctaatcaggaggaatgtcataggatggcaagagtcaagacaatgctgccaccatggtgggtggtgtagcactgtagcagcactgttttgccacagcagtacacatctcatggccaaggggtttgtttttaaataagatgttaactttttataaaaaaatatattaagttctaaaattagaaaaaaatccaaggtatttcatatccagacatactcctttgaagtttgagatagcatcatcgcctgtctctgatagcaaagccctttttggtacaatactactttggtttctagctgtgttactttaggacctgtctgtaattatagaaactatccaatggtttatccacttcatatttacattgtaagtattacattgtatgtgaagaatctccgtgcctcatatttttctttgtgctcaagttgtctatttcaatattatttgttggcaaagacaccaagaccttacctccaaatctacaggcacttcaacaataaccggctcaatgagtcctttcctaatgcatctgcacttttaagtatacaatccctgtaagtgtgtttcatttccattttcacaaaagaatcattttatttgttttcactatcaacatcacaaacaaggcctgtttgaaaaataattagattacattgtattttgttcagaaaaaggtaatactccctccgtcccaaaatataagcattttagcatagtgtaagtcaaatattttttactttaactattaaaagcaaaaaaataaaaatgatcaatcatgtaaaattgatgttattagatttatcattaaacaaactatcataatatgcaactcttttttatttaaaacatcttacttttatagatattgttagtcaaagtagcatctcgaagattgtatcaaggtccaaaatacttatattttgggacggagggggtactaattaacttattggcattctatgcaggtggatgtttgataatgacatcgaaggaatggttccaggatttattgcgaactttgccaatcttacagatttgtatgcataactacttgtccttatatttttctgtaactcctttctttccaacctgagaactaatatgattgtcttgctaggagaatgtatgggatgaaacttcaaggacctattccagaaaatttctctaaattgatcaatatagaaaatctgtaagccactttaattgtttgttttattaacagcacaatcagtcgtacaccgttataaagggtagaaattggatatgttcgtgttgctctccaaagatagcagactatgctgatcctattccaaaagtggaaaatatttgtatgtgccactataacagtttggcaaggccaaatgactacttaactgttccagaagtacaattaccaaatgattgtattgagacctacaagtttaaacccaataatcaattatctgctatcataattttcattagttaactctaaatctaaagctcactgatttcttgtcctaaacttgactaattacctccagtttcaaaagaataattgtatttttaatattgcagtggcatataaagagttatgtagatgtaatcataatcacggttacattgacaaaaagaaatttcatttttggactgataaatttttaaaatgcttacttctgcagttgtatataactaatttcaattgttacaatgaaatatcttttagttttcgtgttgtcatactacaagtaaaggtattctggaagatattgatgtaatactgtatttaatcttaggccttatcatctagagaatcttcttatctgtcccatagtcaggacaaccaaattatcatttgttgaaattcacaccaatctgatttcattattaatcacattaaccaccttctgttgcagcatgattggtgaccttgataccgagggctatccttttaatttcacaggagattgggtaaatctttcaacgttgtacgtttgcaactgtcgcactccttatttcttttcattggactatttgttttgattgttgttggttgatacaagttctaagtacatgctttgtttttgctaagcagatctctgaggaattgtggattcacggggaagtttcctaaccaaattctgaagaatctgaacaaattaacatacgtgtaggtttcagaaaatcttttgtttgcttatgctcaatggcacactctccatctggggaccacaatccttgtctatgtcgaacaggggccctcttttgtgctctttgctgtcagtgaggtgatgttgagtgttctagaaaaaagtgaggtgatgttgcttagtagcatgagggtgcttgatctcagaaccatcgtgaccccatcttctaatagagtttcaaagaacgactaaatcttatgttaatcaaaccgaaacataattggaatctcaaacacttcaatttgggaaaagaggggggtgggctgtcaatgcaccttgcaggcaacaactttaaatttggctgcagaagcctatgcctatttgattttgttgttgttcaaaaaaacgttacaatacaataaaccatgtattctgatattaatcttcaatattacaatgaatgtgaacattgaaataactactgtttttatttgcgatgattctctccttctctgcctgtttctctctcttactctctcaatttgccttatgtttgcagagatttgagatcaaacaacttgtcaggatcaattgaccttcagcagtacgatagtagcctaaagtacctgtaagttggattcttcgtgaaatatgatttgttaaataagaaaattaatttcggatgagatgcttgcgttagggaacttggtagtgcttgcaagttcaagttaaaacccattgtacatgttgaccaggtcgctcaacagcttttctttacatgtatcttgggatatgacctttcagtcagtaatgacatagacaagcgacatctttaaactatcatgttgtctttaaactattaaggatggatggcgaaattaatgtatctttgctgtccgagtttcctcattgctatccttgccaaaaaggaaagtcttcgttttctagagaccttgcttggttgcatttgtgccagggtttgcctgtctactcgtctggcttggaatatctacttcaatatctgatttatcatcactaactatgtaattttaatgtccaaacaatagtaagaggccttcaggggcacgagaagatgacaatactgccaccagggatgaacctgcctcaaagaatatgatgtgtttcacaatgctgtgattaatccgtcatctgaacacgtcacttctgaaattcttgcagtgccatacttttgttcaactgtaggattgtgttctggggaagctattgtttctaattgagagctgaaatcatgctatacttacgaatattttcagtcttccaccagcacttcaggaatttgtaattgaccatgctatacttttcagaatatgaattcccagtatgttgtagagtcagcttctaagctctaattcgtgcgcaaaatttggaaaccttatacattttaaagttttatctaattaccttttctttttaccgaaggttttatctaactatcttgagagctaacatgtttatttcaaattatcagtttgaatctggctaaggctgtgttctttgcctcaagtttgagagacatttttagcgcacgcgaaacgagaaagctcattaacacatgattaattaagtattgataattataaacttaaaaaatggatttatttgaatttttaaaacaacttctatatagattttttttaaaaaaagtatcatttaacagtttgaaaagcgtgctaacggaaaatgaggaagttgaaatttggagttgaagaaaagaactaggcctaaatcaataaactattggtcattggggtgcatatattattatttattcttttccatttttatttttccaagttattgtttaccctgcctttctgatgattttttatttgttagttatgtaggtgaaaacaatttcaatggatctctgcctgatcaaatgcctcaatcactagttgctctgtaagtctgctgtttgcatttgctgattgaagtgtaggaaaaagcattttataatgtgaacttcatggatggaaaacaaatggcacgatttttccacctgggcaactattatatgttatattttcatcagctactgttgcaagcaatccctactacttaaaatatttcgtactctgtcaaggtgcatactgttacacaaccgtcttcaaatactaaatgagaaagaacggcaatatagcacaaatcctttccttgtcagctaatccttcttctcccaagctgataagaggataagagaaatcctttccttgtcagctaatcctccttcacccaagctaataagaggaaaagagaaggcagaattagatgcaactctatttgccattttacatttcatgcaatgtggtcaagttcagcatgctcatagtgcctaatttgatggtggagcatgtgggggacacggtacccgggtgccctagaggaggcctttgggttgtactgcatagggtgggtcgagtgccttaggcccatgcaacatttttgtatagaaagggataagagataagaaagtctatccaatcccatgtaaatagatggtagatacccggattattatggatatcgcgccatacatgccgccggatgccctagcactatataaaaggcatcggtaggaaccctagagaggttagacaccattatacccaccatcagccactccattgttgatttgcacacacctcgtagatccaatctacgctaactggactagggtattacctcattcgagggcctgaactagtataaatttgtgtcaccatctctccttgttctcgtgcaccctataaattatattaccgatcataaaaatcgacagagcatatgttgaagtaggatagattttcttccctagtacaaagtacaatctgatattaaacctgtctaacaattctcctttcctttttattgaaaactacagggatgtcacatataatcctttgcttaggggaaggcttcctagcagttctgctgatagaaagatgcggatgtatgccatttacttgtattaagcactagactcaactgattgttacagtggccttactcattattttgtgaacatgtcttttatgcatagaaattatattggaacttcgattggtgcaggaagctcagttggcaggtaagcaacacttgaaatggtttatgatattgttgtcatactcatataagctcattgaaatagacttccatcatcgaacaagtaataatttaatcactatgctcctatatttgctctctttcttgctattgtttaaagaaacaatcaaataagtttaactggttaaggacagtttaagactgaagggctctcaagtttgctatgcaattcatgagattgaggcaaacatttagaaattcctttttatatttttcatgagattgaggacatattatttgttaagagaactgcataacccgtgttagaggatttggggaggtaaaataattcttaacaaggagaatgcgtgaattggaaacttgactgtaggctgatagcgtcagcaacgcagacttgataattttagaacgtacaagcattccttctagtatgcattagaatttactaattttgtttcttgattactttagggtgtgtttggaactccaagttcccaactctcttgcttcgtttttcgtgcgcacgcttttcaaactgaaaacggtgcgcttttttgcaaaaagtttctatacgaaagttgcttaaaaaaatcatattgattcatttttgaaaaaaaaaattagcaaatacttaattaatcacatgctaattgaccgctctgttttccgtgcatactatttgggttggtaaccttcatatgcgaacagccaaaatagcatgcaacatattatttactttctctattatcatgcagtgaaaaccttcgtctcctcaattgtgtcgacatgaaaggatgcaacacaacaggtttaactagtacgtttaaaaaactttgaccattgacttatgaacataccttactttcctataagactactagtactagtacatgctgataatgctgcaattaaccgttttgatgtaaatatttatagtgctgttggagatttgtcaatgcttctaaaggttcactttagatcattccagtctatttgggagtcttattcatcatcacaccataaatgcagatcctgtatcctttgctgtgaactgtgggggcaagcaatatactcctccttcagatccgtcgaatatgttcaatgacgactccgctaaccttggagcagcagactttcatgtggacactaataataattgggtagtcagtcatgtgggcactgatccttttagtaactcttctggtattgtaactaccggcaatggaacaaacatacctgagctctacagaacggcaagaacatcaactggttccttatggtactatgtggttggcttgcctagtgggaaatatacagttcaactcttctttgcagagatagttatagaaagtggatcaggaaggcgtttatttaacatcgacattcaggtctgatcactctctctctctctctctctctctctctccaagtttaacaatcttaaagcaaaacaaatggcacatccagaccatatgggcaaaacatgaacaaaaatgtgtggttacctgcaggatcggaatatcatgacagattttgacatttccaaggaagcagggggttccaacagacccattaacagaaattatacagcggatgtcaccacctcagtgttgaaaatacatctctactggaatgggcgaggcacttgctgtattccacgcaatggaacttatggtcctctggtgtcagcaataagaggtaaattacagactcacagtacatattctatttttcttgattaccttttttctggttatcaggtaaacattgactgacaagaaaatgctctactttctcagtattcccttccgcggagacgcaagccagcccccctcctgtggcgcttacatcaaggcacgatgaaaagcgaagaggagtggttgcaggaattgctgctctttccatagctgctacagtgatatcttcatcagctgtctacctctggtggaaatgggtttcacttgtgaagcatcgaaaggcatgaggtgttcagatgtgcatatacaaagctggttgttttaattttgttccttctgtcttcttagcatgttcatgagcctatgtctgtattgtatgggcattgagctgggtttacatgagctgtacaggaaaaggtactgtgtaacgtcaagaggaaagcaacaatattgatgtacagtttggtttgtggtcatgatttttagcctatagttttgttgctctaccatcatttatagccagggtgtaatctcaagttaatttttttttgaaagttttgtacatgttacttgtatcaatttgtaaagcttttttgcacccatatcaatgtgtcaattgacaccgaagatcatttgtttacgaaaattgcgtgttaatacccatgtttaagtttttataactttgtgcgcatgtttttgctactccttgcttgttgctacatacttccagtggtgagttcggtttctaaatagagtcaaatattatataatttttcgcattttcttaagtgttctttataaaaatttcatttatattagatgctttttaaaaagaaaaagcggtagttcacatgacccatcatgcctcatcatttggttgtcttagcagttgcagctaaaatttaaatggttaatattaagttttttccttgtagttttgtttttaagcattgaatttttaaatcgttataaaaagttttgcacataatttttttttgcttagtttattttctatggcttatgagccgtaaagatcaaataatcagaaccacacgacacttgaagtattgtttacaatgctatttttcttcgatgacaatatcagaacttttgaatttgggatgaattcacccctaacataaaattggattcagtacaccgaaggtcccagaacttgtcatcgagttaaaaaatgtcctcaaatccggcgtcccttaactaatcaaaaccggtcacaatagtttctttcgtggttttgaccctggttttgtccgacatggcggctgagtcagcgtaggacccacgtgagccccacatttcaggatgtcacgtcatctctctgtttcccctcttctctcccttcctcctctctctctatcactcttctctcgtaggccggccgacgggtggggaggagaccgacggggtgtatcgggagaggaggtccgatggctggcaacgcggcggcggcggtggcgatgcggagcatcctgtctttcccctttctttttcctcttcttttttttcttctctttgacgcgggggagtagcaacgggcggcagcgagcagggttgagcggcgcccgacggaggcggcgtgtgagggcacgacggccggtggagtagagcggcggcaagtgagtgtgtggcagagggcggtggcggtaggcgggcgagcatggggcggctgatggaacggcacggcggcggtctgtggccagggggaggagctgggagagggtggcagccaccgagccaccgcctcctttgcgcccctgccttcgagctcctcaccgacgatcgcggccaccccacctcctccctttccacgcagtggagctcgccgacaatggaggatttggacttgggaggagctcgtcgacctccccgcatgtccgccgatcccgcctccgcgtgtctcactcgctcgctggcctctgccgtaggcctcggagccgccgtgtttcccgctgcagccgccgccaccgcccgccgccgtcgcggtgctaccctcctcctctcccgcggcagagaagactgagagagagaggaagggagagagatgacgtggcatcctgacatgtggggcccacgtgggttccacgctgactcagccgccacgtcggataaaactggagtcaaaaccaccgaaagacctattgtgaccggttttgattagttaaggaacgccgtatatctggtattgcagtttgaggacgttttttaattcgatgacaagatcagggaccttcggtttactttttccttctaaatatctcctcatcccccaccccacttcaattcgggtgtgtttagttccacgctaaaattggaagtttgactaaaattggaagtttaaagaaaaaatttaaaaatttatgtgtgtagaaaagttttgatatgatggataagttggaagtttgaagaaaaagttagaatctatagggggctcggatgtacaaattcgtttccatgacaaattcaaatcaaatccagcccataaggccttttctcttttcttttcttgtcttacaagtaggtctctctccttaacctcacccgattcacacctctcccctcacttctcccccctcaaatccccaaatctaaccggagaaaaccccaatctctcgccgccgccgccgtgatgtctcgccggtacgacagccgcacgacgatcttctcgccggaggggcgtctctaccaggtggagtacgcgatggaggcgatcgggaacgccgggtcggccctcggcgtcctggcggccgacggcgtggtcctcgtcggcgagaagaaggtcacctccaagctcctccagacctcgcgctccgccgagaagatgtacaagatcgactcccacctcgcctgcgccgtcgccgggatcatgtccgacgccaacatcctcctcaacacggcgcgcctccacgcccagcgctacgccctctcctaccaggagcccatccccgtcgagcagctcgtccaatccctctgcgacaccaagcaggggtacacccagttcggcggcctccgccccttcggcgtctccttcctcttcgccggctgggacaagcaccatggcttccagctctacatgagcgatccctccggcaactacagcggctggaaggccgcggccgtcggggccaacagccaggcggcgcagtccatgctcaagcaggactaccgcgacggcctgacccgggaggaggccgtagccctcgccctcaaggtcctgagcaagaccatggattcgaccagcttgaccgccgagaagctggagctcgccgaggtgttcctgcagcccggcaccggggaagtgcagtaccaggtgtgctcccctgaggcgatggggaagctgctcgccaaggccggcctctcgcagccggcgcctgaggcttgatgtgctggtttgctgtgccttgtgatgcctgctgctcttagatggttttatcattattatgcttcttgttatctaaaccaaactatctgataatcatgtgttttaattttatgttggacatgcttgggcggtcgatgctttatctatgacagtgaattcccttaagtttgttcaattttgcgatttctgtatgccttgcttgattgttattgtggtaagggagataggtactatgaaaaacaagggtgtagggtaaagggtaaaatcgtttgagatctatgcatgtgattatattgtcatcgaatgtgtttagtgaatcaattcaaactgtaaggtgattctgttgtttcgaaagacctagaattcctatggctacatagttcagcttcttagatgtttttaatatttctattcaccatgtaccttgcctatgggaatgtcagtaattatgtatggaatatggtttaagactgtaggttaaaatctttatctgtggccaccataggtctctttgctcatgggcaattcaacttaacaataacaacagtcattagccaacaacaaaagatggtggtattacaaaggggggctgtattagacagtaataagacagacttacccccaacagcaagagacgaacctttgggccaactatgaacttgaggggatactatggatggtttgttactttatcttgtacctgtgcctgaattttcttgatttcacattggtttagttggttttatgctctttctaataatttgggaacaaaatgtgatactctagtaagctgcatccttgactatgataaatctgtgttagacttattcaaacaatgaatctgatctggtgttcagtactttaattttttcccagtatgatatgggttctacgctaacaaagaattaaagatctatctgttccgggatatctatgttttaagccccctttagctttagtgctattattaacgtaggaagatcggcgttttaagggctcattcggaatgcaggattgaaaaaacataggaataggaaaaatataggaataggataggaatgcaagtgtaaaacagaggatttgaaaacataggaatttcatgtgaataggtgtggatggagtaaaggaaaaacataggaatctttagaagaaaataggtgcactattacaaaattatcacatactactagtgaattaaacaacattaatcaacctaataatgtgctttagttgcttgatggcatgatttgcctcgttcccacgcgaagggagcgaaaaaagaggtcagcatggacgtttttcttcctgtgatcttccagtgatatggctagtgcaggaaatttccctatgtatttcctatgaacgttttcctgtgatctgaatgacgccacagtaaagcaatccataggaacccaaatccttcatttcctgtgtttctcctccattccgaataagccctaactgtgttcatgattgattcattaaatttgcgagcaactcaatcctgtgaaaccatacttgaactagtactaagatgtctaggattctctttttgaaactgcctgaggagcattgtacttctttgaagtggcattgaaaggtgtttctgcggaacaatagtttttcaactaagatgtaaatatagttgtgtttttttttcttgacatgattgataggatgatgctttatacttattctggttgtactttgagatactaccaccaaggtgcagttttgtccatggttgtgactgatgtttcatgtaccatgcatgcttgttctgctacactgcttatgatttggtcaccaaaataaaattacaatctccaaaataaaattgcagtgatgcaccaaactgcaactttattttggagattgtaattttggcatacaaatatcctgcttgtgtgcaactattatttgattaatttggtgaaacttgatctgttgaacataggaatcatgccgtcctaatgtagccagttaacagccaagaagtagaaatttgactgtatgatcgattgctattaaggtttttgatcagcacattttatactttttccctttttaaaatttgtgcatttgtagttaacccaccttctatgttatggtttcctccatgtaaccttgctttgttcctcgggggcaaatgatgagagcagtctcgttctccactcgctttgtcttttggcgtgctgggagaagttttcggtttcatttgttcaggaatttcgttagcctgaaaatgcaggtgtatggaaagagctttggagcctttggttagaagctgtgaagtcggttgtattccatggcgttttctgttatgttgatttgtggcatgtctaagggtctgattggggtttttaattcatttttttggattctacaactacatcttcttaaaatctggaaaaaaaaactgactgttttggacgaaaaactgcatctgtcagaagcttcctcaaacatgccctaaactcaaaatcaaatcctgagttactaccttagggcaaccacaatgtatgaaaaaggtgaccttaaggtaatgattgcacttgtaaagtgagctatatacattgtggaaagtagcattagtttagggtgcaccttatgcttaaggtctaccacaagaaaaagaaaatattttttctctctcattcacttcatgaacaagagatgaaacaattatttttctattctatgtgggcctatcttgtggctaaattctaaccatagcattgtgggtatggctttaacaatggctcactattcatagggcccaccttaaggttacactacaccacaaatattgaggatgcccttacaaaatccagccgagaaacacttcatcagacttgtgatcatgcccggtgcggtatgaatcagaaatttgtccatctagtccatgatgcgatggcaatttgcagcctctcctgctccaaacctccagggtttcgttacgagaagcaagcacaaatggcactactccgaggacgttttcaaacgcgcttggaagttgcaacgcagctgcgccaaccaatcgacgcaaccacctcccagaaggccacaagtgatactccgccgcgcgtcaacacggccccacatgacatttttgttcttcgtttactttttttttgtttcgaatttgttccaagtttgttttttagggaagttttggtatcgaaaaaattatacgcacaaaagcttgtatgtataattttttttattataaaattatcatgtacaaagtttctatttataatttttttcctggataaaaaatatgtaaggcgagaaagacacgagaagaaaaaaaaaggcagaacatggctattatggtatacatggtctattttcgagtccaactgagtttttattcattaggtttaagttcatatgaaacaaaagaatctatgaaacacaaggaagatgcacgtaagcccgttctttctttattactccctccgtcccaagaaatctagactagtactaggatggaacacatccgaaacacatcttagtacaatgaatctgaacagaatgtgttttgaacaaaaggagtaagacgtagattctaccattgattcctgtgaataccttttcaaataattaaacaatatatttcgtgcaaaaatcttctatataaaagttattttaaaatatcaaataaatttaattttatttttataataactaaaagttaaataatcatatatcaatgattttctcgttttacataagctaacttgctcttctttcaactggaccgtagttgcgcttgcacgccgcagcgatgcgggtatgagacctccccaagaagacgggcaagcacaatcctaacaggaaagaacgaaagcgaaggtacgatgggccgcatgacgtagaattcgtgtggacgttttctccgtgctcctcacgaagtcacgattcaggaacactgtcgtatatatataataattactctatccattctaaaatataaaaaattctacatattttttaaaatgtgcaggaatctttacattttagaaaagaaggtagttgtctatgcttggcccgttttcttcgcaccaaaggataaataaatataatatggccacagcaatttaagtttgtttaggtagaactgaatagataaatttaaataaacatggcacttgaaagctacagtacaataacaggtgacttgaaagttgaaacttgatgagaaagtatatatatggctagtcggctatatttaagcaataatctagtagagacaaaattaagtgcgatttcagagtatgaatgaaagtactgcacagtacattcagaactagtactgtccccaaacccaaagctgggctagagacctccaatcaggtagctgcggagcgtggtcgcgatggtggcagcggtggcagcaagaacggggaactggccggcggcgagcgacagcacggcgaacgcggcgccgagcagccacaggaggaaggcggcgacgaggacgcacggctcggcgccctggacggcggccgcgcctgcagtgagcaggtgcacgaggataacgacggcgagtaacatgaacacgcggctggagtcgaggaggagcagccggcggcggtggtggtggccgacgccgacggcgagggtttggcggcggccctgcagctggttgccgcgcaggaggtaatggatcacccgatccgccattgcagccgcaggcagcttgtgtgttgcagcttgacagtgttcgttgttcggtgtgcgttgagctgctccctctcccttgtatttatacggagcaggttaaatgggaccaggggaatcaccggcatttcgcgcgtgtcgctcgaacctcacagaagatcaggatcggtcagcgatgtggccttctgtccattttactgttggacagtggactcgggaaaagagatcacctgacgtcgacttcctcacgaacccgacccactgatgtggacttcgcacgaacctgtccattctatgcctctctttgatctaagggatattttttttaagtcctccctcaaatagattaaacagtccaaaaagattaaaagggtgagctatttaagagctatttagaaataacccacccaaggtgtgctaattggggctatttcgggtggtgtccactgaaaaagtgtcttttctctctatctccctccataggaagatacatgaaggtcaaatagctctcaaaataacccttggatccaaacaacttggggctattttttgaagggttatttcgttgtgctaaaaaatagctctcaaaataactcttggccagttctccaaacagggcctatatttaggccgagtttagttccaaactttttcttcaaactttcaacttttccaccacatcaaaattttcctacacatacaaacttctaactttttttatcacatcgttccaatttcaaccaaactttcatttttggcgtgaattaaacacacccttagaaaaaaaaaacacatcaaaaattgataaaaccttataccaaacatatattaggagcagtttaggcctgtttagttggcaaaaatttttggccttgcgtgtcacattgaatatgtggacacatatttgaagtattaaacattgtctaataacaaaacaaattacagattccacttgaaaaccacgagacaaatttattaagtctaattaatccattattaacaaatatttactgtagcaccacattgtcaaatcatggtacaattaagcttaaaaagattcgattcgcaatttacacgtaatatgtgtaaatggttttttttctacatttagtactttatacatgtgccaaaaattcaatgtgacagtgtaaaaagtttttgcgtgagaattgaacatggccttctctcatcgaaaaaaaaaataacgaacggaaaaagaattgatgaggtttattgaaaatttgaaacatgatgatccagaaatttggtgagattcattaaaacatcatgacgccggcttattgatttgttagaggaacaagaagatagaggcaattgctgtaaatttgtgttacactagccttcaaatccgtattagtccattatatatatgctgagcagacccacgtttttatagtattttacttatataatattgttaacgtttcatttgaaagggttaagttgaaggtgttgatattgttagagtgaatcgagtatataaactagatcaaacccatctaaactcttcacctagaactactcctaccaaatgaacacttgggcttagttgaaaacttgaaatatactaagcctgtgttcctccctcagtttttccaactcacctctcttgtttttcacgcgcacgttttttcaaactgttttaaaaaattctatatgaaaattattttaaaaaattatattaatctattttttaaaaataaataattaatacttaattaatatgcaataatatgcaataatacgcatttcgaacgcagcctaaacgggctaagggtattacggttgctcctttgtttactttttatgtttaaagctcatatatagccagatgacccatttcagtatcggataatttggtttcggtctcagccatgaccaaaattatcggagacccaaagattcagagaatttaccaataaattcagtagatagatataaaaatacaaacatcacaaaaatccaatagctgatgaactcatcgacaaaaatactcttctagtcttgcacatcggttttttagatatggcaatggatctccatctctagcatggctggcccaaccaggcaaggcggaaggccttagggagatgctggtttttgctaatatggctctttgacctggtctaatgggactaggtccatatgtggagcccacatgtcagggacccgtgtggccgagtatttctcctatgctcccctttcccacaccaccacacgagctcaagaatggcagttggcagcggcacgacgacatctagcgaggaggagcgttcttcgtccacaccgccacacgagctcgagccaaatcaatgaaaattgctcttaaaacagacaagaaagttaaattacatcggttttaatagttttggggtcaacaagttttggggtcaacatatcccatatcgcagtttaggaatatgaataagactaaacctatatatgagagttaaaatggacttattcattttctcttatgctcatctgtacttgggccgggcctactccaacaagaacgagattcccccagggccgacgtgatgtgggccggaattggattcccagtgtacgtgatgggcttcatagatgcagcggggcggcgaggcgagcaaacccataaaccctcggcctttttttcttcccgaagctccaaggaatcctctccactcccggcgatggcatcggcggcggcggcggcggcggcggagtgggaggaggctgagcggaaggtgctggtggcgaggaaggccgccttcgggctgcccaccgcctgcccgacctgcctccccgtcctcctctacctccgcatgtgcaacgtccccttcgacatccacgtcgactcctccttccccgacgccggtgagctcccctcacccgaatcctgtggacatgtaccagggccgtaagctcaaattctatgcgctcgctcggttttgccggtctccgctcatgctgtccccctctcggcggcgtcagatgatgtcagagttgcgctaggggattgatgcatttgctcgtggggggtgattttggggggctgggaaagatgattgtgttgttgttctcatgcaaatgcgaaggcgcattctgcagagattctcagtttctcatgtccgtggcgatgagatgctatctgagttctgcatatattctgttagatacatgacacttattggttgatataacccagttttgttaggcacatgatacttattgttgataatctagtttggttaggcacatgtggcagcaaggctctttatctaaaagagcacagttagatatatatgtaggtttgcttttatgaacgaaaaaggttatagtccattaatgactac

SEQ ID NO: 44387 - DNA, 3526 bp, Oryza sativa
ccaatagaattctgccgaaaacttcgaatgaaattctaaattaaaatatgtaatttcagccatattctattttgccagtagcagtattatacgtcggtctacatgtacgaggaaaatggagaaatggtggaggtatagaaccgtaggagtagtttgtgtacgtaaggaagaggtagaaccatgaaatttcagcatttgtttaaggaatttctcaaaatttcagatatttgaaacctttgcatatgcaacatatataaatatcatctctatacacattacaaagagatcataattaattgggaagtgtataccgatcgcaaagaatcatttgggaatgaatcagctataactgccgggagaatcttgtatatgctgatctacgtattctttaagataaatgtgatatgatctacgtctgcataatgatgcaggatcgtatatgctaatgcttgttgcttcagaaaaaggtgtgaccaagacgaaaggtgcagtacgggaatcagaatgacaaacgaagtgtggtctcaataatagaactaatgagctatgtattagtcaggaatcagcatatatactctcaatcagtatactgccttgtcctatacatatatagattcgttcctacggaaatttcggttcctaacagttgacggtacgtcaaccatgcagagtgctagacgacctaatcgattgatggatattgaagatatatatttctacaagaacgattattggcagagtgcaatttttttaaaaaaaatggttgaggtactatagctataggagcagtatcggataataattgatcacatatcgctatagcttagcgtatatacatagagtacgtgacttacatatcaagtcaagtggtcttatcttatatagaaataaggcctgtttagatcccacctcaaaatttttcaccatgtcacatcgaatatttgaacatctacataggctaaaaaataactaattacactgattgtgactaatttgcgagacgtatcttttaagcctaattgtttcatgatttgataatgtagtgctacagtaaatatttgctaatgaaggattattaggcttaataatttcgtcttgcggtttactaatggattctgtaattatttttttattagtgtccgaataccccattcgacaccctatataataccttacgtgacaagccaaaactttacacccctaaatctaaacaccccataaataacaaatatatgagagagcatataagtaacaaaatatacaaggagtgcattgatgtgtgcgcacgtgggaaacatatcctatgcacgccagctggtaaatgttatcgaaaattttagaaaatattgtacacgtagttctagtaaagtctgtattcaaattcactatatttggtcgtagaaaaagaacaaaattctgactgaattatattattaaaactgtcataattttgtatttttcaggctaaaatataataagtttaaatatgaaactttgcacataggtatagtgtaccattggaagaacatgcataattttttatatgaatttttcataacatttgctagttggtatgtacagcatgtgcgctgaaagtttgtgtttataagtctataagatacatttgccgtgctatgagtgcgtcttgagtaagtagacaaatatgaaaccaggtataaattctaacagattctaacatatctcttgtagtctttctatgcaattcagctgatatagtgtctatgcttcttgtaaacgcctagtgaagcaacctccctcgcaacaaaagaaaaaaagtaaacttgtgcttcgaaacacaagattattagttttatgccgtgagctttgaatttttttacaccaactttttttttcttgctttaaattggtccggggttacagcattgcaagaacactgttttgcctaattgcatgcatgcctgacgatgctttccatgcacgcctagtacgtgttttacacagcacgttcttcataatcatagctcttaaggattcagtccaaagttaaacgccgagttgatatacgtcttttaaccgaaatttaggagcgaattttaaaattgatttggagatgttagtaagatttgatccacggaacacgtatgtatatatatatatatatatatatatatatatacacggcaaatacttctactgcatgcaaattaaccaattagttaagtgagcatttgctagctagtttcaagaggaagaatgttttactagtccttgcaaatatctctacctctcgtctccaaggagaatataaggaagcttttttttttctgtttgtgtttgaacaaatactgaaccgaaagtctgataattaatctgattaacgtgcatgcacatatatacgagctgtgagccgaaagaaaatggttgattatgaagtacttccttcgtggttaagaaaaaatgttagttaattccgccaaagaaaggcaagagtgaaaccattctttttgtctctttgacggtggaccaagattccagttactatatagacaattccaatgcagtgcatgctaaggcatatgcatccttggttatggcatgtttaaacatagaggttatatatatgactttttttagctgtgattagtcaaactgtttttgaagaaatgtatgtttcgtgagtaatgccactaatatgtgctgttataaatgctattcctttgttattaattccataaaatccatgaataaaaatgtcagttgttctaatttgacgacaatacaagatatgagacaacattatatgtataattagcggacccgccaattaatatcatccttctcaaaaaaaataaagtttgcaatccaaaaataatctgcaagcaaggtataagtaacctttcaatgttgttggcccctttcaccggtttcaatgcatgtgttgtgcctgcattgagatgcacttgtgtgttaaggaaaggaggaaactagtgctgtgctggctagtcattttataagttcataggtcgtcttcaagttggggtcaatgggaggaacaatcgagaaagcgacctccaaatacttgcagtattttatgacggattattcctactaatccagctcccctgatcctggcctaaacactgctctataaatagaacaaggccgtgcaacaacttgatcacaagttaaccaggtcatcaccaacatacaaagctaacaccactagcttagctcgcttggtctcccaaaggaagaacatatatggccactcctctcaaccttctcattgctctcctcttcatcgtcgtctccgttcaaggtaaatcttgtaacacaaagagagattatgtgttagtacaattgaagtttcttgttagtataaattaatttaagtttcttaatttcttttgatgtttcaaaattccagtgtaaaaattatttcaacttagatatatgacagatggcataacaaataatcatccatctttattgggacacttatcttcacaagtgaatgattcctctctaacccctagagctagct

SEQ ID NO: 44388 - DNA, 909 bp, Oryza sativa
tctgtgaatgaagattactaatatcaatttgtctaccttgaaccaccaatgcttcatctctagccacataatgagcaaatgagcggacaacatcatgcatcgtgcagtgccattgatcaacatactctatacttggtccaaaagatttctcatgatcaactccttgtagtaatcttctcctaattcttctaatccttttgtgcattgaagtacaagtccttcactgatccacataccaataatggtatcataaccaaggacaacatttttagggataagtgagtagtgcaggaagcattgcttcaaatgaggagagagatcttcatagctcaggtgcaacacatagtttaggtcttggggcattccatcaactgaccatgtagaattactcaaaatctctgaccaaacaccatggtttctatctcttctgcacaagaggccccctagcactttgatagcgagtggtaaaccatcgcattttcctattatctccattccgacatcctttagtgcctcaatctcaggctcatctatctcactaaggataacctgtaggcaatttaagtcaacaaattcaattagtagtatgcataaatgggtctatttttctttaacatacatgagcttacaaaaactcaaattatgtaagaactagccatcaacccatgcacatgcataagcaagtttgttttttttttaaaaaaaataaggatataagttaagcactataatgttcgactgatcgcaaaaaatgtactattaactcattccgcattttattccattttctatggtatgcatttcctattgggttatgcttatttgattgtattgtatcaaataatattaatactgaaatacatttgcacgaaaattacaggtattggtaaggaatatatagtctattat

SEQ ID NO: 44389 - DNA, 739 bp, Oryza sativa
tgtgctgattttaagcatgttattcacattgctaatgaagtagaggaacgtgaattgacatcttttttaaatactttgggctatgttcaatgtgatgatttttgtgagctcgatagtttgaaggagaaattatttgataaaactgatttgccatgtccgactaatgttatttttcatatctttggcgaatataatgatagacagatatacttggtgtataaaatttatatatgtttggatttagaacctcctgtagatgtgaataaaatatgcaagctagagagacctattattgctaatcatattatctcgagtttgtcttgttttgattagaagaaacagattattctaaatggaccatgtgacgagcaccatatggaaaaaccgaggacggttttccgtaaagaaggggaggatgatgtgaccatggctactacggatacaaccgttgctcacatcatagatgaacaagatgctatcaagatcaagtcctccaagtgctggaatccgattcggccacctgctacactgctgacttcaaacggccgccgaatatttaaacggctgcatcagagtcagggtttaccaaactgtttggggtggggttaccgccaccccacggtttgacggttatcgcgagttatatcgtggtttcaaaaactgaaaagattaccgcacgtgataaccgcgataaccgtacggttttgtgaaccccgatcagagtcgaggatgcaaagta

SEQ ID NO: 44390 - DNA, 965 bp, Oryza sativa
agctacaaagcaaacttattctttatattaacagttttacattgttttcgataaatgttatgatggataagtaaaaaaacactatttaatgcagattttgtgatatatcagcacttcctaatatgaaaaacaagtctttgagaactatttttagaacaataaaacgatgagataatactgaatcatgaagatctgtgtagcatatgtcccctgtccatagttgcatgtagctaataatagatactactattaactaacgttctgtaatgtgctattgttcagattactaagatttccttaatgtgctcatgctctctaaataaccaacctaaatatcccttcatatggattctctatgctattggatttatatcaagtaaaaccataataattttgttccttctgtcacatcagaagaatggatcctccattccccatctgtttattaactttctaccgccttcaaagaatgtcctgggttactgttaacattatgctgtgcttcctaaaccaggtccaacaatttcatattagtgaattggagctatctttcacacaaggtcaatggaattatgagcagtggggtggatatgacccaatgtcgaccaattatgcaaagcctcctggtgttgagctgggggcagcttttgaccttcctttggatgagattgatgccacatggaagaacctgacacacacactctcaggcctgttttgtgcatccattaactttttagaatcatccactgccttttctgctcctcggtggggattcaaattgaatgaagggaatctaagatatggtgcattgcctcgtgaagcggggtgcactgagaatctcacaccttggttgaaacttcttccttgtcgtgacaaagctgggatagcttctttgctgtacaggccttcaatatataaaggatattaccattcccaaaaactgaaattgacatcatctcaatctt

SEQ ID NO: 44391 - DNA, 1257 bp, Oryza sativa
gaaacttcccctcatatggtcttgcacccctgcaccgtatcatgcaaacagatttctcatgggtagtggaaatgaaagagggtcgattgctctgtcatttagatccactaatttgcataagcagttatttggaagctcaaatgattgctcaataaaagctgtagttttccaagttgttccatggtatgttaaggtttattatcacagcttacaaattttcattgatgggaacagtaaggctatttcagaagtagttgagaagattcatgtcactccttcagaagacaaacatttacctggtactctagagatgctactaagattaccttgcagtatggaatcagctaccctgtcgctggactttgacaaggtttgttctgctacttaaatttacttgtttcccctttgtgttttatttagtgatatatagaactaaatgttgaccttggtcttatatttacatgaatgcatatttcaggggtttctgcatatcgatgaatatcctcctgatgctaatcaaggatttgacatcccatcagctttggtaacatttcctgagttcaattctagccgaagttatcctgaaggtgatacattatttgtgtcacctttgctacaaacgttcaaggtatatcttgtgacttgactaatagtatcagaagcaaaagcaaaaagactaccatgtgaactgaaatgacatgcttcaatacttactgattgcgatattgttataacttgaaggaagatggcgtggtcaagtcatatacagaagtattgcttgttcccttgacaactcctgatttcagcatgccatacaatgtcatcaccttcacttgcaccgtcttagcactttattttggttcactacttaatgctttgagacgacgaattggtgaagaaagagggaattgaaaaaagcaggtaattttactactttgttcatttggttaccttttcacaatgccctgagttcatgacttcttgtgttctttgatctggttggtgatattgtttacttggatgttcgatctgaaatataaaattacaagttagtgctctattcgcacaacaattagtatcatgcggatggacaatggcagtattttgcttatgactggaacatagatttagtgttctactcacgtatgaaaggggtatgagttaggatgagttttttcaggtgttaagacaactcacactatgaattgcacaagcaatattcatacttatatgaagattatattttatgcaggatgt

SEQ ID NO: 44392 - DNA, 723 bp, Oryza sativa
gtagtagcattccagcccaccaagcctgcatagcccagttgcctaaagcccaaaggaaagctgtgctgtgcccctcacagcctcgcttccctcccttattaatccccctcttccacgcaacacaaccgcgggtgttctgctttcgaacacagaagggggagagaaagagggggaaatcaagaagcagagagagaagggaaggcgtccgcgctcgcaatccccaccttctccatgccgcgccccgcctcgcctcgccgaccaccggcgccacctcctcctcctccacgccgcgctccgcctcgctgaccaccggatccaccgccgcctcctcctcctccatgccacgctcagactcacttaccaccggcgccacctcctcctccaagctgtgggcgcccccgacaatcacccacgagaacgcctccccctcctgctccgccacgcgggcaccactccggccaccggcagctgcctcctcctcctcctccaagctgcgcagttgcacctgccggattgataaggtgacagagagctcacgcatctcctccccattcacgttctgttgtcattttctttattttctttcttggcacgatcgcaaatagaggggctttctcctcaagatcgacgatgcccaagcggcttgatccagagctcgtgcactctttatatctcaactgcaagaaggatcagttagttatctacattgaagggtttctatga

SEQ ID NO: 44393 - DNA, 20709 bp, Oryza sativa
acaagatttaagaaattgtagaaactaagaaagaagccaaccaaatataaaattattaaagaaaggtggaaaaaaattaaaaaaatgtatacagaccttatttttattggattttaccactgctaccaggaccttgctaggtttggttacttgtctatttctgagaacatcatcatcaaaatcatccaacatttgcaggtatctcataattattaacaaaaaggcatttaaaagctaaaaccatccaaatatattaaatgtgtcgtttaaaagagaaagagatggcacaactaatgactcacctatgaggagttgtcctggtgtttgaaaccttctcaggcttcaactgcgtgaaattatagagccctttttcttcaagggttgctcatacttccaacatttcaaggctttgtgagctgatatgctcatcctagaattttaatatttgttcagcttttgtgcatctgcattattttcgaaacaaaatgctaaaatatatcaaaagtgttgtttcagttcaaccttgtcctttcttttgtcaatttcattctaagccttattagaatggtcattctttgtcaattcagcaacttccgcacgctgaataaaaattatcatgatgagttaccagaatacttcaattatcatgtttgtactttatagtaaagtaaagaagaacagatcctatttttatcttatcccgtactagtaaattgtccttgtccaaaaaaattatcttgtctagcacatccatggtactgctaccaggcgtacaacagtcattaatgtctccttgttgtcttggaagatatattggcctgtttaatgatacgtttaatatcagatattattcaaatatttgcaatcaactcaatgataaaaaatcatagtattaattgaaattggtactgcattaactccttccagaaaatatacaaattaaagaaacaaggttgttgtagaaaagaaaacaaaccttttctacaatactcttcatctctacaagatgagcaattacaggatgatccggcacaaacaatccctcagcttccataaggaggtagtagaaggttatatagcctaagaataagccagtaggcaagctcgtttcacttccaaaggctgcattttacccttatggttgccttgcccaactatcacctgcagaacagagtttattttaacaagggcaagcagtttatatcatataagataggcaaaagaaattatttttccttctcctttagcaagctttgccacaatcttgagaagatcagaaaaataaaacaactcctggtctcccacagcaagcagagtcagggtgcattacacttaatatccccattagctagtgctagaagagtcgctatcacctagtcagtgtgaagtgtgactgaactgataatgcggcacaatgatgtcaaggcaatggcacaagaaaatcaaacgatatttatttaaacaactcaaagtatataactaattataggtttgctgctttaactataactcaagaaaatcaaccgatgctttaattgtaggttcgctgccaattttattataactaaaacccccctacaattctaacaaaactatgtaagataaacgttagaaaatggaaagctctttcatgaaaaccacttgcatggcctaatgtttgtgtcatagcatgaactatgctaattactatcaatacgaaggccggtgcaagtgtcaattttccaatgcagtcactagaacatacttaaacaaaaggctatctaccaacttgatgaaatcatagagaacgaaaaatatcagccaattcagttcagccataaggttttctattgctaatgagatgacattcactagtattcaagtcaataacgaaaatgtgcttaggtaacactaaacattaaaaatgaatgggttttttttttcggaatggtagcccagtctgatatgatatctcttctccagtgccttgaaaatagcatgaaattgcacgagttcaagttcaaaaccatgttacccaaaacaatagagcatgcatgataacttggtttcctagaagattgccatttgccaaacacattatatcacatataacttgtatggattcctttaacacatcaaggaacaacagaagatcaccaatagtcaccgcatgagcactttccatcctcaaaatgatggaagcgatttatatccctcacgatgatttctcgtttaactattttagatatcaccgtaaatgcagtatgacaatccaaacaggaacgcaaattcttcaatatccttattggatgcccaggaggtgtcatcacaaggccatatgctaaagccagcctctcactatgcacccacagcattcgagtcttttgttccttgtctacgtcgtgcaacactacattaatgtcaggaatataaccttccctactagttttaagattgagccattccagcattgcatttatcacccgcatatctggatggtccactgatcccactgaaaaggcatgaatttcacccttgatctcaacccaactaagaccaggtaccttccttacaccaatattcctcattgatttcctcaaaagggcaacttgatccaaacttccagctgcagcatacatatttgatagtaagacataggttgtctcatcttgtggttcaatctcaagtattttttctgcagaaaatcttcccagagccacattcttatggattatacaagagctaagcaatgcacgccaaaccatagcagatggtgccgaaggaatatctccaatgaattgtagagcatcattcagacggccagctcgtcctagaagcctaacaatgcatgtataatgctccatacttggtttgatgccatgatcaatcctcatagaatcgaacagagataatccatgatttactaatcctgtgctactgcagacggatagcagagcaacaaaagtgatatcattggattccacgttgcttttattcatcctgtcaaaaagttctagagcatctgccgcttgtccatgaagcgcatatcctgagattattgcattccatgaaattatatcgcgttccattaaatgttgaaataccttgagagcatccctaatgtatccgcacttagcatatgtatcaataagtgaattgccaattacggtgtcattattaaatgtggacttctcaattgaacaatgaatctgaccagcatgtcttattgatgctgtgcttgcacaagcccggagcacactcgagtatgtaacttgagtgcaaggcatctgagcagcttgcatctcacagaatacactcaatgcttcttctcccaaaccagactgactgaagccaacaacaattgtgttccagctcacctcattggcatctcgcaatgatgagaagatcttaagtgagctatccatgtcgttgcacttggcatagaaatccattagtgcatttccaacaaaaagatcagactcatggcctatttttatagcatggttatgaatttgctttccgaaatccaactgaaccatgttagtacatgcttgcagaacactagaaaggctatattcattgggcagcacagaagaacgcatcaatcggaggaacagttcaaaggcttgttcattctgattgctctgtgcataccgggatatcataaaactcagaagtatcacatcatcatagggaatcatctcaaaagccaaacgtgcatccttaatatccccacatttggcatacatatcaagcaaagcaccaccgacatgaggctccgtgtcattaagggtttttatggcgcaaccatggatgcccttgcctagcacaactgatggcaagcaaactgcagctttgagcacactggttagtgcaaaagggttaggcttacaacccgacaccctcatcttggaaaagacccgaaaggcattctctgggcaatcattttcagaatagcaagaaaccatcgcagtccagacaacagcatccttacgcacaatcccattaaacacatgttccgcatcactgacaagactgcataaggagtaggcatcaatcagccctgaaccaacaaaggcgttgtgatcatggcccagcttccacgcacatgagtgcacacccccggcaagccctgccgcatccatggcaatagctagcttcaacatggtggtgagcacgaactggttcacctcgtgcccctcccaccgcagcctcctgaacagagccgcggcagcctcaaaatcaccgcgctgagcgtgggcctggacgagcgtgacgaaggacaccatgttccgctcaggcattcggtcgaacagcctgcgcgcgctggcaaggggcccgagcttcccgtacatattgagcaggacgttggcgcagaagaggtccaggcgccccacccctccgcggcgcactacatggccgtgcacggcgcggccgccgcgggcgtcgccacgagcgatgcagccctgcaactgcctggcgcacgcgaaggagtccaccccggggacggaggggaggatcgcgagcgaggtgagctcgtcctccagccactgtagcgctgctgcataggctgcgaacccacggcggtgtggggcaactgggcaggacaaggtggggaggaggaggccgcggttcagtggccggagcatccatccgcccagtcgcatcacagccttagcttctacgagaagctgaacctctcgggcttatatctttggcaaatggcggccccaatgttcaccgagagagagagagagagagagagagagagagagagagagagagagagttgaatacttgaatccattgccattgggggatcccagtttcaggaggcgcgggcgcgagaaaggagggaggaggcagtagcgcggaggtggcgctggcggagggaggaagggagaagtggggcgatcggcgaacccggatgcttgagggcaagacggcggcggcggcggcggcggcggcggcgagagacgagagccagtgagcggtgagggagaaccggagaagatgttcccgggctggggttggcgcctgccttggaggctttgatgcatgggcttgtttggtaaattgagacgaggattgggagttttttatgaggaaattgatcgtatgattgttacgaaaatttatttttcaatcttaatcttgtatttttggtagaaggtagaaataatattgagtttagactatgtatttttaaataaaaatatagtgctaagatttatttagatagggtagaggatgaaatcctttccaactcaccattatccaggtcaagaggagatccctcctaaaatctcccctctaccaaacgcattcacccttagcctttgatatattaggtttttatcaaaatattattctcaaatggtgtgtttatcactataatatcatttcagacaaaactacctataaactccctattttaaagctaccttctcactgatcatgatggcatgatttggtgacaagcgaacggcaccacccaacacccacatcccgtattgtgagcgagacagatgacagatgcgctacaaacaacttcagcccactcgaccccttcatttttatttaaacaacttcacacctcccccctccaccacccgtctcagctccacgttattttctctatcaatccccgtctcccaccctgaccatcatgtcggggctcgaggactagattacgtcacatccaatcatacttctttttttttggacaaacggaatatttggttgaaaatgtttattttcatgtattggaatcatagtcctataaaaacaatttgtgtataaaatttgaatcctaaaatttgcttatatttgggaacatagaggatataaatttcacaataaattggatctctaatcttccaaatcttgaatcataggttcacaatccaagggcccagatcttatccccaatccctatgcaaaccctccatattccattcgccgtctcacatctcattatctcatagcccatcacagctatttatatcttaactagtgaaaagtgacatccaaagtggactgagaatgagccacattatttggtaaatattagccattgaacttactacaagacaaaaaagagtgaatgaatcttagaccattggattaaatgatggcaaaagaacacattcaagagacttcaggagatgaagctactagaagtggaaagaaagaaatgaaggaagaaaaaaggcaccctcattcccttaactaaatattcattagtcaagattgagctattcagggcatattcaaaatgtatgttcatgtgattatttttgtttctagcaatttgttgttaatgtatttgagaaaaaaaattgctactgagacatgcatattccttccaataatgagtcatggtcacctgaatataggcttaatgatttttcacacaaatttaaaaatagaaattaaactaatccttaaaaacctacaaaatatatgacaatgagtcacaaaagggtacgcactaatagaaaataagtgaagaataaagggtgatacatatgtctcatacctattaaaatttacaataaatattaagccatctactttaccaacataatactatgactcatcctgacccaatattttactagcaacaagaaaaacaacagattgattatattttactagcaacaagaaaaacaacagattgattgacactcacgtatcacgtaacaagagtcgcgcaaatgtgtgacaacataagctagtatatatgatgtaagattctaatgaagaccctacaggatgaaccttatacaggaatagttatcattagtttatgacctagttagaattagtttgtgaccttgataaattaacctcaggaaattagcagcagttcaagtggcatcagtagttcagatttaagcctgaaagaccacatagcagcatgtcccattaaaagaatcaaatcttatctaatataccgaattcaaggtaaaaaatcaagcatatgattgggccacgtggctccctaagattttagggtttgctcctttgaaaaccagccacgtgtcccgtgagattcagctagagcgtcgattgtgcaattgtctcatctcttctattaatctaaagctagccattcttctagcgtttcattggtccacgtggcatgtttcattcgtccagccctctcgattagtccggacactggaccgtgaaaaagaaaaagaaaaagaaaagaaaagccattggttcattcactggctgtcaatggatggcaacgggtcgggttgggcacgggtagagcaaaaccatgcccgaccccatgcccgtcgtcgcccgcccaaaccctacccactagggttagcaggcaaaactctgtacccgtacccatgcgggcacgggtatgcccagcgggtacccaatggatctcacatgaataataactcgaaaaatatataatttaacaaagagaaataaaatcaacaatttatcaaattatcagctatcaacaataatttgaattacgtcacaacttattattagtagttagtatcacaaatgaatcaagagaaaggggtataagaattaagagataagtcgaaattagctaatacatatgaattgggtcgggcatgggttacccacagataaaaaatgaaactcggctgttgctcacgatgtctgcgggtctcgggtaggcgtgcccacaggtaaaaaatcacacccacacccgtgcccattggatcgggtatccgtggatacccgaacccattggcaaaattaccatcccgcctgtcatgggctgtacagcccagtcatgcatgactgcactaggcctggtcatctagcgttgttgctacagcatttgcacgttgcactttaccttctcgggctaattaattagtaataacacaaacaggaccaaacaaaagtaggaaaaaggaaggtagagaaaagtataaataattttgtaaaaaaaatcttcaaaacataaaatattgatatcctgtatttatataaaataaataataatcgggaaaaactaaatatcaaatataaagtgaaagagattggatgagaatttgttcaaatataaactaagaaccatttcttcaaatatgcactttatcattgatactatatgtacgactttttggttaatgaaatcacaacaattttgaggaaacataactttaaattttctaatagagtctagctatttgccaaattattgatcatcattaattacaatcttactttggtttttctcataattctaagacaaacataaaattaaattccattaacatgtccatttgaaagaatttttttcagagttaaacttactcatgtaataatatattactctgcatgtttaatattactggtcattctcacatttcaaattattatttttagatcgtggtcttctatcttcaccttttaaatgccatgtataactgtcaatcaaagttaatattgcttttgaaaacgattataatgtagttaataagcatatcagtgtaatttgccacatctccttgtttgatgtgaaattttgctagagttacaaataatataaaatgagaggtaggcaaattttctatatatattacagatgagccatattacatgctaaattaggtggcacgccaacaggcgtgcagatcttctagttgaaccattaagcagaaatcataggtcttgtaacaaaccatccagagcaatccgtatcggtatggcattaaatcgccattcatagcatgtagcttagttaattagcagtacaacttgtgacacaatcaatagctgaacatttcagtagttagatatagcatgttttcagtaaggcatacggtgataataaccagataaagtccttcaggatcaagctgcaggatgtagagtttcaataatcagcagtgtaacattgtccttcaattaccatggtttcagtacgcacatttagtgtgctttcaattcagtgctgcagttccatatgattgttcagtgagcattccatccataagcatataggcattcaaccatatattgaactaattgaccaagaatttgataataatttggattaatctgaccaacataaagtaccgctgagcataatataatattaattatatgagccaataacatgaaatcatactgaattattatggatgtatatcatggaagtcttagtacagagtaattggcagcaaaatcatagaaaacatatttatcagactcatcctggaacctcttagatcatgcaaaaagcaagaacagctcgaataggtgtttcggactcaaccatacaaatactctgcaaaccaaagaaaataagtactagtacattaagtttaccagcccagtctataaagaataagcagtatcctgcaactataaaaacacattactcttcaacttcctttttgatttcttccaaaagttcatccttgtagtcctcaaatgttccatcaaatttgttcacagtgccatcttctacaacccatatctcactcctctgctcatcgtcacacactctagagatcaatctcgagtcatggctaaccaagaccacaccaccagtgaattcatccagtgcatctgccaatgcatcgatactttgcatgtctaggtgatttgttggctcatccagcaggagaatgtggggatgtgacattgatattgaagtgaacacaacacgggccttctgtccaccagataatttaactattggagtgagatggttgtgccctggtaaaccaaattttccgagcttcgcacgtacagcctctgctttgctcattccctcctgatcaggatggagcctgagcaaatactgaactgcattttcctccattgtcagtaagtcaacaaaatgctgtgagtatcgcccaatcctcagcttctgactcctccttacctctcctttggttggggtaagatcaccagcaagtaaattaagaagtgtagattttcctgccccattgggaccaacaattgcaacacgtgttcccatgtcaatgccaacatcaacaccagacagcttgaaatctggcctattagggtagctgaagcccacctcaatgagctgaaggagcggtggtgtgagcaaagttggctctgggaagtggaactcaaccttgtagtcaagccatttctgtggaagatcagctggcttcatgtcgtcgtcatcatttgctacattctttcccttccccttgctcttggcagcctccttattagcctttgatagtgcctgacctttgaccttgtcttgcgctgccttgctcccagtcttctttgctgccttcatctgcttttcaaacacctcaaacttcctattcatctccttcctcttctgttcatacccactctcaaagtcgtcaaaatttccacgataaacatgcagattcttatcatgcaaatgaatgatctcattgcaaactgtgttcaggaagtcgcgatcatgggacacaacaatcagtgttttcttccactgtgagcacaagtattgctccaaccaaagaacagctcggaggtcaagatgattagtcggttcatcaagcagcaacaatgttggctgcatgaacagcgcacgagcaagcgagatgcgcatcctccagccaccactgaacgatttagtggacctggcctgcatagcctgatcaaaccccagcccagcaaggatcttggatgcacgagcccgggcagcatcagaatcccggaggttgagcttctcataaacctcagcaagccgctcattgtcatcagcatcgttagaggcctcgagctttgcctgctcggcacgaagcgctgcgagctcttcatcagcagcaacaacagcctcgagcgctgaacgattgtctccaataatttcctgctccacaagcaggacatcaatgctccggggcaccgggacctgccgccatgacagcagcttcagaagggtggacttgcccatgccgttgggcccgacgaggccatagcgccggccgtgcgagatccggagcgaggcgttcttgagtagctccttcccgcgggcagaaacagagaagttctcgagcacaatatccttgatgttgtcatcggcggcggcggagtcaccctcggaggccccggcggatccagcgacgcgcgcgccaataacgacagagaatgcgtcgcggtcgtcgcggagcgcctcctgcttggccgcctcggcttgcgcggccgccatcgcctcgcgcttgtccttcttcttcgcgtccttctgcgagggcgcgatggcgttgaggtcgacggtggcgcgggccgccttgggcttcgtggccatggcaacgaggtcggcgtcgtcctcctcctcatcggaggggggcaggtcgatgtcgcccatgtaagacgacgcgggcgccttggagggcttgggcttggacgccgccttggatggcttggccttggacgccggcgcgtccatggaggccagaatggcggagaccgacatcggcttgtccttcttgccgccggcggcggaggacgacgaggaagtatctttgcggcccatggaggcggcggcggcggcgtggtggggagctggggaatttagggttagttttgggctcggtcgattagatcgggacggctctgctgtgtttggctccgtcttaactactgtgtttatacttataatactattactataaaaaaaatgcatgtgaatgatcttaaaaaccgacttaaatacggatatttattttcaaaaaaagcaagtaaacttaaaaaccgactcatacacagatgacatataaaaatatcgacaaaaacatctttattttttaaatagcagagacagagatataggttaaaaccaaaacataaatttaaaaccgactcaaatacgaatgacgaacagcagaaacatcttcaatttttataaccgactcaaaaacggatgacggaccgcgaaaatatcttcaatttttataatagtagagatttccccgtacaaattaaagaaattctccttgttttctcggctcgcctcttctatcttctcgcgcgcttgtccttcttcttcccgtctgctttctgttggcaacttttttggtcaagtagataagcatgatcgcaacacctaaacgtcttgcggtgatttgtagagtcgccaaccaccccaaaccagcaaaatctagatcaagttgggttttgatagattaaaccggatagcggagccgatttagataaaacggtgaataactacatgtctcgtgggcaaacagaaggtttacgggacaaacctacaaaggatttcgcactctcgcaatgaaggcgaatgatttacggcgtaaatcaataaagatggacgaattaaagtagagctaagtgaaaagcagaaagcgatattgaaaaagcgattcgattgattgatcgttgtgtgatacattgtttgaaccgaccttatccattaaataggggttggtcttgccctctacaggccctcctccatgtctaactaggggtagaaaacaaaaaaagaacccaaaacatagccccctgagcaaggaatctcgagacccgacaaaaacggagtctgacttggactctgctggtcagaccggccctctggccacagtctgagtggtccatacatggcggttagatcggcccttctggaggaaaccggtagattcccaaatcttggcaatttttcctatttcgcctctaggtgccaaatttgagtgtaaacacattctttgtcaaaagcaatattgatagataagatcaaaccgaaaaaatataagatttaagttgataaatatagatttaactatgattatacaagtttgagtataagccgatgtaactcagaagatgccatgagataatataatttgaaccaatcggtcaaaactaataatataatgtgatgtaaataggatggttaaaacatccattggctgaagatccaatgtaaatgttgtcgaaacgacaaccgcatacgtcgaaagacgtggttactcaacagtggttggaaagaaacgaagtgtattaattttagaattttttacttcgggatccccttattacatggccctaggggactatttatagccccattataggttcttactactagggtttaggttatacaggggaatttacatggttacccttacgaaagggacatttacagggggtacataatgttatggaggttcatgggcccctgatgggccgtcgggcgaccgccggccctatagcccctaggcttgatgggccggaaaggcttcttcggccctcgcgggggcgaacttgccatggcgaaatcgtcttccttcggcagatactcttcgccttgcacccttcgcctgggacgcctctggctcgacaaggtactcgcacgacccctcgtctcgcgccgttcttgctccatagtctttgccacgggtttcggcagatttggtcgaagggcctcatgccatccgccaacagtaaataaattaaagtgtatatcaactaagtaatcattatatctgatagctaacccacaataaagacaactcatcggctaacagtccgatgaaacgttgcatgaaaacctatcggcttagtagaaatagacttattagtagcaatctaacagatcgagcctaactaagatattttaagattgacgataacaagaaaaaaatatttagccaatagatatatatacaaacatgattgatacatcgatctatctaaaacggcaatacgattagaaaaacatcaacttagtcaaaatatcggacctaagtgagaaagtcctaactaagccgataccactctaaatagcaatgcagttaaagatataatcaatatatcagatagacaatgcttgcgtcaacctgaataaaatattggacttaaacgagaaagttgtagccaaagttaaatagtataggaagaggagattatttcctcgcgggaagttgacgaaacttacttcctcgtgggagatcgaacttaacaaatgcaaacctgctcaaaactaagaactcgccggaataaaagttggcaatgtaccgaaagtaatgtattgatatgtggaaatagattacaaagtctacgggtgtacatatttatacccttaggttgatattagtcctaatcggacaagatacaagtttcctaaagataaaagaaaagatataagtcctgatcggttgattgacttctttccttaactgaatcctctaaacaaccgtatcaaattttggtgttaacagcttgacgatgactcaacaaagaacgacaagcgatgctcacgggcaaagcaccatgatgacgacgagaacagaggcctacctggcagatcaggatcgatcccactcagggtgaagcgcgatgatcatgcagactatgaatgaaaaaaaaaacaggtggctgggccgtattagatcaacaaatgcagaagatgatgaaatttgaaggacatgaaaaggtcacagattaatcaaaatgggtacaattcagttgtttttcttagaataaatagaagtagccagctaagagctaaactacaaattgaatgcaagtgtttaagcttagcactaatgccaccatgcgcttcagtcacccagctccagtgttcccatctctgaaaaaaaatcgaacagcattggatcaattccaaaaagaatcaggaagacaagctttatcatctagaaaatggagctttaggaaatgactatacataaagttcagaaatcaacccagtactgaaaattggtcttaaaatcaatccagtactaccaggccaagggtatagggtcccaagaaggaggaggctggtcttctccaactctaattggtggacatgcaatctacaaagcagacacaatttacattagtaaaattaaaatatttctaaagtgcaaggccctatatgtgctagtaccaataaaaattgaaataattttcaattgagatcaaaccgagaattttcaattatgttcatattggacatggataggtacaattatgtagatcaaaatgcttgtgcaaaaatcaaatcttgacttctgttttgtcctatactaatcatattcataaatgtataaccagatgagatatacaataaggagcaaaagacgttgaatctgtcaggaacttaccatgttgtgcatctatggtatgtactctaaccatcatactaatctaatttgttggataaagataaaagaggccacgttaactggtgactgcttaaaactcgacaaacagcagtaaccaggtactgcacctcacaattctacctttaataaacattcttccaaacttggtttgcttgaatcatctaagatatgaaatacatagctagcttgcacgatgactttcgaggcagcacatggtgtctcagtgatactggaatcaatcatcctaatcagtatttcagtgaaagtcagaaagttttgaaagcaaaggtgagccaccatagttgatttgcattaatttttgcattttgtcagcatatgatatgttcaaattgacattaatttcattttattccacaaaatcaagcagtgcagagcaaggagcaacctaaattgtgatgctgctcagtccatccaatatgcagaaaatcaggtttaatcaagacactgattaataacctaagaaaggcttattccaacgagaaccatcagtcctctagatccgctagctacatcaaaattgcacaccatctttaaccaagaaccttggaccaagaaccaaaccctaggaaggatagggagaagagaggggaaggaagagagactcaccggtgagaaagtggccagcggaggggacggtcggcggaggggagagcgccgcctccggggagagtgccgcgtcgccgtcgcgccgtcgactctcaatccgcacccgcgccaccgccgctgctttcccctatgcgttgatagtttcctcctgtgcgcgagggtttcttccacgcctcttgggtcgatgattttttcccggaccggggtgagggggaaaggccgggatgggccgggacagaatccaaactgggcttaaccgaacgcacactttcttgtaggccgggatttaatacccaccggggagaataagttcatctgaggtcccttaacttgtcaacaaatccgaatttggtccttcaaccgaaaaaccagatacaataggttcctcaactatcaaaaccaatgcaaatgaggtcctcggcggtttggatagcggttttaactgacgtgacgtgtcgcttacgtggctaatttaactatgtcttcatctgacgtagcattgatgtggcgcttacatggcaatacgaagtgggaaaataataatccacatgagacccatatgtcagtgtcacatccaaattaattttaaaaaggtggggcccacgtcatttctactcctcttcttcttcctcctgctctctccccatctcccctctcctctctccaagcacgatggagagccagcggcggcgctggttttcctgtgtggcggcgtcggccgcgatcccgacgagtagccggaccccggtgtgcagtacgacccgccgctgtcgtcctcgtcgtccccaccaccaccacctcctccccggcgccgtcctacaaccgcccggcggcacacgacgcagcgccgtaccaggcgctctacggcgggccctacgccgtggccaccgcgcacacccccgccgccgccgcggcataccacgcgcaggtgagcccgttccacctccacctcgacaccacccaccctcacccgccggctgccgccgtcctactactccatggaccacaaggagtacgcgtacgggcacgccaccaaggaggtgcacacggtgagcacgccttcttctccgacggcaccgagagggagcaccaccacgccgccgccggacacggccagtggcagttcaagcagctcggcatggagcccaagcagagcaccacgccgctcttcccgggcgccggttatggcaacaccgctgtgtcgccgtacgccattgatctttccaaagaaaatgacgatgagaaagagaggcggcagcagcagcactgcttcctcctgggcgccgacctccggctggagaattcggcgggccacgaccatgcggcggcgacgcagaaacctcaaacctctcggccacttcttcgacgagtggccgcatgagaaggagcagcaagggctcctggatggggctcggacgtgagacacagctgttcatgtccatccccatggccgccaacgacctcccgctaggccgctaccacaatggtacgtactaaccttcgtctccactgatcaaaaccgtgctgatgatccaatttgcttcttgtttggtcttgtgcaatctgcagacgacagcggcgggtcgaccggggtctggctactcgtcgggatcgccgccgacgtagccgcacgggaataccagcgccgctgtcttctcgccatcgcgtggtggtggtggtgctgattccccccggccgctgactctccgtcgtgcctggagagaggagaggggagatggggagagaggaggaagaagaggagtgggaatgacatgcggggctcacgtgggccccaccaattttttattaatttgggtgtgacactaacatgtgggtccacgtggtttattaattttccgattcgaattgccatgtaagcgccatgtcagacggtgaccgagtcaaattagccacgtaagcgcaacgtcagccaaaaccaccatccaaaccgccgagggacctcatctgcacggttttgatagttgagggaccgttgtatctggttttcgggttgaaggacgaaaatcggattcgttgacaaattaagggacctcagatgaacttagtgatccacagggatcgcggcccaatccctgccatttccgggccaaccgaacaaggcctaaggggttggaaatcttcatttactaacaaaatgtgacaccgacatacaaaattgtaaagatttcttccacacatggtgtaagatgaagatggtataagattaaggtgtaagattaaggtggtattaacgtataattgattgagttttaattatttcaaacttgaaaaatatattaatatgatattttagagcaactttcatatataaagttttcgctcgaaatgcaccgtttagttgtttaaaaagcgtgccacgaaaatcttaatcttcatgcaacttttgttggaaaaaagaacgagacttagtttagtcccaccctcttatttctgggtataaaatctgtactacttaagaaaaacatagtggtggtcttgaatcctgatgcaggcagacacacgaaacgtagatcattcgatcatcaaatcgaattaggcagacatacgcttctctccgcaatttcatcgagcgacgcctcccatagcgacacaactcccccctcccttttctccgctatgccacccactccgcctaacgccaatgccagtcgcccagccaccagcgggctgtggtcaccaacccttgccccccgggactactccgccgcgcactccaccctgcatcgcttgccgccgatgaccgtcgccatcgcgccctgccctacctgccgtcgaatcgttgcctcctccgcctgcctgcaggtcaccatagatctccccggcatccccgcaacagcttatgcatgcagttgacgacacggtcacctagatgttggcagcccggggaggtggtgtcgaaacaagaattcggcaataataaaaggggtagcgcatgagacctaaaagtggatggatgcagagacaaggatttagacaggttcaggccctctcgatgagaggtaataccctactcctttttggggatttgaatccgccgggtgtattatagatctgacgatctggttgtgaattatgccccctagagggcctcctgcccatcttatataggatttgggggggggggggtcaggattacaagatagaaaccttaatcaatatggtatcagtttcctaaatatactttacaatattatcaaaccagaactttaggccgttctataatatacaaggaaatgtaataccaaagtcatgatcggttacatatttcatagatataagttatcccctataaccagtcggataaccatgccgtgtgggtatggggtacccataatctccacagtagcccgtgagaccttcacagtcgaaaagataatcttctctcgaaccagattactccaaagccgagtgcatcaatcatctttgccatggtctcccgagtacttttaccaaatctaaagactgtggagggctaaaaattaattaattataaacgtaggtgcatcgactagatgcacctaataggtatagccctcgactatgtggttagttgaacaaacaaaacatatagtcaaggagtaaataatccaaccaaccgagtggttttgataattgtagtaaaccaagtgacttaatattaatatatagcatatgcggtgtgaatccccgaataacatgatccgagtgatataccaactgctttataaaatatgatgcgtgcaacctaaagttgactacatcattgaaaattcacattgcaaaacaactataaaaaagctagtatgctgtgaacaaagaaatttctaaagtattgggcacacaccatgcgcacactgctttaacatatgtgcttaagtccctaaaagacacatggtttcaccatacctagaaatatatggcatatgtggtgtaaaatccgagtaaataaactcataaaggatttactaatcgcccgaaaaacgaccaaaatatatagtcaacctaagccataatattggtcaataagaatgcacacttacgtggcaaaaagcaacgatattgtatccaatcaattgctttataaacccaaacaatgccctgacttagataaaaaagtcagcaaggcagctatataaagctttactgtttggtaccttttaaaatgcattgtaccaactactaaaaagttgagtaagagcggtataaaaggatttttaaagtattgggcacttgatcacgcgcacttttgcctaaccaaaaaatttctaagtccctaaaagaacgtgacaggccacgcctgaaaatatgggctgcagacatattaggcctagacccaaaatatgcctactgatacccttagaatacgatgtgtgtaacgccccgattttcgttcgggattaaaaatcatttaataatccattttctagaaattaaataaaagttaaatcaattcaatcaagtgaaattaatgggggaattaaaattttcccttaaaaatcattggccgagaatattttgtaatattctttgtgccctaaaatactctccggatttttccgcgaatgttcggagctcaagaagtaatcttaaagtcacaaaattcaactaatcaattaaataaaaagaaaaccaaataaaaatccctctcctccctcttgggctcggcccaactccccctccttcctcccgggccagccaccctccttttcccctgaatttttttcgtttttagattttttttaatatttacagaaataatctatcgaccaaaaaaattgcagaaatagcccctgccgccctaatggtgggcggcaagctgacgtggcagacggtgggtcgaccgcgccgtctgccgccgtcggctaaaattgcgattaggcccttgccgcccatacagagggtggcaaggggctaattgcaattttggccgcccataaagagcttgcggccgtactttttcatc

SEQ ID NO: 44394 - DNA, 3237 bp, Oryza sativa
ccagatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtttgggtcgtagaaacattatatggacttaaacaaggagaattatataacatgaagaaatagtagtacaatttgaacatgatacgactatttgcattgcggttacatagatgatattagattcgaactaggagggaggtagcgcaatagttgaacacaacgacgatgtagtaatgggacaaggaagcatgacagtagaaatttcaatatgccaagttgtccgataatagctaacccctacgtgaggatccctctcctctctgaaaccgcgctttagtaaccctgtattgctctggtagttcaagctgcacaacacggctaggtggagttagaacccttatggtgtctatccattctctgtattgacatctccttggtggttcctgggaggaaagactagatgtaaagcaagcaaagttagtaaatgttgtgagaaaataaggattcatgtaatcaaaatatttttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccacttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtattacgaagaataaagcgattgcccatacagaatgaataagcatatgcagataataaaatacctcacggtcatagttagggcacctaaaaaagcgccttcctcgaatatcaggattcctcgaagccattagttggcatcgatcactgcataggcagagaggacgctggcaccaaggtggtagtaggtatacacaaggatcgctacgccagtttggatcctcaacaccccggcgtctagccattgacgaaagccggttggatttgtaatgaagcaagtggggaagagagtactgaatgtgactgagttctgaaagattgtgaggccttactcgttaaggcgacttatataggcgcaaaaaatcgagtgatacccctgacatgtgaacgtggtggggtatggtgggtacgcctgattggcgccgaaagatacatgcatgatcggcgctgaaagttacattggtcgtatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaatgatccggtggcacagcacgggtagcacgagtgtcccgcggaggagtggcctgcgcctggtcctgcgtctacaccggcggtgcgcctcccagttgtgaggggccaatgacgtcctctgtcgagcctgaagcgaagtcgaagtcagtgatgttgaagagcaaggtggaaggcagcaagcggtccgacgaggtcccagcatggtccagtggtggaccctgactcgacgtgccggctgcctgtgacgaagtcccggtgtactgccagaactgcgctgagtgcgaggtcgacacagctgcctgagacgctgaccctgcagcctgggagaagtgggcggcctgcgtaatagcgaactgggcgaaacctacacatcgacaacgggacccttgtaagctaagacataaaatgtatgtaaattgattgtcgaagtaatgttgtttttttaagtacctgtggggggcacaacagaaggcctgcagaggaaggcggggtgctgaacggtgcacgaaaccctgaagcaatcggcaggtgaaacggctcacttatatgtgcgaggcatgtacagaaatagtaataaaaatacttacctccgtgcggagggggagtcggcctaggaatgtgcgcagctggatggggaccagtcggtacgggtggccgctgtacagctgcgtctgccccagcaacgtcgtctgcacgacaggtgagcactcggagaatcgagcgcatcgactccaccatccgcatgtacgtcgtcaggtgctcctctatgggtactggaatccccgcgcctaaacgttggatcgtcgttgaaccgtcaacgacgacctggttgatgtcgtcgacctacatggttaatttgttcgtaaatattcgtaaaatttgacgaagagagagacatgaaaacataaaggaatggtgcgatgcagggtactcacagcacgagcgaagtcctggtcgcggtgcctggcatagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccatgacctcctcggttgcgagcaaccagtactcaacaaaagtcgccaacttggcgggccaatcgccagctgagtgctgacccttgcgcgagtacctgcgaattaatgtgtaatattagtgtgaaacgacagatgttacaaattattgtgaacaggcagattttaatgcaacaacgaaaagcatagtgcaagatcttaccggtgaacaacagctgggacggtggtcggaaacggtactggaaagggctgacggaagccgaactgccgtatcacgcggaaaggggcgtgaggctcaacgcagatgtcgaagaccatcggaaccgtagtcatccagtacgcctggtccctggtgtagagtgtggacagacccaacggcgcacgagcctggg

SEQ ID NO: 44395 - DNA, 1332 bp, Oryza sativa
  unsure (1)..(1332): unsure at all n locations
nnnnnnnnnnnnnnnnnnnnnnnnnnnnnnnnnnnnnnnnnnnnnnnnnnnnnnnnnnnnagatagaaagaaagagagggcacccaccaaaggtcgcgctgggatccgtcttcgtgcaagactcacaaagtgcatggtacagagccgccaacaacgcggaaccccagctccactgaggcacctcgcctaccgcggcgtcggcgatgctcctggtgtagtgcacgagtcccttgtcgacggcgtgcccgtgaccgccacagaacatcacccagccaaaaagccagagcaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaactgaagcagccacctcttcgtaggtccggtgttgcggtagtgtgccaacggctcgagcgggaggtgcggtgcgcgctgtactagtgcgaaacgtgccgtcagatcgtcctgccaatccacagccgtggtcactggcccaacagcgtctcccgcgagcggtagccccaacaaatacgatacgtcctgtagggtaggggctacctcaccgcacggcaagtgaaaagtgtgcgtctctggcctccatcgatcgaccaaagttgctaggagggacctgtccacagaccatcgtctggccgggtccgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattatgaaatagtaataaaatcatgagattaattatgtacaacaagattacaggctatttaaatatagcaaacgttactaatggtacataacgatgacgtgcaatttaacatatatgtagagttcaataatataacataacattacgtgtcgaagtccgacatacatcggcatacctaaagacgttaggcgccaaaataagacgttacatcacgagacctaaagacatgac

SEQ ID NO: 44396 - DNA, 709 bp, Oryza sativa
acaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcagcagcaatgacatgggtggatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactacagctcgatgtttcatggcctttttacgcaactcctctagctttttctgcatgaaagctccaaacaaaatgctattgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcataattccatatctagcaccacctgtgtca

SEQ ID NO: 44397 - DNA, 4250 bp, Oryza sativa
  unsure (1)..(4250): unsure at all n locations
ccttttcccctcctcccttctctttgggccgttggcccggcttgccccctccttcgcgcaagtccgtttcgcctccctcctccttcctcctctccccgagccgccgacaggtgggccccacctgtcggggtcacccccaacctccagcccaggccggcaactgccatggccgcctgagccgcccacgttgccgcccctcccagcgcgcctcccggttcccgcgcgcgtgtgggcgcggtccaccgcacgtcctcccctttatccactttctcccccattttcccccaaaaatcagcgccgttcgagccccactcacccacgtcgccggaacttcatccgccggccgttgccgcccgccacggccacgatctccacctcccggacctataaaaagcatccccggggccccctctcccatttttccccaaatccccaagtcgtcgcgccctccctcgcgctccccgcgccgagcccaggtgccgccactctccggcgaactccagccgcgccgcgccaccggtcccgttcaccccgcactgcgccgtcgccttccccggtaccgcagccgccgtgcgcaccccgtccaccgctccatttcccctctccacctccgaagtgccacagccacgcgcaccacctctttccgccgccgccgccgactccagccacacctcgccgcagtcctagtcgtcggcgcaccacgagacgacctccaccggcttcgccgttcgagggcaagcccgaccgctactccatttccctaacccctcaccgaaactccacccccactgttaacccgaggccgccgccgttttgccacctccggccgcctactgccgccatccctgtccacctcaggctgtgccaccgccatcactggcttcgcggttgcaagggcaagctcggccacttctccatcttcgcgaatcaccgaagaaactccctcccctctgctcaaggtgagctcggtttcctccgccggactccggccgtcttttgccgtcgtcccgcgccacctccctcactctagctcccttctataccttccccaggccctgtcgggcctcggccgcgccgcggtcttcgccgggagtcgccgaagccccgccgagctgtctatccgaggagcccgccgtcgccgttcctcgccgccggccgccttcccgtctccttctcgccatttgtgcgggcacggngagaactgcctcctcctcctctcccttttgccgccctcctcgcgccgtcctatgccgccgctagtcaccggtggtcgcgccgccgcgcgccatcgctcggtcgactcggctttgcgccgcgctcgtgcactagccgcgccgcgccgccgttctctcgcgtgcgccgcctgccgcccatgtgcgccgccgctccccgcgccgcccgccggtcgccgtcaccagagaccgcgcgctgccgccgcaccatggccggctgggctggtcttggccataccgtgcccagccgtctctcccctcagccgtccgatcggcctcgggtcgatctgggccacccgtgtgtccgcacacgtggccgccacgtcggtgccccgtcaacgtcacgtgtgcgccacgtggtgcacccgtctcgtgcctccgtggacttggtccacggtggaccgcccctttgagtcaccgacaggtggggcccgcttgccggcaccacctatcccctcggtgacgtcataattgattttaattgcgcaataaattcgttaataattatagaaattcatttaaatggttcaaaacttctaaaattcatatctaattcattcgaacttcaaattgagccgttcaacttgcaaaattcatctaaaattgagctctacatgtttgtttactttttatgtactgtttccttggtttttattagagtttttcctcattttgtgtgccagcgagtagattccgtcatttcggaagtccgcgatcgcgaggaaaagagttcggaagattcttttgaagaagcaaggcaagtcacacattccccttgagcatttttatcctaatttacaaatgttttatcgtttgcaaataaaattgcatgttttgctaattacatgggatccgggtattacctatctgctcgcttgtgccatgtttacttgatatctgtcctttgtcaaccttgggtaataaatcaactagctcatgttacttatgtgacctagctagacctatatgcttagccatgcttaattaccactagctcagttgatgggataatgacagtattagacccttttagtatcagaataagctgcgtgctcgagacatctggccatgcttcatagtcgtaattatctaactaaaatgcgactgaatggtgggctgtgggtgcatggttttgctagtcgcacccatggcaattaaggaccggttcgagggatgccctggaagaacttgtcgtacttaccacaagccagcgtaggcaacggctgggcttgtagtgtagctttcctctagctgacgcatccaggcaagggtgggcgtgatggagtttggatgggccctgtgacggcctatgcggcttccggattcacctaggcatgagaggggactgcctgctgccttgcgaggagtgggggtaaaacctgaggtgtggtgcgcttggttagagggggttatgcgaagggtcctgtcgcggcctctatccggtatgtcgtggtggcatgtcggcgcacggaaatgtgtcgtggggctgtgtcttgtgggtacagttgtacacctctggccagagtaaaactattcgaatagccgtgcccgcggtgatgggcggtcgaccagattcaccgtgattagtctcacacttaataaatcgactcaatgcactgtagttcaggtgggttggttgggactgttcaacgtggtgtagcgttgatcagtggagatttaatgttactttaattactcaacagttttactattttgctcagtaaaatgttttacaaccgcctttatgtaaatagccacaaaccgtccttttgttccccttgcacgtctgcatcattggtgtggcttgctgagtacggtggttgtactcagccttgctattattcccccttttcagaagtgtagtgcttttgagctgaagacgaagttagaggatcaaggctcagaccccagttgagttttgcctgtggagtggagctgaagcaccgctaggatcgcctttttccgctgctcgtgcttttgtttcggtgtgaggacaaagtgccttttctgtaagtatttgacgctttatttacgttgggaactgtttattacttgtcgttttgtgtacccggcctggtcctggatagggatttaatacacaaaatagtctagaaatttgggctaaatttttgggcgtgacgtgtataacatgcctattaatatgctctcgagtgataaatttcccgggtgatgtaaatagaatgcatctcatctgagtagcttatgatctgagtagttatccctcatgggacgcaccaaagtagatgcgaagttgaatcccgactggcgcaagtactcggctgatagccctcatggagaataatgaatagtccagtcgttgagcataagaaatcgactcatgaccatgaattcatgttgcatgtatccagaacaagtccaaattgaaggtatgatacttgtgtttgagctggtaagcccctgagtatatagcttgtcattttgtcgtagtcgaaattatccattgacgatagcatatgcagtcggcatggaaacgagatgaccaacatggggatgacatctcccattagagatgatgaagatatattggtggtagtaaagacagtgacaccaatcaaagatgacgaagtcgcacagctacggaggcgaagaaaccagtcaacaacagtcaggtcagccaacagtgaagatgaaggcgcccagcaatagcgacagagttgtatagccatggcggcggaacaatcagtcggtgacgaggcagccggtgaagaagatgaagaggcctattagtggcaatggcgaaattcaccaatcatgaagatgaagaaaatagtcggcgacggcaaacgcaaccgatggtaatgacgattagcaacaacagagatgatcaactatgatgacgaagtttcccatcaatagcagtagaataggctatgttgaagaggcttgacaggatgttgatgaagatgacgatatcggtgatccagtcaatagcggtgtagcagccaatgataatggcaaagatgctcatcagtgttt

SEQ ID NO: 44398 - DNA, 4116 bp, Oryza sativa
aaatagagacatccatgagcagcagtataataggccagccatcaaggcggagacaccaatcagcaatggagaaggcaagctggtgatgacaatgatgccattcaatggtgacgaagacgtgcagccgtggaggcgaagaaaccagtcaacgccaaacaaggcggccagcaatgaagacgaatgcgcccagtagttatgacggagttgtgcatccatggcggcgagataatcagtcggcaacaaacgggagcagccggaagtgaagacatagacgcccattaacggtggtgtgacgaaccaaccgtgaaggcgaagacacaccagtcggcggtgacagaggcaagccagcggtgaagatatagatgcccaacaatggtggtgtgaccatccaaccgtgaaggcgagcaaaaccaatcggcagcgacggaggcaagccggtcggtgatgttctgactgatccattcctaaagcgtaggacataagcttaatgccatgaatccatattatgcatatctggatctggatcctgcaaaacaaacatataggatgagtagtatctgatgtaaatacaatacttgagaaaaattcaagtattttaaaatgtttataaatatgtatttctcctcttgtcaattttgatttccccaagcagatgactccttacgtttaaacactttgcccgactagtcatagcccccacgcatcgggaatgagctaaggcacttcctagacatgcatatgagtgacttgagttcgtcattaatggaacaaagtttcacggattagaatttactacgcgggtacttttgcaatggttgagagcagaaaataaattatcttatttctgtgcttttgatttcttccgagtaatacttagcatcttgcattactcggtccatccaacgagcccccggtaggaatcagcccaaaggcaactaaccatcgacaaaccaaacgggaagcatagaaagatagaactccataacttgataggcactttatatttttactcggtttatttcgcaagcaattaagatagatattatgaaaattttttgaaaaaatatgatataacatctgtagcccccaactcactactcaatagagaaccaattgatgtagtgaggtagagaaaagaaaaatatcataaaaaaattgatgacttagctttttggtcttcgccttggtgacggcagaggtggacgatgtggaaacaaattcgtccatcaatagcaatataaacaccagccgtgaaggcagctgaggcaactagcggtgaagatgaagacgcccatcaacggtggtgtgaccatccaaccataaagacgaaggatccaatcgacggcaatgaaggcagtcgtcagggaaagtgaagacgcccatcaacggcggtggaatccgccaaccgtataggtggaaacaccagtcgtcggtgatgacgacagccgacagtgaagacgttgatgcccaacaatggtgatgtgaccatcaaaccgtatagacgaggacaccagtcggctgcgatgaaagcaggccggcggtgaagatgtagatgcccaacaacggtggtgtgaccatccaaccgtataggcaaagataccagtcagcagcggacaaggcggccggtcggtgaagatgatgacgcacatcaacggtgatgtgaccatccaaccgtgtaggcgagggcaccagtcggcatcagcgaaggcgagccggtggtgaaaacgtagaccaaccagccatgtaggcgaggtcactagtcggcagtggtgaaggcaagccggcggtgaagacatcgacgcccaacaacgatggtgtgaccaaccaaccgtgtagtcagagacaccagtcggtggcggacaaggtggccggttgctgaagacatggacaccaacaacggtggtgtgaccaaccaaccgtgttggcggagacactagtcggcggcgacaaggacaggcaggcggtgaaagtgaagacgcccaccaaccaaccgtgtagtcagagacaccagtcggtggcggacaaggtggccggttgctgaagacatggacaccaacaacggtggtgtgaccaaccaaccgtgttggcggagacaccagtcggcggcgacaaggataggcaggcggtgaaagtgaagacgcccatcaacggtggcgatgtccgccaaccgtataggcgaaaacaccagtcggtggcgaccaaggtggttgacggtgaaagcgaagacgcccatcaatgacggcctaataggtcagccgtgaaagcgagggcaccagtcggctgcaatgacggcggccggcggtgaagacaacgtctccatcaaaaatgacggcggagtaaaccaaccgtggaggcaagggcaccagtcggctagtgctgcttttgactcatcgtggccgaggaggaattataccaaacaaatagtttgtgtaagccttggtttttgatcgggctcagccatcgatgatacatgcaaaagtagaaaaaaaaagatcacataaaggaagctttttactaatctcagatgactacatcaagttgatagaaccatactaagaaaacttccggcctttgcataactaggatgcacataggcaaaacacacacgagcccacaaaagactttgtaataagagagggaaagcactaaaatttagggagcaccaatcttcaggctagaccaagcttacaaagttaaattgaaaaggaaaacaccaaaaacttgccagaagctggattcgtggatgattccacgatttgagaggaaaataagtttctgttactagattaaagatcaaaaagatataaccaaataatagaaccggagaggatgtctgacgaggatgtgcatatatacttaattgccattaaacttgtactgcatacatatgcatgtcgccgacttctctgtatgcatgcacgccaatttcttgctagccaaatagatacgggacacaactggaaatatggtcctctcaacgggtgatgatcacgtgtatagcttggcgtcaatcaatcatgttcggcttggaattgcagattggacttgaaactcgccgccgagtggttgtcatcctccctagccgattagacccgaatctgagaggcgaagcttgttggcgactcctgtattttattccatcccctacctggcgcgccaactgtcaaaacaagaattcgtcaataataaaagggggtagcgcacgagacctaaatgtggatggatgcggagacaaggatttagacaggttcaggccctctcgatgagaggtaataccctactcctatttggggatttgaatccgccgggtgtattatagatccgacgatctggttgtgaattatgccccatagagggtctcctgcccaccttatataggacggggggcaggattacaagatagaaaccttaaccaatatagtatcagtttcctaaatctactttacaatattatcaaatcaaaactttaggctgttccataatatataagaaaatgtaatacccaagtcatgatccgttacatatttcatagatataagttatcccctataaccagtcggataaccatgccgtgtgggtatagagtacccataatctccacaggtggaggtgctggtgatcggtggtggctgtggtagagcggaggaggttggaagacgaggttgacgatgttgaccctgtgtgacacttcttcgtcacctgcaactgagccccctagctctgtcgatcccttccgcaccaaaaattggtatcgcactatgccggtgtgcccaatgccaatgcatgtacgccctcctccacagcatcagtaagtctctatccctattatctgttgatcttgtggtgccctcctccatggatttaaatcttgctttgctacagcgcataagtgcataacagagtgttccaatttttgctcctgaaattttttagtggtgattctctcccatgttcatctgattggatctggtggtggcagtacggcactactgatatatgttagacatggatccttatccagccccctcatatgcctaggttgtttcaagatccaatttgcaagaaactttcctagattgctatttaattcatatgctttctcgttatagggattta

SEQ ID NO: 44399 - DNA, 1490 bp, Oryza sativa
  unsure (1)..(1490): unsure at all n locations
acccacatcatctccttgtaagggctcaaaacccacctcctacctcagtcaaaggctagtccaaggtcccccacatcggtcaaatctcggtcaaacccgccaatgacttcccccaccaccccctctcttcttagctctcgtatcggaacaacgtagtaacgtcttgtttatcgtgcagtaacaccgtgttttacttgcagtaacaaaattaaaattcagtcataatatagtcatgatggatctacttttgataagcactttttttcgaacatcatggtgcaaacggtttttaaaagtagtacatgatatgagagatattgcccttcaaagatttgttcttaaaaacttaactctccacgagcagtaatagtatatcaaaaggtgttactagtgcatgttttgcgttactgcaatcacatcatgtcgttactacaagatgtagtaatgattataagtttcatagtaacatagtgtgttactgcaattacttgataacatcactacaagaatatggggaattggttcggtttactcgtttgttttaacccatatatttttttattcctggtttactacaatttcatcacgatgttactgccaaattaagatgcagtaacgctctatatgtactacagtaataaagtttttttactacagttcttggatagtgttattgcataaacatgcggtaatgtgtaactatcaagtggtaacgtgtatctgctgtgcagtaacacttttacttttgtgcagtaacaagtatatggttagcatctgagactttgaacccatatatttttgttccaattccaggtttacaacaattcaccacaatattactgtcaaaagtgcagtaacgtcatatacatgcacgcagaaacactatattggagggtggagaccggttttcttgagaagaaggaggaagaacgatttcttgaggaggggagtatgtagatgcattttgaagtttaactctccacatgcagttgcactatagcattatggtggaaacggttttaaaaaataatgcatatcttgtgagatattgcttttcaaatattggtattttgaactttaaccctccacatgcagtaacaaaatgtgtaatatgcagtaacaggggcatatacatgcagtaacatggtttgaccaaatgtataaaattgttcaaaatactcctacatcaatcagacctcgctcaaagccaactacagactttacctatggcccacctattcaatcttcatcttgtaaaaatgacataataaaactacaattattgtgcagtaacatagctacttggaagtggtaacatgcacctattatgcagtaacacttctacttttgtgcagtaacaactatatggttagcatgtgaggctttaacccatatatttttgtttcgattcttggtctactacaattttaccacgatgttactgccagaactgcaggaannnnnnnnnnnnnnnnnnnnnnnnnnnnnnn

SEQ ID NO: 44400 - DNA, 13814 bp, Oryza sativa
caacttaactaaatttatagttggttagggaaatcaatactttgcaaattaacttattatgtcaaaaccttcttaaaagcttacctagactaatagaccatatacaaaagttcttaaacaggatcaaaagttgcgcaagcgcgactacgtggctagtgttgttctttagaaatcccaagtaacctttcgagttatttttgcgaggtgaattgacatatcaaattgcacatatctttgaggaaatgctccaatggccctttaatccaggattaaagaaagtactttttaatgcttgagtagaaaccttaattaattgcagtatgaataattcaggttcttcattatcctactccctccgtttcaggttataagacgttcaactgcttcaagtttgaccaagtttgtagaaaacaataataatattttcaactcaacacaaatttattatgaaaatatattctattattgatttaatgaaactaatttggtattataaatattactatatttgtgcataaacttagtcagatttaaagtagtttaactttgaccaaaatcaaaacgtcttataacgtaaaacaaagggagtatataatactctttcttcattttttggaagaatgttgtggcctattctgtttgttattaattattcagtggttcaacaattgttaaatactatacaggctataccgtctttagattaaagttgatgcatctatatgaattgcctaccaattgtttttcatacattttagaggaatgccagatatatgaaccttttgctagcttcctataagtggaatattcaataatcaaactcagataaaacctacagtgaacatgacatagcaacacaatatttattgcataaattatgccaagttactcttaacatcttgttaggtagcaattgggttaacatatctctgcactactggtatttgcatggctttccttggaagatgaggaaagtgatgatgcggtgtgtagaaccaagcgtggtgaaggatgtggaggacacagtcaagttccttgtttccaggtgaggtctaataggatattttcaactgaacattcatccagaattattggaggaacctcactgaaacgctgataattaagaacttcatgtaaaaaaaagaatttgagggaaataatcttccattttgctgtgcaaaaatgtaagctttttattctggtaagcatggtttgtgtgttagtgatatgccctagaggcaatcatagagataattgtatcacacactatgtttacatatttatccgacttcattccttgaaatagataaactcattattggttaatgaatatgtgattctttcatgagactctttatgttgtgtgttgctatttctaaaggatccctgatcaaatatcatatgtggaacaaatatgatgattagcatatgtattaattgatgatcatgtctcatggatcatggtatagagataccaaattaataatgtggacacatgttagtgaacatgttgttggatagacccaacatgagacactgcaaaagccgtatgtgttgtgtcatcagtgatcttatttagtgttggtgttgaatccttagacctgagattatgatggttcccaacatgtgtagtagcttacttaaggactgctaaacgctactccgtaattgggtagttataaaagtagttttcgggtatgctatgaaacatgtagtgggatatgaataattaagatgggatttgcccctcctatggagagatatctctaggcccctcggtgttgtagattatagaagtgcatggccatgctaaaggtgattgaggagacaattacaagttatataatctatcaacaggttcgagtgaatgattgagctattagaggatggcacatatctagccttgagcttaatcgatatcgtgaggcaaaggggttcatacaagtatacactagaggttcagccgatatgatctttgtgtatgcccagtgggtaaatacgttctgctaggggccgttgttgacacgtggacagaaaaggagttttcgggttacagccgagtgtacatgaacctacagggtcgcacgcttaatgggccggaataaggggattggatggagatccaatatgagcttaattcggatagggatccgaataggagtcctacgggccttggaggctcgagtgatggatcctatatattcgtgaggggtgtgaccgacgaaggtattacatcacatgagaaaccctagccgtcacttccctccccgagcaaaaccctagccacgcgcgggtgctagcacatctgtgcgtggcgttccgtccctgtacgtgtggataccagtagaggcgccgctggtttgcagtgctgatcgacgtgggagtacggcgagaagaacgcacggggaggagaaggtcgagccggtgcaatcaactacttcctctacatcgacacgtgctacttcgcgagagttccttcgacttctcagtgtcttcttccgcagcgcgtcgagtgataacgatctatgatctaatacttgcatggttcctggtttacgcgatagaaaattttgatttatgctatcgtagcctacgcgtaacccaacattgtgcactaaggaaagagttggaaaatatcgtgtgcagcattttgtgcgtatgcaagtagttgaagaattccaccaagttctgctattgtgctattgtacagtaactattgtgctattgtacagtaactatagaagaatggaacttagttcaaatttaggggatatatgctaataaaagtacaagggaatgatgtgcattcaatttgatatagttcatatgaatttcactttcttgaaaatattgagttttggttttacttgttaagccttcatcaaaatgcagaaaacacaggatcaaactaatctaaatcaacatctctccttcaagttttctaatgtcagggtggcctttccttttctgaatgctgtaaatacaactgtttccctctccgatgatctgtttgttttctacatgcttgcataaattgctctgcttgatcaagggaaaatcaccacaaccagcaggtgttgtttgaaaagtttagcctaggttttggtaaattgaaatttaccatgttactatgacatgtacgagaatttaggaatatgaaattatatttggggccaaatatattacaacgatatactatatatcattgtttggttttttgggttttgagacatttgaacttaatttgctaaaatatgtatcttttagcatttgattgtttaattcgcattactaaatatcgatgtagtgttagcatgggcatattagtcttttaagtattcattgggactgtataacaaaaatggttgttttgcctagcacactgtagttgcaagtgatgttttgttgtgcacaagtttcgacgagaaagatgtatcatatttttctcctgtacttttgcataatctctactattttaaaaattaaagatgtttttgccggtactttagtacgtcatccgtgcatttgtcggtttttaagtttgttcgtttttggaaatacatatccgtatttgagttagttttgaagttcattcgcttttggaaatacataatgaatcatctacaatatctcttaaaaaaacttacatgctaacttgaaacgattagactgctaattgcagctcatgattttcttaaaaaaaatccaaacgagttctgatttcaccttaactaaacgtataacaataataaagctaaaattgccttcacccgttgtaatgcacaaattgctttcacccgttgtaacgcacgtgcattttttctagtttaattataaagtcaaaagtcattgtgttcacaaactgttagttatgcatatattattgtttgctattatggtatttacatatacggtcctattttttagagggcttttacagtacctcccactggtactagtagtgtagtaaaaatcaaatccaacccttgattgtaaaatgtgtttttcagttttactctaataaggtggaaggatattttgataatttattactagcctcccacgcgaggcaagacgactgatctcgttctgctcaactccccgttctcaggaccgccgccgcctgatgactgacgtccaccttcgcctctctcctcaactcctcctcgcggctcaagtaaccacgggcacggcggcgccgcccctccacctccctacgcgctcaacagccagcgcccctccttgtgcgaaccgatctacggcggcaatgcccatcctcctctacgcgcgtgcgacgaccgccgcttctccttgcatgaatcctcgctcgtggtctgtggaggcagcgctcctcttctgtgcactgtgctctcaatctcctgcactgcattcgagacgtcaactcagctgccatgccgccagcacctaagtactgaaggaggaactttggccttccatgattcctgcagagaaattcagtcttgcctactccagagaaatgatcgatgtttcaccaagctattttcttatcgtactcgtttctaccatattaactcccatataggacttggaagaactgatacaaggctgttaatttgctttactggaacaattcactgttaagccattggggagaatgttgaacagagaagggagctttgtacttgtagtacagaaactctaatgcccttctctaatatttgtacatcattatagttttttttaaaatacaaacgcagacgttcacaaacaacataacatatagttttcccttcatatgtctacctgctccttttgaatcatttttgttttcgcctcccattctctttctcttctagttatttttattcgggtcacaaaccgatcgagattgcaagtgtctaaagcagcaaatctaatgtaacagaccacactacctacatgtggctcttccatgtggcacatgcatggcatctgaactgattaaattgtactactgaattaacatgttgagcctgaatctgaactacgtaccttcctactgaacgctagatcaaccctggcaactaaccaaaatcatatcatggggaaagaaacaagtcagtacatgtacagcaccggtggttatttgtctcatttttggctaagcacgcccatttctcgaggcagattcctgtggcagcaaagacactagctccaaagaaaggaagagagatctctcactatatttattattatcagaacaagatattatttaacatgttcagaaatatccacaatttacatgcacagctagctccttgcatgtgtcctggtctatcctgtaggtcagttggatcagatccaccagaaagaatgtaccaaacatggtccggcccctgatcttggtctcgttaaggataattatgcatcaatgtctgctgcgtacatgtaatatgtaccatgcgattgcatcattgcgatttgattcttttctacgctccagttgtacccacaagtggatctatatatgtatgatcgatacgtctctgtcaaggagcgctgatccattttatcatgtagcccatgcaactagctacaacctagtgatcgatgagattgttttgtgttccatggtcggctatgcgatactgttagattagattctttcccccgtgctctacagagcatgtaatttaaggatcaactacagctgcaaacttcatgggaactatggctgctatttgtgcaacaacatgatatctgcactgtattatacctaactgtgtttttctatgataagagctacgaaaaatcatactaaccattaatgtatacattttattaataaattacagcctaaaaaacaagtgattatatatacttttttttatccttctaattaaatttaatcaagaatgttaatcttgccaaaaggtgaaagaaacgcccattcagaaattgggggacctatttgtcaatttatattcaaatgttaacaaatttagtccaaattcaattctattcaaactaaatttgaaaaaaaaatgaacttgaaacaaggttgtattttcaagtctcaaattgttatatgtgaaagaaaaattaagagtaaatttcccattgaaactacatgaattttgaccaaattttgtaaaactacagatttaagacgttgtatcacaaaccatagatttaacacaagatttatcacaaaactacatatttaaggccaaatatcacaaaactatagatttagtactatagttatcacaacactatagattttacaatttcaatccttaccaccagtgttatgttagagttataaatgttgtaattttgcacttaacatgcatggtgtaaaacatgtagttttgtgataattttaaaactatatatgtagtttggtgatagttcatcttaaaattgtagttctttgataaaattggttctaaatctgtagttgatacaccttcttaaatatgtagttttgttataattttatcaaagtatatgtagttttatgaaatttactcaaaattaaatataacttaaaatttcaaagttatttcaaaattttggtttgaaaatggaagtagaatagcatttcaattagtctatttattaaaatttcactcgaaatttgaactagcagatatttttttcttggtattaatagctatgtgtggactaattattgacaataatagactttaaatgataagaaatgaaatcttgtcactcaataggccgggaggtaagagaaatattaagccttggataacatctgtttcctattctagcctccgatatccgaatatgattgaaaaggtacgatgattgatgaatgttcaatggttccatagatgtttttcacccacccatggatacgcaataagccgtcctagcataatggagttcacaaggatttggtgtaactctagaaaattccaaattatgatatacatcaacactacgtgttggcggttttgtcggtttttggttggccaggttttctctagtgatgtagcaatggactaggctgagtggcggggcatcgtgccaatgagcagagggtgggcggctggcagcatgatgacgacggtagcggttgaggaggcaggatttcacagcgcaacaacgaagatggtggcggtggcagggatagtgcttccaatggtgatggccctagcggtggtgactactagttcgggtgcccctacacccaaatcaggctgtgtgacaacaagtgtaaccattgaggcaatagtgctttctagcgtggcatcgtggatggtggtggtgatggctctagggatagtgcctaccagatcgtgggcttccgtgtccagatccagccgtgtggattggaggcaagctcaaaggcagtgatttgacagtacaatgacgaattcaatggcggtgttacgacaatcgaggtgggtgaacccaacatccttttggtgagcaaggtgaggagtggaacgaagagattgacgtaggtgccagcgatagtagcggttagaccgcgacgctagatccagggcctaagtgcccctagatcggatgtgtttgtgccaggatccgttcatgcaacggtcaagggcaatggctcttctctgcctttcgtggatggcgttggcgagcgaaggcactagggggttgggagctatccggtttgtcaaatggatgtggtcgtcagtaggggcagttggacgaagcaggaatcagttgaaggtggatggatcgctaatctatctatctatctatctataataattatctacgagctctcacgttaatcagaaaaaatctgactgttaattagaaggatcgtattatacaaccgtatatctttaatccaacatgtgtttaatataaattattgtaggccaattctaaagcccaaatctgttgtgcgtcatgtacgtatatcttatcgtctccctacgttttttatccaatctccagtcacgctacctacactatacaagttgcttctttcacgataaaagtaggacgtgtctacaacgagaccgttctctgtatggtcataaccagctacctcaatctatctagttgctactagtatactcaaaagtgtatgtatttttttcttcttatagaattttttcttagattactcatccgatttacgatccgattacaccattgtgttcataacaattagatctttataacaagatctcacatgactatatttttatgaaaaaatacaaattacttttataatacatctaaattacttttagattttattaaattacttcttagtcataaaagtaatttaataaagcttaaaattaatttacctatattatagaagtaacttaaaacaaaagtaaagtaacttgttacggcattaaaagaaatctatacattcataatgttattcataatattgtgagttgtttattttataatcatttttagtcagtgacgtaatttgtgcttattaaatttaatttctatatagactcatgtttttacctctataacggatttagttttgatgtcgtgataaagttactttttctttttgttttaagttacttttataatttatgtaaattacttttagactttactaaatttacttttatatgtctaagaagtaatttagtgaaatctaaaagtaatttagatatattataaaaataatttataatttttcatcaaagtataatcatgtgagatcttgttataaagatttaattgttacgaacacaacggcgcaatcggaccacagatcggataagtagtttaagagaaaatttaatttgaagtataggtggttcctatttgcttgaaacacagggataaactactctctctctagcgtaacagagtgcgtcacgtggcttccgattcggtctgttctggccttctcggcaatatcggcatgtggaatagacgactacaccagcgtgtgggatcggacggccctagatgcgtcgcgtgataggaccagatcgagaggcctctcgagatagattttacgataaaagtaataacatatacctgataaatggtatcttagttagtttccaccgttatcatagctggtagaaaccatatgctgttgatggattggccatatttgcatttggagtactggaaagggattcacgtacattggctggtagtttatacgatctggatcgaggtcgtcaaccatgcatacgatgatccggccatctggagacttcacgcggccgatacacgtgtggtgtgggacttcgtcagagacgagagccgctgcagcgaaattcatcccgatttgcagacatgtgtgacttgaagaatgaagatcctacaattcaagtgctattcctttttctcaatcaaggcatcatctaaaacaaccttgatcgggggatttgcaattatgacactgtaaacattaacctttgctataatgacattggacctatatttcatagacacagatggacccatttatcattcactcagagtgtcaaacaacgaagccctcatgtttgcagttccaattttgcaattttctcacctttgatcaggaatagctacgtacgtcttggtttctatttcgcaaacaagattggtttctaattaacgcggttattcctcatctaaaacgactacaccaagcagaagtacggcttatccgcttatgctatatcatttgacacaaaaacatccagtgtttggatgttcatccactaatccagttcttctgcacctaaactgacccagtaaatttcaggtgtttattagatgttcatccactaatcagaaagttcttttgcacagtaactcagaagattcgtacgtgatttcaagcacaaactaaaataagttcttagggacagccataaaatttatattaaataaaacacaactctatagactaattaatttttttaccttaatataaaagcaagaaatcaaactgaggtacagtagattctataatttttgaattattgaaactaataaatgagactctaaaccgaatatggcttcatgtttattaattatgaattttggaattattaaactgtaacaagctataatagacattctcgaagccaaatacatatagtttggtacttatcaattttaatttttactattttaaaccgtgaactataaatataatagaatttgtttaacatttgaacttcaaaaaaatttttacatgtactttcagcaatatttagtaacaacatatttaagatgtaattaaatttgtgctattcataatatatccacaatttaattctaaatttcgtaattattaaattatgaaacatactacattgaatctccaacacaacacaaatagataaaataattattaatttcacaactccaaaatataaaataaataggaaacaacataatatattaagtatggattcttaatttctgtcaaaatagcgatggattctaaatttcagtgaaaaagggattgattctgaatttcagtcataaaaaatgggatgggttcttcatatagtatttcatttaattgtcaattttaaaactaataattatcgagtagtaactgaagttgactgttattttgatctattacttcctttttatatgacatttaatagttcaaaaaggaactaaccaatataatttaaaaaaaggagtaatcaactataatttgaatgtaaccaacgtattcaacatttgtctcaaattttaataaacttttatattattgacactaataaccatccaaagcacgtgtattataatattattgttaacacaccatgaaacgcgtgggttggcgtctagtgaaaggctaaaaggtggttgggctgctccctggatcaccacggtttgttggagcggtgaagcaagaattggatgtagttttgaagcttaatcttctaactttatttctttgtttttcttttattgttcgttggttacgagacttggagtcatgctgtaacttttggctgcagtatatccacttatggatatacatgtcaaatttttatctattattgtaagaaaataatgattgttggcgaaacgacaaccgcatacgtcgaaagacgtggtcactcaacagtggttgggaaagaagtaaagtgtattaattagagaatttttcttcgggatcccccattacatggccctatgagactatttatagcccctattacaggttcttactactagggttttggttatacaggggaatttacatggttacccttatgaaaagggaaatttacatgggtacatagtgtaattgaggttcatgggctcctgatgggccgtcgggcgatcgtcggcccaatagcccctaggcttgatgggccgaaaaggcttcttcagccctcgcgggggcgagcttgctttggcaaagtcatctccctttggcatatactcttcgcgctgcatccttcgcccaagaggcctctggcttggcagagtacccgtgcgatccctcggctctcgctgtccttgttccatagtcttcgccatggggggacttcgccccgactaactttgacgtctcgggcttgaatccccactcttcgcatagctttcggcagattttggtcgaatggcctcatgccataccgccaacaagctcctcacgggcaagggtgagattggagcttcggccgagaccgtgcaaaccatgtggtatggtgtgtggcgccccctttcgatcgatgctcctgccgaaacctacattgttcctgcaaataaagtttgttgtctgtgtggctggtattgttttgccactcttcgcctcctgcggacggtggtatattatttttatctttcccgggccaaaaggaacagtaatgggccttccctttgtgggctttttactttgcagctcggtcgatgggaatttaccgttttgcctaccctcgcgacacgtggcgctttattactggtgggtaggcgaaccgttgcttcggtgggctatatattctccccccgttctcttttcaccgccagacttgtcactttcaccgctcgtgctctcttcctccgttcttgctctcacggtaccccttggcccttcagacctttcgctcgctccctttgttcgccactgcacacaccattcaccactgcatatgtccttcgtcatggctccccgcaagcctaaccccttttcggtgaaagggcccgaccccggccggattgacgatgacaccaccgcctatttagggatttctctcatagatgacggcgagcaggagaagttggtcagctctgggacgttagtcgagggacagactttcgccctggggaaagccgttgtaccgaagcccgtcgacaaccggacggtggtgttcgccgtgttttttgaggcggggctccggttttcgtgcaacgcgttgttgccggagatccttcgccttttccaggtggagctcccacagttgagcccgtcggcgctggtccggatcgctatcttcgactaggcgtgttggacttccggttttgagcctagcgccgaactttttggcgccatatttttcgccatcgtgaattcgaagacagtggttacccctgctgggacgaagaaaacagtgttcgggagcgtgaactttaatgttcgccccgagcggtccgatctctggccagtgaatgccgccatgtcgaagtgggaccgccattggatggcgaggtggttttaccacaccatctccttcgaggctggttctaactcagcgaaggccctccggtgccagcgcagggcgattgcgccgaaccaaaaacccaatatcgccgtggacggcgctatggaggcgcggttcgctctgctgcgtaaggtttgctcctgccttagctgtcgcgacttggtggaggaattctgcatgcttcacatctttcccctctctcaatcatggcaagtcgcagttgatcaaggcaaagaggttgatggtttgccgaagttggttctccccgagggaacgaatggtaagagtgctctttcactacgcactcctgcgctttgctattttgatttgttcgacgcttgatgtggctacacccgttatttttgcagtgttgaccctcgaccaggctgacgccgaagcccgtaggatgatcggcgatgtgtcagtcgtcgagtatagccagctgctgatgtgacaagcagctggccgagcgaaccgggtttacaacggcgaattgcctccccgggcgaacccccacaaggcggacgacgatgcaggaccttcgcgaaagcgaacgcgcgggcaagtgaagcttgtccctaggaagcgaagggttcctgcttcctccgattccgacgccgacgatgaggaggacgtcgaagagcgtgacggcgaggaggaaggagaggaagaagaggagacggaggtcgtggctgacaaggccgcggacgagacggtcgaaaaccgcgtcgacacccctggctacactcctactccaagtccaggtcacaacgagaccggggtggagtcgaacagctccccccttcgtcgaaaggatttggatggggcgaaggcgctaattgcgttttcggcaggcagggcggcgaagggaggtccggtcaaaaagatctccaaaaagaaaggacttgtcgatgtcgctcgtgtcttcaacgatgacgagtcttctgacgagactccgacttcgcccgctagccgcagcctggacctttcaaccgtccccattcttttcctcggcgctggtggggcaggcgatagtgccgccgcggggcttcagcctctgcggaatggatcgtgcagctgcggcgagggtcttcggtagccctctgcgtcagccggttgtttcgccgctagtcaaagcgaaggggaagggtgcgg

SEQ ID NO: 44401 - DNA, 1129 bp, Oryza sativa
tcccactattatcttcatgttgtcattatttagcatccaacgtattcctttacaccttcgaccttgaagggttcattcccattggatcatcttccaagacatggcattgcctggtaaccggtgcctgcacttttcactccgtgtagcatctgataccgagttaaagatttcattccttgccttcaaacaaacacttttacctaggtcatcttgcttactcatgaaatttttttttctacctcaatgacaaggtgactattgcagggtgatcaggggtcttcctcgagtgatgcaaagcatgcttctgattatcctttatcaatcacctttcggcctacttctttccggctagagaactgaggtcctttggcctgctgcctttcagtgaaaccttgaagtggttcgtcaaaaagctgcactgactaccttcagggaaatacattgcttgctatctgtatctatgccactagggtttaattgccgatgatcatctttagtgcttcctcgagatggggagcatccaaattgttcttctgccatattacccttgaaccttttctgatacctgatagactaattaccaaccatcgactactatgttctcaaatattgatgtctcctagatcttcttaactgttggcaggtatatccgaacttatcaatgtagaggcatggggggtacccttatgggtttcatccaacaatccttatcttgatctgtaaaaggcgtatccaaactcttatccccaactactgtctcattggctttttaatccaacacagtttaattggttttcttttccatcaacaggttggttattaactcgaggttagaatatagttcctctgacacgagaccctaggtctcctttattagtaagcaattatacacataatcccatatccgcatcttccaaaagaatcctcatagaacatgtctatattacaaatttctcccttattaatgaatactaagcactgcctaaaaggaaaggtgcttagcatcggtacattgtttctgctatgggttatgattaacacgaggcctcacaggtatggcgtttgctccagtgaccacaatacgattaggatgtctgcttcgtgtaaattggcggtaatgtggaggccg

SEQ ID NO: 44402 - DNA, 11771 bp, Oryza sativa
  unsure (1)..(11771): unsure at all n locations
nnnnnnnnnnnnnnnnnnnnnnnnnnnnnnnnnnnnnnnnnnnnnnnnnnnnnnnatataatcgcggtcagaccgacggcaaccaggctgtcagaccggcaggacaacttcggtctgaccgcgatccgtcgatttcgagggtaacttttattttcgcttaaagttttcggtttttgggtataccaaccattcaccccccctctagttggcttagttcttgtgattcgatcctacaagtggtttcaaagccttgttttcttctttggatttttatcgatccaaagtttttgccatggctactcctgctaggttttcaactaagcctcatgtttttgatggaacggatttttctcattggtgtagtaggatgtaatcttatattatggctgaagattatgatatttggagaaaagtttctcatccttatgtgattcttgaagctattaatactgctgctgaaaaaactgcttttgaacaaaattgcaaagctcgcaatattcttttgagtggtatttctcgttcagattatgatcgtgttgctcatcttcaaactgctcaggagatttggagtgctttgagtaattttcatcaaggaacaaataatattaaagaacttcgtcgtgatcttttcaaaaaggagtatattaaatttgagatgaaacctggagaagctttggatgactatctttctcggtttaataaaattttgagtgatcgtagatctgttgattcttcttatgatgctaattatccacaatctgagatttctcgccactttttgaatggtcttgacatatctatttgggagatgaaagttacatctattcacgaatctattaacacgtctactttgactttggattcactttatacaaaattgaaaacacatgagatgaatgttctttctcgaaaagttgattctaagtcgagtgctttagtttcctctttggatgttgatgcttcttcatctaagtcttcttttcttgctgtttttaatgccacatccgatgatcaactcgaacaaatcgaggaggaggatttggctttggtttcttatttgaaaaattctttgctaagattttctgatggtaaaaagaacctcaacatgattttggatcaatcagagattagcacacataaccgtggtttaggttttaatccttatgctcacaattttagacatcctcctgttgtgttaggtgttggtgctagaagtggcaagattttggttaaacttgatactaacaaaactgtgcttaaatctgttggtgtcatatctaatatgaatgcatcttcttcaaaatccaatgttgtgcatgcaaaatctcatgttgttgctcatgttgataaatctactagtgctaccaatgtgtctaatcatcgtgaaaaatatacttgttctttttgtggcaaagatggacatattgttggtttttgtttcagattagttcataaacagaaaaaggagagagagagattgcctttgcaaaatcaaagtggcaaaaatctggttttcccttgaggaaaccggtctgaccgcagtgggtcccgcggtcggaccggcgaccggtcagaccggctgaacagcctcggtcagaccgaccaccggtaaaaaaagggaaaccccgggcttacacaaccttcggtcataccggcctcggaggaatttttctgtaaattctaaaattgattttgcacgtggatatatgcctattggatcttctggtcgtgtgcctcagtactgacgcttcgacttctgcttgtgtgtaggctttggtggcaagaaaggagaatgtgtggatcgtggattccggttgttcgcgacacatcaccggtgataaaaattggttctcctccctaaagaaggcagctaagattgaatcgattatctttggtgatgctgctacaagtgccgttctcgctacaggtttggttaaggtaaatgaaaaatttgaattgaagaatgtagctttggttcaggacttaaagtacaatttgctttcagtttcacaaattattgatgaaaatttttgaggttcactttaagaaaactggaagtaaagtttttgattcttgtggtgattctgtgttgattatttctcgctatggaagagtgtttaaagctgattttgaaaatcctatttcacctatgataacatgtttggttgctaagtttgataaagatgtgatgttttggcatcgtagacttggacttgttggttttgatcatcttactaggttaagtggtttggatcttgttcgtggtttgcctaaacttaagaaagatcttgatttggtttgtacaccgtgtcgtcatgctaagatggtttctacttcacatgctcctattgtttctgtgatgacggatgcaccgagacagctattacatatggacactgttggtccagctagagtgcaatctgttggaggaaagtggtatgtgttggttattgttgacgatttttctagatattcttggcttttctttatggcaactaaggacgaagcttttcaacactttcgtggtttgtttcttcgattggagcttgaatttcctggttctttgaaaagaattcgaagtgataatggtggtgagtttaaaaatgcttcgtttgaacaattttgcaatgaaagaggtcttgaacatgaattttcttctcctcatgttcctcaacaaaaaggtgttgttgaaaggaaaaaccgtgttttggttgagatggctagaacgatgttggatgaatataaaactcctagaaaattttgggctgaggcgattaacactgcttgttatatttcaaatcgggttttcttgagatcaaaacttggaaaaacttcttatgaacttcgatttggacatcaacccaaagtttcacatttgcgtgtttttggttgcaagtgctttgtcttgaaatctggaaatttggatgagtttgaggcacgttctaccgatggattgtttcttggttaacccgcacatactcgtggctatcgtgtacttgttttggagaccaacaaagtttcttttgatgaggctagttcaggtactagacccgatattgcaggtacactctcacaggtttagggggaggatggtcatatttttgaagacgagagcgacgacaacgaccacgacgaggtcagctcggccggtcagactgggtgccaggccggtcggactgccggcacacctccggtcagaccgacccatgaggagcggtcagactggccagggtcgtcgggttcgggtactgttgatgctgttcgagatggtcctccagagattacaacttcgaccagtactgatacagaacgtggatcaacttcagaagtcgctgctcctttgcacatttagcgacgacatccgccggaacaaatcattggtaatataggtgagcggactacaaggtctaaggtaacggctcatgatgtttgtgcaaattctgcttttgttgcttcttttgaacccaaagatgtgtcacatgcattaactgatgaatcgtggattaatgccatgcatgaagaacttgaaaattttgagagaaacaaagtttggactttagttgaaccatgtcacaccctaaaaatcccaaatatataaattgttgtctaaattggaattattagaatttattttaaaagcctagaagagaagatctagttttaattaatacattccaatataaaatggggccagataaaatttcattaaatactttgcttaaaatttcattaaatactttgcttaattctataattgctagatttttctgggatttatttgagctaaggaagtatttctaataaatggaattgcatttcatgaataatttaaattggaaaaggttttaaattttctcttttggctttgggccgaaagtcggcccaaaaccttccctctctctctcctcttcggctcagtcagcccgcgcgcgcgctcggccgctgacaggtgggtcccacctgtcggactcgtcgtcctcctcgcgtcgaaaccctagccgcgccgcgccgccgccgtctccttccaaattcggccacccctttccttttccggtgaaatcaatagaggggaaatgatcttcggaatctcctctaccttttctcttttggaatcgtcggctaaaatcgtttggaaatccgtggattcgagtttgattcgaatcgatctctctcctccgaaccctagactttccttcgcgtcgccggtcgccgtgggccttcgccgccgcctcctaacccctataaattgacccccaagcccgccgctacccgccgccaccctcgccttcgcctctcgtcgccggtagagccctagcgccgtgtagcctagcgccgccatcgccgtcgttcgtccagccgtgcgccgccgccactccggtcgtcatcgtcgctcggggatgtcaccatcgtgatcgccaagccgtcaccaacctcatccgcccctccgtaggtcgccggagcaccgccgtcgtcgtcaggccgaaggtcgccgctgcttcttcctcgacgccatcgccgtccgttgatcttccgccgccgttttggtcaccggtgagttcgccgcgtcgccctctacgtgttggttccctccgttcgcgctgtcatgccatcgttcgccggcgagcatgcatgcccgagccgccgccggtggtggcgtcatcgccgacgtcatcgttgccatctgtcgtaggccgctcgtggaccgatagatctcggccgttcgtttttggatggatcggtctcggccgttcgtttccgtgagccgtcgccgtgcacccggtccatcgcgaaccctagctgctgacgcaataattcccttttccttttcaaaaataattcattattgcgtcataattcaattaaaatccatataagtgttttaatccgatttaatctttaaaaattcataactaattcatcttagctcggatatagttggttgaagtctctaaatttttctaaaattgagatctacatgttaaaaatatccacatgtactgttcatgcttgtttatgtgctgttttggtgattttgctcttttctctttagattccgacgttttcggagagtctgagtttgcaggagaagaatttgaagagtcccaaggctagcaaggcaagtcacacagatcccaaacaaccctttgagcatgttgatcccatttaaagctattgtttctattcaactattgcatttattttcgaatgtcattgggtggaattaacctattatttgttatggcacttttgttcttgattactttattccttgataccttgggatattgtaacttgactagttgagctttatatattggttcaactagatattagatatgattgcttagccatgcttagaaactttagcacactattgggataacttatgactcactattatttaatgatggcttaatgatagttcacgatggtcaatcgtgattggttaattaattaaattgccaactaaaacctgattaaaggtgggttgtgagcacatggttttgttggtcgttctcatgacaattaaggatcggttcacgagtttcggttgtgagacattaaccgtgccaaccacaagccagcgtgggcaacggctttaccttttgtataacatggttcattgcggggcaccagactaagaagtggcggaggtaagcccacgggggttgctggggagtccatgccttgtttataagggggtgattatgatccaggaacggtgcgctgtggtggattgtgttgtgtgaggggtactgtcacagctcctttccgaggtaccgtggtggtattgaggcacatggtgacatgttgtggggctgtgtcttgtgggtatagtggtacacctctggccagagtaaaactattcgaatagccgtgcccgcggttataggcgggtctaacaatgtctttcgtgattagtctcacacttctcatcataataaaagatgctataattggtaataatttgattagctcctggtttggaatggttaattcctggtttggagatagaactgtgcagccgggatggttgttcagaatggttgggcctatgcaatagggtatgttgtatagcgttggattaatattgtttaattattacttaactgttttaataaattctgaaatgtttattaaatgttgtttatgcaaatgaaaccctactatgccatcctttgttatcctgtgcacttgcatatttgctgcgtggcttgctgagtatgtcatatactcaccttgcaatcattcttcagaggaggagttctacagtgatgctgatggtgtggaggattaggtgtagccctggtcaagctgcctgtggagtagagtcgtctgcgccgtttatcttatttttccgctgcttagatctttattgattgagaggaactatctacctctgtaatgacattttattcgcttattaattagagtaataattgttctctattattgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcattaagaagaaatttgcagcggaaaataaaatctagcgaagctccggctccactcccacaggcagctcaactggggtataagccaaacgtcttctccttctggatcctttttcttcaactgaggttgattgattattgcaaggatgagcatataacatactcaacaagccacacagcaaatatacaagtgcacaagcataatataggttcatttgcaaaagcagcatttagcaaaacttttaagagaagtaaaaacagtggagtaattaatcagaaattttaatcaacactgaacagcacacccatgctgcacaggcccaaccagctaaacaaattattaccaggtataacatccataattattgtgagaggtgtgggactaatcatgaaaaacattgctcaacccgcccataaccgcgggcacggctattcgaatagttttactctggccagaggtgtaccactgtacccacaagacacagcctcaacatcatgtctaccatgcgtcgcgatagtggaaagtacccgaatagaggctgtgacaataccctctgcacaacacaactcaccacagtgcaccattcctggatcataatcacctcctcaataaccagaggcatggactccccagcgacccccgtgggcttatctccgccacttctcagtctggtgctccgcaatgaaccatgctgtacaaaaggtaaagccgttgcccacgctggcttgtggttggcacgattaatgtttcacaatagtagctcgcgaaccggtccttaattgtcatgagcacaactctcaaaaccatgtgctcacaacccaccattatcaatttttagttggcaagtaattaattaaccaatcacgattaaccatcgtggactatcattaaaccatccttaaataatagtgaataataagttatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttctgaacactcacgacgcactcacgaaccttcgcaacgacggaaacgacaagctaacacgcaaaacgaaaaaaaagaataataaaaaccaaataaacaatacataaaaagtaaacaaacatgtagatcataattttagatgaatttagcaacttgaaccactcaaaaccgagttacgatgatttagttatgaatttccgaagatttaatctattagaaaaacaggaaaaagaaaaacgatgatgacgtcatgatgacctcatcaatggccggaccatgatggcgacctcgccggagattggatggtcggctgcgactttggaggacatgtacacgtagaggacgacgagacgaacccaaaggtactcaccctcgaaccaaacgacgaacgacgacggccggcgacgaggtctagcggcggcgcggcttcggtcgacggcggcgacggggctccggtgaccggcgacagcggggagggagcggccgagcttgcccacacctcggcgcaccttacagcggtgacggcgaccgacggcaacggcggaggcgacggcgcgacacggccgaagttcggccggcggcggcggcgaacttggcggcggcggcggagaggctatggggcacgggagaccacgggagaggggcaaacgaaagaggaagactagggggtcctatttatatccttggattgaagagatcggactcctcccgcaagaaatcgatccgggaaatcaaaaactcggttttggagataaactcgaaaacgagttcgattcggatgagatactcaacgattagctccgattttttgggggtaaagatagaggaggataagaggaatatttcccctcaacaaaattggaaaaaaggagcaacggggaggcgagattggtgggaggaggcggcggcactgtgcacgggctggagagctcgggctctgtctggaggtagaagaaggagcactgtagcgacagggacgaaaaacagacttctatgcgggctgagaggaagggagagagaaggggaggcaaattagacttttcgtgttgggctggctgaaaacaaagcaaagaaagaaagagaagggggaagctcggctgggccgacttgggctgtacggccgagcacacaaaagagggagatgggctggaaagggcccaagactaggaagaggattattattacttttcgaattaaattaatcaatgaaatgatctttgaattgttaaaaatacttccaatgcccaaataatttcaagaaaaatcctgaaaatacttggactcaaagtacttaacaaaattataattagaccatttaatgattaatttaatatgtgggtaattactgaaatgctctttgtatgattaaaattaggaattgagcttcgaaaaatctgagaaaattccagagagtataattaaccatggagaatttaataaaaattaaatccatccatgctttatatttaggaaattttatttcccacatttaacttcacttgtaaattaaagatcatttaatataaattctaataataatttattaaataatttataaatcctgaaacgaaaatcaggatgtgacaattatcaatttgttattgtgtgcctcggctgattcctggacgagggttcacacatatgtaagcgtttggaattttggatagaaattccgggcgtgacaaaccaccttctggacataatattattggaaccaagtgggttttcaaaaataaacaaaatgatgatggtttgattgtgagaaataaagctagacttgttgctcaaggtttggattttgatgaaacttttgctcctgttgctagaattgaggcaattacacttttgttggcttttgctacttcaaaaggttttaaattgtatcaattggatgtgaaaagtgcttttctaaatggttttatacaggaagaagtttatatcaaataaccaccaggtttggaaaatccagattttcccaaccatgtttttaaattgtctaaagctttgtatggcttgaaacaagctcctagagcatggtatgataggcttaacaactttttgcttgcgaaaggttttacaatgggaaaggttgaaaaaacgctttttgttcttaagcatggtgataatcaactttttgttcagatttatgtggatgatatcatctttggttgttcgactcacgctttggttgtagattttgctgagattatgcgcagggaatttgagatgagcatgatgggtgagttatcgtactttttgggattgcaaattaagcaaacacctcaaggtacttttgtgcatcaaacgaagtatatgaaggatcttttgagacggttcaagatggagaactgcaagccaatttcaacaccaattggttctacagctgtgttggatcctgatgaagatggtgaagctgttgatcaaaaggaatatagaaatatgattggatctttgttgtatctaactgcttctaggtcagacatataatttgctgtgtgtttgtgtgcacgctttcaagcttctcctcgtgtttcacatcgtcaagcggtcaagcgaataatgaggtatttgaatcatacacatgagtttggaatttggtattctacttcatcttctatatgcttaagtggatattctgatactgattttggaggttgtagaattgataggaaaagtactagtggaacatgtcattttcttgttacatcattgattgcatggtcttctaggaaacaatctagtgttgctcagtcaactgctgaatctgaatatgttgctgctgctagttgttgttcacagattcttggcttttatctactttgaaagattatggtcttacttttgagaaagtacctctcttttgtgataatactagtgctatcaatattgctaagaatcctgttcaacactcacgcataaagcacattgatattcgttttcactttttgagggatcatgttgagaagggagatgttgaattgcagtttttggacacaaagttacaaattgctgatattttcactaaacctttggattctaatcgctttgcttttcttcgtggtgaattaggtataattcatccttttggtatggtttgagggggattttgtacctcatggttttatcgagcaataatatgacaatgagaaaaattgagaaaagagagctttgtttatacatatggtattttcttgtacatgctagcaatactttgaaggtttatttgtctctagcatagcatgtatgtatttttgtcttttcatgagatttagattttgtttttaagggagatgatgcatgacacttaaattctatacttgaattaagcaaatatgcaatgttgatgctagcatatggtttgatgtataaatgctatatatatatgctttattgactttttattcctcaaatagttttaattgctcattgtgaaaagataataaaaaatatgaaaaaaatgaataccgaatctttagaaacagtcttgacgattcgatgtgagcaaaataatgggtgccgaattcctggaaaaagtcttgacgacagggacgtacccggaataaaagagaaaaatatgagcaaaaaggctcaagaaaaataaaaagttaaaaaaattctcttggttgttttgtgctaaaggttacttgagaaagagtgataaatgtaataggtatatgtgtttagtgtttatttttcaacctatatgcttgttaagatgttgcattaaaaatcatatgaaatcatgaattttgactgttgattcaagcataattgtaaaatctttggttcatggttatactttaatgcatgattgttatattatagatgggtttatattctttttattgcaacacatgacttgatatgctatatgtatgctaaactcttgaacattaatgaacataattcctatgcttgatgaaatcattgtccaaagggggagaagt

SEQ ID NO: 44403 - DNA, 6770 bp, Oryza sativa
ggattcacaggtgatcgcaggattcattatttcatgtgaccggtcagaccgggctctggtagccggtcggaccggcggtatgcgcgcggtcagaccggccagcccgcggtctgaccggccgacactgtgtcgatttcggtttcgggttgtttgtttggatatccgtgattatttcatgattatgacttctagatggatactagatgtatataatactgttgtttgctactaatgagtcaagttggagatagcttggtttcggaatatggtttctttgtttgttccatgtgtaggtgactcgatgcctcgggagagtatttgcggtgatggaccgggagtcggcttggggataagacgacgtccgtggtggtcagagatcatgcgggatacttaggctagagttgatgcacgtggttgatggagattccatatggcatacgatggagttattgtgtgcgtatgggatgcggagtcaaatttggaaggagtccaaattttgtacgattggttatgtaaagtttctttcttgtactagagggtttcctaaggtgtttaggactcttagtatgagtttggttcgtggctttaggctgcctacctcatgtataaatagagggggagcgtgaggtttccctgtatcgctttggagagcaattgagttgagttttgagttagggtttcgagtttagttgaaatttttgtaaggagtgctgttggtgcactttgtaaacacagagagaatcaataaagtcatcatttactttaagagttcttcgatttgtgtttaccgggtttcggcggtcagaccggcgggagcacggcggtcagaccggcggcggcgacagcgagcagcagctgatctcggcggtcggaccgaagatataatcgcggtcagaccgatggcaaccaggcggtcagaccggcaggacaacttcggtcagaccgcgatccgtcgatttcgagggtaacttttatttccgctaaaagttttcggtttttgggtataccaaccattcacccccctttggttggcttagttcttgtgattcgattctacagaaatttgtggcattgaaggatttaccgaaggtgcgatgcccatttcggcctgtttatcgtgaaatggtgataaacggccgcagctataaggtttttaaggttgccgaatggcttcgggtgcaccccgggcgaaccttagaagactacgatctttgttcattcaagacgtttggaggatatggctcacttttggcgaaaccatcaaaagactgatcggcaggaggcgatctcccagcatcgttacagtctagtctgtgtttcaccctcttctcctcttagggttgtgtatgatattagtagtgatgacgaacctagttcgcctgattattcctaagagagagagaatgtgatcgcgggggcgaagatgtaatttatctgtaagctgggctgtaacgccattgctattttcttgtcacttgtatcattgtaatgggtttgtatttttcgatacatttttatttaaaatcaataaaggtgcgttttatttccttttcgctatttttgcattgtcacttcgcgtgcttttcgttgggtcggaacgtgtcggctcctttgcatatattagcgaaataggttttgacttttcagctttcggcttccgttttcgatccgttttgttctacgttgtaggaagcactcgtgctttccttttgatcgagtgtaacggtgttcggctagttgttctccgaaacaagctgttgcggtttcaatcgtttggcgagcgatgcttcgcctgattcgtttcgcccccctggcctttttcgctgatcaggcgtttgccttggggtttttccacaaattatcaatcgcacaaacaaataaaaagaaggcagaggacatagagattttatactggttcgggccttcgtggtggataatagccctacatctagttttttgtctttttttcattttcatcttttttttctcttttttttcttaccgaagggcttacataacgatatatacatttttacaagttggcgatatgggtgccatccgttctagacataaaaacgcttgagagaggcagcgttctaggaatggtcgaactcttcgccttccagtgtcgccagtcgaaaggaccccgtcctggacttgtgcttgatgaggtacggtccttcccacttcgattcaagcttgccaacggctatcgggttcgccttcttccttaagacaagatgaccaggcaacagctccgtcggtcgaacttttttgttgtaagttgccgaagtgcctatggcatacttgcgcatgtgctcgagtgcttcgactcttaccccctccaagagttcaagcgacacctcgcgcccctcttcgcccccagagaacgtcacccttggtgagttagtccttagctctgttggggtcattgcctcatcaccataaagaagcgtgaacgggctgaacttggttggtcttgtgggggtcgtccgaagggcccaaagaacagatagaattttctctggccatttgcccttcgctgccccctcaagccttttctttagtgcttttaggatcttaccatttgtatgtatggccgccccatttgactgcgggtgcatgaccgacgcgaacctgatttccaggttaagcccttcgcacatttctctgaacttgtcagagttgaactgcttgccgttgtcagtgataaactcttttggtactccaaaacggcaaacaatgtttttccatacaaacttctgtactgcggccgaagtgatatgagctagcaggctttgcatgtattgctttatctcgtcgaacgctgcttggcattcgggtgtccagttgaattttcccgtgccctggagggttttgaagaagagcaaacctctttcggctgcctttgagaggaatcgactgagtgccgcaattcggcctacgagcttttgtacttaacgtacgctcgacggaggcttcatttgctgaatggcatcgattttctcgggattcgcctcgatgcctctttcagaaacaaggaaacccaacaacttgcctgcgcgaacgccgaaaacacacttcccaggattcagtttcatacccgctgcacgcaagttgttgaaggtctcctgtaggtcggacgcgtggttgaaagccttccggctttttacggcgatgtcgtcgacataagcttccacgtttcgccccaatttcttgtaaaggaccttgtacaccagcctggcgaaggttgctctggcattcctcaggccgaaaggcatcctgaggtgacaaaaggtgccaaatggtgtgatgaaggctgtcttggggatgttggccgtgttcatgtggatctagtgatagccggaatatgcatctaggaagctcatgagttcgcagccaactatcaaatccacgagctagtcgatccgtggcaaggggaaatcgtccttcggacatgctttgtttaaatatgtgaaatcgacacacatgcgccatttgccgtttgacttccgcaccagcactggattctccagccactcaggatggtcaactcaggatggtcaatctcttgaatgaccccagccttgagcaatttttggacttcggcttttgctgcctcttggcgatcagcggacatcttgcgtagcttctgtttccttggcttggcatccggcttgactgctaggtgatgcatgatgagatctgtcgaaacacctcctacttcatcggggcctcaggcgaagatatcaatgttcttcttgagtacctctaggatgttctcagcttcttcttcgcccatgtcgccccccagcgatacgagctttgtggggtcggcatcatcaatctgtatcttgattatcttgtcgtgtggggcgggctttggcgcgtgcttcgcacggtcatgcggttcggcctcaacattgtgcactacttatggccagatcgccttttgaagcagccaaaggctgaagccccttgaccacgatcactcctgtcgggccgggcatcttgagcttgagataattgtggtgggaaatggcttcgaacttgttcaaggttgcacggccgaagatggcgttgtagttgtacgggatgtcgacaacgtcgaacaatacttgctcttcgcgtctgttttccgccatgctgaaggctaccatcaactgtgcttggccaagaacttgaactgcttctccgctatcagggcgggcatcttgagcttgagataattgtggtgggaaatggcttcgaacttgttcaaggttgcacggccgaagatggcgttgtagttgtacgggatgtcgacaacgtcgaacaatacttgctcttcgcgtctgttttccgccgtgcggaaggctaccatcaactgtgcttggccaagaacttgaactgcttctccgctgaaacgtcggagcgatgctggtgctggggtaagggcttgggtggctaaccccatcttggcatatgcttcggcgaagatgacatcggccgaagtccctccgtccaccaggattcgccggacctcgaaaccagctatctcggctgagatcaccagaggatcttgatgcgggaacattactccttcggcatctcctggcctaaaagaaatttgctggttcagatactgcggggccccttcgccagccaaagtgatattgtggaccgttcgtagctgcatcttcttttgtcgcttcgacagctggatcggcgggtcggcccttgtaatcacttggattactctgcgctgcgcgtcttggcactgttcggggggtgcttgttcttgagctgcttcacgaggtgcttcgacagctgctccctgctgcggccttggatcttgcccgctgacacgttgccgaatgtttcggcattgctctgtggtgtgtgaagagcgtctgagaaaggcgcagtagaggtcttttcggaccttcttgcggacaggctgctgatggttgcttgcttgctgggcgtcgaactccttgcggagggcttgcacttctttgacagccatcactgccttgcccgcacggtcggttctgaacttcctctagatcatgggggggggcttgaccttgccttggcggttgtccttggatggctggggctggcgaacagcgagaggaggtggttcggcaacttgaacttgtgcttgggcttgggctgcggcgacggaagccttatgatactcatcttgtattgcttgccatcgcttggaatcctcttcgccccttgcgtacccgtcaatgatgcaaagtaggtgctcaagcgtctgtggctccttattggcgatttttcttatgagttcaccctcgagtagaccggtcgaagcggcgtttatgacagatgcctcggttatgtcttgaacttggcaccgggcttgcgagaagcgacgcatgtactcccttatcgactcccccggcctctggcgaatgccgagcagatgttgctgcgtcttcggctcctcataggtgcctcgaaagttaaggacaaagatatcgcgtaattgctcccatgagtaaatgttattggctggtaaattgaaataccaagaacgggcaatgccgtctagagcgagatgtattacctttgccttggtattttcgtcgccatgagccgcttcgatcgcggactcataaatggagaggaattcctttgggtctgtttcacctgagtagcgtgggacgggtgggaacttgaactagggtgggattggacgggtcttgattcccccactcagcgatagccccttttcgctccctgccctgttcacggcaccttgctgcgggtatggcgtggcgaagggcgaaatcatggcttgcgcgtgaggttgggccatggcattcggctgcccggctccgattggtgatgcttgctgagctaccatggatgggtcaaaagttggctgtgaccgtgtcatggcgacctggtttggtgcctggtttgctccgaagcctgacgttggtgcttgcggccgaatggttggtgcctaagaagcattgatgaagttgaactacggtccttgactccacggcgaagctcccagacttggctgattcgacggcaaccaactcggtgcatcatgacttgtattcccctccgggtgtgctgaaggggctatacctgaaatgctatggggttggctgagctgctgaaggaaagcttggagctgcgcccgcagagccgaagccccttctgccattgtttgtggtgcttggccaggtggttgaggttgtacttgtgtaacaccctgcctccaaaatccgcattagtccactctacacgttgagcggacccactttcgcatggtatcgtgcttacactttcgtcctcgcttcgtgtaaaagggttaacctggggataccatggttggagcaccaaggcttataagtaggccttcacccacctaaacttccaaggtggtactaaaccaccactacacatccacttctgggccacatgggccaaactcacactactaacaggcttcaaacgggttggggtgttacattcacccccccttaagggctgacgccccggcagctcaccgtttacacggcagaggcctagaaccccctccggtgcagaccatggccttttaccccccttaagggctgacgccccggcagctcaccgtttacatggcagaggcctagaaccccctccggtgcagaccatggcccaaagcacatgcatcacacaacggaggtttatgctctgataccaactgtaacaccctgcctccaaaatccgcattagtccactctacacgttga

SEQ ID NO: 44404 - DNA, 5215 bp, Oryza sativa
accccccttaagggctgacgccccggcagggcaccgtttacatggcagaggcctagaaccccctccggtgcagaccatggcccaaagcacatgcatcacacaacggaggtttatgctctgataccaactgtaacaccctgcctccaaaatccgcattagtccactctacacgttgagcggacccacgttcgcatggtatcccgcttacactttcgtcctcgcttcgtgtaaaagggttaacccggggataccatggttggagcaccaaggcttataagcaggctctcacccacctaaacttccaaggtggtactaaaccaccactacacatccacttctgggccacatgggccaaactcacactactaacaggcttcaaacgggctggggtgttacaacttgggcagcgaccggctgagcttgcagctgcacgtgaggggccggatgcgctgctgcggtcgatggctgcccgacgaagtacattggcgcttgcgcgacttgtggcggaaggggctgggtcggcacttgtggatagacttggggtgggacataacctgccgaatactggaggattggtgctgaagcgaccttggatcgtcttgccgtctcgtatgcttgctgttgttcttgcatttggcgaagcatgtcttggagtcgtgtcatgttctgtcgcatggcttccatgttggcttcggtttgtgtttcggggttagggttgacttgggcttgcacagcggtgagcgcagttggggccgctgccgactacgacggagcggcttggggcaccagcagttggcttgtcaaaaggatctccgccctggtctggagtgcccttgccgccgcagccgccttcgccataccagccatgttcggcacctgcacagaggtggcaggggccgaaggcggtagtgatggtgcaggtgcggaagctgatggcgctcctccatcttcggcaacgggcgccgaagtctctgctccctcttcggtggccatatccgccctgacgtcactttcctttcgccttgtaaccttctccttcacgaccttcttcggtggcattcgctctcaatggtttcgcttggaggtccccacgatcgacgccagctgctgtcgaaacgacaaccgcatacgtcgaaagacgtggtcactcaacagtggttgggaaagaagttgtcacgtcctgataaatttatcccgaaataaaaatcattctctaaaaggaataatagaattaattaaaaatcgaaaagaaattgacaaacactaaaatacgtacaagaaaaattcgaatatggtccagagaatttttgttaaattctccttggtctaaaaggagccctcaaattttacttgaattttcagagcaccggaaataattattaagcaacaaaaacaattaacaaagtttactaaaaagaaaaactaaaaataatccccctcctccctttgggccaagtctggcccaaagtcctccctctctctctctcggcctgcggccaaagtcctcacttcctccctctctttctctccctctcctcctctccctccttctcttgggcctcctctccttcccctcggcccagccccctcctcctccctctctcccccaggtcgcctctccctcctctcctcctgggccggccgcccggcccaaaccgcgccacccagccgcccctcccgcgcacgcgcgttgcacgcgcgctaactgcgcgcccgaccggtgggtcccacccacccggtcgtctccttcctcccgcccggcatcctttctctcttctctctcccgtgaaacctagcgtcgattcctcccctaaatccacgcgaatcaatgcccttccttccaaattgattggggggaattaatccccgttccttccacatcaattccccctaatttcccccttgattcgtgcccccaatcgtcgggaacgcccacgccaaccccggccaccttccaaggccgccggccggcttttccgccgttgttccctcctctcccgtccccggctccctctcctaccctataaaatggaacaccctcgctccgttctatcgttttagccccctcctgcgctctcccgtggcctcaccacctctccccgcagccctcctctctctcccacaccgccggccaactccagccgccactgccgcgccgctcaggtgcgggctggccgtgccgtcgccgccagcggcctcgcagccgcctcctcttccccggcgtcgcctccgtttcgcgggaaattatcggagcgacgtcctcgcagacgaccagtggtgtcgccaccactccaccgcctccagccgcctgtgccgcctcgccggtgcagcggctgtcgtcatcgccatcctccctcaacgtcgccgcgtcgccctccacccaggactgccctcggtttcgccggaacgccgtcgcccgtggcgcctctccctcggtctcgccggagttccttcggcaacccctttcgctgtgccagcgacgcatcacctccggcatcgcagcggcgagccagcgacgtcatcctcagcatcgccttccctccatctgaacccctccactgtccatcgtcgtcgtctccgttcgtcctcgtcgacgactcctccggtcggtcgttcgtcctcaccggctcatcgtctcgcggcgccgcctccgtcttcggattcacagcggcgtgttccatgccgtcctcgtcgccgtgcagccactgccggctgcccacgtcgcctcctcgccggccccggtcctcgtcatcgtcgtcctcccgtcgttcccggtcgtcgtggcgttcgtccctccgtcaagccgttctcgttcgtcgtcctcgctacgtcaagtgccgcagccccgtcatcgtcttcgtcctcgcctctgcgtcgccaagcgttgcgccggccgcgtctcgccttcgtccaaggatcgccgccgaagtcgtcccctcgcctttcgtctccatcgttcccggccgtctccgccgcgcccgttcatcgttgttgttccctcgcctcgtcacgtggtggtaaggatctctctccctcatcgccctcgtcctcatcctttcggtgtcgcccgtgcccgttgtgcggttgtcggccccggtacccatgtattggtgtcggtagtcgttcgcttgtgcgtgtggtgaccgtgttagtgtgcccgctcggtagccgcgtggtttccacgtgtgcagcccgcgtagtgtctagtggagtccgtttgtcggccactcgcctcggttgacacacagggtccgcttccgtcgacccgtggaccgtctctgtgtacccggtcagccgtggtcccttaggttgacaagtggggtccgcatgtcaacggcgcagccttcctgtcttttccaggctagcgcttatacatgttttatagttgtaaaacctaattataataatccgcaaatctccatataacagcattaaacttcggatgaccatgcattggtcatacgagctccgaatcgatccgttcaagtctcctaatgtttgttataacctaaagaaccctgtgctttatttttatgtattgttattgcttctttataggcttgtagctttgcttgtgtgcttcgcgtagcttctgtcgttcctgagtttcccgaagcgtggttcgcggtcgtcgccgaaggttcggaaggccattatctttgagcaaggcaagtcacatcatccttgagcatattgaatcccagtttataaaattattttgatttaaattattgcattatcgctttattcaaattcccgcattatcactattttatttagccatgcctatttatctttgttatgaccttatcattgttgttattgttattattgccttgttcaccctaggataaacaaaactccaactagtgggtaccctattcatggttccactagtatgaatttaggtagatgcttcgctgactaattaggcaacattaggtggttttataactttagactttgggaattctcatatcatttggacactatggtatggttggcttatgttggaattggacacacacctccccctctattcaaaacccccaaaatggttttaggctgggctcgaggtgcgtggttgggttttgttagtcgtacctcgggtactataaggattaagctcgggcctctgttggaaagcactaccgtacttccacatgtctagtgggtaaggcttagtttgtggctcagtctggttataaacaaaggtacacggatggagatggacgaagtcgggggtcgatggacatctttaggacaaataaaggctacacgagctgcggcccggtagtcgagatgtcatggcacagggctggtgtcctgctgctaggagctcaatcctgcctgcctgtcccggaggttccggctgtagatggggctgggtcggtacttttgtttatggctaggatgggttgggaactatgtgacgtcttccgtccgtatgccgtggtggtatgtggcacgtggttacacgtgaggatgatgtgtcttgtgggtaaagatgtacacctctgatcagagtataatctattcgaatagccgcgccctcggttatgggcaagcctagcaatgtacccaagttagtgttttaattcttaaaacctgcttaactactaaaatgtggaatggttggcctgggttggcttgggatgagctgggacccagggtcgggttgccagttcggtctgaatcatcgtaggccttgaattaaggcaggttcgtgagggtttacggccttgattaataacactttgtagctctaggatcatctttataaaatggctttgggcaactaagtgacttttaaatgctgtttactgcaaaacttaacccctatattattaccccttgcacccccttgcattaatcatgcatctgccggtgtggcttgctgagtactgtggttgtactcattcttgctcaatctttcccccccttcagtaagagaagctttggagaagaagtcttaggtggagtcctggcttataccccagttgagtgcctgtgaagatagagccgtaggcccgctagtccgctgctgtttatttttgattgtcaggccttaagtgcctttgtaataatttaaatattatcgatataataaagatgtgccttttgtatcatgtttgtgtggtgtaccccagcttttcctgggacggggattaatgcactagcgttcgggaaaaggcaattttctcggtcgcgacaa

SEQ ID NO: 44405 - DNA, 17271 bp, Oryza sativa
aatgtaaatattatcgatataataaagatgtgtcttttgtatcatgtttgtgtggtgtaccccgacttttcctgggacggggattaatacactagcgttcgggaaaatgcatttttctcagtcgcgacagaagtaaagtgtattaattagagaatttttcttcgggatccccccattacatggccctatgagactatttatagctcctattacaggttcttactactagagttttggttatacaggggaatttacatggttacccttatgaaagggacatttacatgggtacatagggtaattgaggttcacaggcccctgatgggccgtcgggcgatcgtcagctcaatagcccctagacttgatgggcctgaaaggcttcttcggccctcgcgggggcgagcttgctttggcgaagtcgtctcccttcggcatatactcttcgccctgcatccttcgcccaagaggcctctggcttggcagagtacccgtgcgatccctcgcctctcgccgtccttgttccatagtcttcgtcatggggggacttcgccccgactaactttgacgtctcgggcttgaatccccactcttcgtatagctttcagcagattttggtcgaagggcctcatgccataccaccaacaatgatatccatcaaaactatccaaaatgcgagaggcagattaccatagtaactctcggtaagcacttggctgagtgagttgcaagtactgttcatgtacttaatgatacctaaggaattaatttatatacggagaaattaaacatagtgcagcctgttggtctgtggcgttgtgctcattttttcagaccaccaccctttcctcgatcttacttgggctagcgctcttcgctggtccagcgaaaaggagatagcagtcgagagtcgagatcgaaggcctaattatttttagagagcaatggaacgaacattgatgggtatagatcagtcatttaattaggtgttgttagctgcagtttagtctcatgagtttaattatgcttgtactccatccgtttcataatgtagcattgtccacatttatgaaagtaatttttataagactaatgatgacaaaactatagaaatcttttatcaaacaatgatttatcataaaactatatatttatagcaccgaagttattatagaactacatatttgtggtgcagtactacagatttaataataaagttaccacaaaatcacatgttgagcatcaatttaatcagaaaacttggatgctaattattcaaacataacattattgctagggatttaaaccctaaattttgtagttttggaataattttattattattattaaatatgtagtcttaagatatttagcctttttactctttttaaaatttggttgccctcatgggtcggtcagtgaaacactgcaggatttaaacgacagctagagctataatttaccttatcagatcaagtaggtcctgtctgattcatggttcgatgcttgaactatcttaagttcttgacacacatgaacgttacaaaagattagtatttggtgtgtagaagggtcaacgccaagccggttaattagtgcaacaaactatgtgtttgcttgcggcacgattgcagagagcacaccatcgtcatggcatgaacacaaacagacccgtaggcttaatcatgtgtgttaggtgaaattaacttgatagatttgcagttcattatctgcaattgacacgataaattacatccttaaacctgctggcaattgtacttagataatggtagcgtatcctcacagatttagcacagctagcaaggcgggaaggaaacaagaaagcattgggatgccatcatctgtaaagtacacagcacagtactgaatcaatggcaatccatccgttgcctcccatgtatgcctattgtctactgtactaaccaagaagacatggaggacaagtccagcgcatgtacgcatggtgcccaagaggacagatggaggatcagatcatggggcaggcacatgcatccacatccctcaaaatcatgcccttgtctccagattcccgggcttggctgttaatgcgtgagttgtctgaagaagctcgcatccctccaaggcaggcggcatatatacagttcaggatcatccatttcttaatgctacttcatcattctgatctccaaaagggcctttctcatcaggacaccgctggtgatccccatccgtgtctcagatttatcatgctagctgattggagtccattgtcgcacgtggcgacgatcgggtttcttggaaagctgggggaacattgttggtgctgggtcactaataatttagtttgataagaaaagagatggagagaaaaattaagccggaaagggaaggtaggacatgcaaacatctaagtagaattattctgtagttcacatgcaataagtgcgcgtcatttttcaaatatcgaattaggtggattggaattagcatcactaattaatgtgaaacaccgtttatagtttaggttgataacaccaattaattactaacatacatctcccgtcagaaaaaaaaaacaaagaaagaaagagggggggggggtcatgttattcagttagagaagtgtgatacctgaaactgaatgtcatgttcagtttcagactttaagaggaggaacagatcatcaaattaacttgaagcttaagctctccaggacgactgcatttactcatggaagtcgacaagatccccagatccacaatggttataaacaatcttgggtggcaattattaatcagtcatgtcattcaactagattgagaaataaaagaaagaaaaaagggggtccgtactgttgtagtatattcctgagtgggggaggggaggtctgtgatgtcaacaagttaggagcgaggagcatgattccagggcaggcaggcatgcacacatgtgaagtgccttggttactttagctgttcctgtctcttggttcgggtgattctttcttcctttctggtgtagtgccttcctttaaatctatttctggatagatacaacacaagatggatgcacacatatttatagcaagtgggggttgctatgtctccctgcttttctagtctgcttgacattttgtggtgggggcatcatccctttcactctcaaatgcttcagatttcagtcaatccacactgtaatccccattgctagtatctctctctcgctctctctccgcctttaaaataggctcttgtggattgttgagaaagttaagtgcccctgttgcaaggttctttgaggcttcgatcccgataagcgttcgaactggtcggcctccacctattgtgagtaaaagccactcaattcctttctcatagtttccattttccttgcatccatctataaagatagctagggtgcaaaattttatatggttggtttgttactgccatggcagaaaaaaattgagcgtatgcatccatcgagagagagagagagagagagagcaatctgttgatctcgcactgtattttgcagctgtgatttggcttcaaagccagccaaaaaaggtctaattctccggccacaagaagatgtcaaggtacctgaagcagtacgagaaggaacacatgaagatggccatgttgaggcaggaggagacattcaagcagcaggtaagataagaacaccactccatactgaaacttccaaactcttgcttccttatccagtaccgaaccttcaggcctcaagcaaataacagcagctttgttcaggttcaggagctgcaccggctgtaccgagtacagaagctactgatggacgccggctctgcaatcacaatgcaaggcatcagttgcatacctgaagacgattatcatgcagaggagaacgaggcagggtcgagcaggccatggcacaccttccctgggagcgacaatgacaagccacaggctcacactagtgttcttgaagagagcgagctggacctgacgctagcgatcgggaggacgacgacgaccaagaaggaggcgccgtcgtctagcgtggactcgaggacgagcaactcgtcgtcgtcgacggagtccggcagcaccaactgcagggcggtgatgccgcaccggccatctcggttggggtcgtcgtcggcggtgaaggtgttgctggtggccccggtgttgggacgacgcagcagcatttggacctggagcagcaggacgcgctgaagcagcctccttggctccaccgttgtctcaatttggcacgataagaggatgtatagcacacaacttcttaatttcttgccgtgtcatccctttactattctcaatcatgcttgctgctcgccctcgcatttctcgatcgtttgtcctcactttacttcacttttttttttacttcttattttttttacttccccaccaccgtcatgattaagaagtcgcgctcagcaggggaaagaaaaaagagtcgtgcacccggagccgacccgcttgatgattccaagccttatcgttttccttatataaaatcagccgctataaaaatttaagtttcagacttacttttgctgttgataactagccggcggctacaagtcgtcggatagttattagcgagtactagttggttggcaagattagttagcttgctgcttgctccaccattataatttgtgagatataaattataaatttataattgaattagggctactacctatctcgggggtctgaatcaacacaaaaattcgttgtctttagattactttaccgcaatctcacgtatagcttagtcccaacgtccaccatactatatagataccgtagtcaggtataaactgttgatagtagcgtgccaagtagggggcttgatgaaaaaagtttcgacgagatgggtacaagagacggattttctaacaatggcctctataatcagcttggccagggcggtccaacccagctgatgttcactcttctgcatgttggatccgtcacattcccagtcttcgctgttacgtcgttgttagtatttcttacgatcacagacaaaatccgcaagcgcacggatataccgatgtagcacttctcctacggagtattccaagggtatcgaatccaagagaacatgtgtggtcagatcttcctccggttcatccaaggacaccaagcaaatgataagccaggatagagaggatttaatagtgagaaacattgttagggaaagcttaattttaatcctaatgcaatatttcaggcactggcaacccgcagttcccagatgtcgctctactacgtacccggacagggaggacttaagtgatctcgagggctgtcaccacctctacacccacctcaaacatactgtgggatacgcagcaattactggataataattacctaaacaccacgtctaagcaattactatctactttagtgtttataactcactaaagcaatcattatattttagttgattatagtgaacaataatcccgtatgctacttcggaactaaccaagagataattctcacaagataaatctaaattactcaagaagaatattatattgaattcacagtaataaacagaataaaagaaataggggaagattactgacaactccggaattcttccgactcctactctactcccttccttcctattctagtatacaatatagtacaatagagcctcttataattcagctcaagcttggaagtatgtgtgagagtgaataaagtgaggtctatttataggacaggtatgacggttgtgagaaggggaaatgtccgaactgccccgcaaccgtctttgggagagcatctggagcgtcgatgccaaaccctaggatcaacggcgatcagaggggttcgcccgaacctaggctgggccctcctggcctggccttcggtctatggactccctgggctcttctctatccatttctcagagttttgggttaattcactgatgttttgatgaagttcacaacccctccttgtatagatatataattctcctcactttagtctaggtttcctcccaacatcagggtatatcatctacatacaaatatacaccaacacttgtggaatatgtgagattaagcacctatcactatgttggatgttttattatccgaactttatgcagatgttggcggtatagaatcgacatttaacagccgccaacagtcgttgatctaccatccgacttccaccgagaacaaggagccgactgcgaagtctattgggtttactcccacatcggtaattgaggatgggggagcactttttaaaaggtggagggagtcctcacccatcagactagttttttgggttgtgtaggcctgagacctaaagttgtggctctggttgagcctgtggtggagcaggcccaatatgaccgggtggcccatggttggtggactgggctgcgcactctaacaagtaatatcagagtccaggtttagaacctggaacaatttccatgggtcacatgatgggggaggccaggtaacaagtcttcagggtcacatgggttaatgtgacataggagattgttgggcccgatgtgtgacgacggtggagattgttgagtttagtctcacatcggtaattgatgatgggagagcacgacttaaaaggtgggggcaatcctcacccatcaaactagtcttttgggttgtgtaggctcaagacctagagttgtggcttcggttgagcctgtggtggagcaaactcaatgtgacctgagtggcccatggttggtgggctaggttgcgcactctaacaaagtccaatcacaagattaggaagaagtggtgccccattaacaaaacgagttctcactctctagatgggtgcagtgttatgctgaaggacaaaactggatgcaacggttgcaaacttgatgatactcaacgcatctcctcatacaaattatgccccatcgacaagacctgagtggcccatggttggtgggctaggttgcgcactctaacaaagtccactcacaagattaggaagaagtggtgccccattaacaaaacgagttctcactctctatatgggtgcagtgttatgctgaaggacaaaactggatgcaacggttgcaaacttgatgatactcaacgcatctcgtcatacaaattatgccccatccacaagacaaaatgcgtactttgacagggtttaaggtattcatcaaagttgtcgaatccatgacctcgtctacgtcggccagttcttctcccaagcattgtctgatccactcccgatgacatcaatccatcaatttgggatcatacgatgatatgtcagatgacttagcttgtttggtcggctatctgggactagacccccatgaaccatctattctccatagtctggatccgctcgagtcctaggtctcaattcataccgtagggtgaacatcgttgagatcgtggacctagcgtcccgtgacgacattgttgacggtcgttatcgattagtttcgaccgtcaatattactaaaatagaggagaactagtggtgcttgcaatgcatatatttgttagaataataatattccattagtattaggtatactaaccttttgcagagaatgacaataaagtggaggagaatcgacatcaactcagacgataaatcaatcggacgatgtcgagaaccagacttatgtatgaatgggccaagaactcaaaaataacacgacacattgggccaaaattcacaagtctacggaggaggacaacaaaggaggccgccagccaaagatgggctgggttgggccagcccatggtgtttcgaccgaaccccccatagctccgtttgatccagggttctcctggacggctgagatggctccccaatgacggttagagggtattaccgacaattccaaccgtcacaaccgtcattgggaggctataaaaggagctctcatcctcacttcactcacacacctcaagcaatagctctctcatttctctcaagtttagtttagtagtatctagctggtggaataggaatagagtagaaatcaggagtccggaatccttaggaagagttcgggtatggctctagtagcttttctcttctcttttgtaagccttgtacttttactagaatactcttctaaatatatttatggtattgaaatactttccgagtatatgagtacctactttacattatgttcatgttatgctgaatatacggctagcttatctgggagatgctttggtgcgggtatagtgtttccttatgcaattactctatgtcatgacgatgatattagagtagtacgtggtagtttagacgtggtgtctagattacgggatatcattatttagggttatatattgcggatgagaggtgggccgctgatggtgacagctcagtacgggtattcctccgtgccggtatataatcctaagttaattccctgggagggtattcctccgtatttagccccggttgtatggtcatgacgggctgtcgtaaggaactcagcagtcaggggtggcttctcgaagtaccaggagggtatcggatagagggtattagctagtatatcggttaactagaatgtatgtatactatgtatattaaaagtataggaattgatttttgaagtataggaatagattttctctcttttctttccacttagcttagatgatatattatgagaatgagtagttaatgcttgtgtgtcactctacccttggattatcttaacccctacttagaatatgattatcacaagtaatatataaattattagtcaagttttctctacatgatcttcccacgggataaaataaatacgatacccttggaatactctcaggtgaaatgctacaatggtatatccgtccgcttgcggatgaactctgtaaccataatataccagaagtatttctgcgccattgttgggaattatatttctagtaatatcgttaagaaataccaacaagcatttctggtgccgttgccggggaagatttataatagtgattacttgaactaatactttatttttacctttgtataatcattttcctttgcaggataaaccttggttgtttttactttttgttctgaaaacaggttagtgcatgactggtttcaatttgccggaaaacttcaaagaaaatccagaaactttctttcggagcgttaggccgcgagtcgttgctccgcagaaaactctaccaatagagaaaccagccataccggcgccaccaaccttcaagactatggctaacaagactctccgcgagttcgctgctttctctgctgacaatttggccatttggcagctggtcaacataggggacgtggatttcgacttgaagtccagcctcatcacgatggcgccggctagctcattttgtggcaagcctaatgaggatgccaatgctcatttgcaatagttcctggagatctgtagcatgtacaccatcagggtgtcagtcctgacgccgtcaggctaccactgttttcgttctcccttctcgggagagcgaagcaatggttctatgccaaccgtgctgctgtcaacacctgggataaatgctctataacattcctctcgaaattcttcctgatgggcaaaaccaatgcccttcgtggaaggatttcatgtttccagtaggcaagcgatgagtctattcctgaagcatgggaacgtctgtaggaattcgtggccgcttgtccttatcatgggatggacgactggctgatcccggttgacttcgtggtgctggacatggacacggggaaggagacaccgctcatcctgggacgcccattccttagcaccgcgggagccaacattgacgtgggaacggggagtatccgtttccacatcaacggcaaggaagagaagtttgagtttcaaccgaggatggaacaatgctccatggtcagaataaagtacgggctgaacccagagaatattcaagtggtcgaagtggagccacccaaaatggacagcctggtgaaattcatgcagaatttcctagagaaggaaacaacgatgcctaggaaccgttattggaagacgccggtaaaaccacccataccagccaagaagatagagcagccgactcagaagaagccgtcttccacaccaaagccaaggaatgtgtggaaggagaagccaaagacgcccgctccatcacctccggagacgggtggaaaatccacgaactgaactggatggaggtacagtcttgcacgtcggactttaaatgacacgaccttcaccaacaggtaaattggtatgtatccgcatatttgctttcaacaatttgaatttttgtatcatcacatgtttgaatttcaaagttgcatataggatttttgaattttgaggaaattcttcaaatgaatttttcagagcaaaccaaaataaaattttcagtgaaaattcgctgtgccacgaccacactgaccgttggaacccaacggccgaaagcggggacggttgggcccaccatgggttcggccaaacccattggttcggtcgaactagccaggccaacggttggctgcctccttcattgaggcaacggctagtgggcctcacaggtcggttttgaccgttgtgggtgcactacttaagccaaccggccgagagagggaattccaccccatttcaacacatcctgaacgacatcgacctcgaccttgtcagtgatcgggagagacaagcctactacatgctgagcgaccgggagtatgctcacacacgagaatactcaccggagctgctaaaaaagataggtatggatgttgaatttcgtactatttagaaagcggttggttggcagagatttgctgtggtagatgagcctggttcttgtttgcttactttgcaatttttgtgcactttgaaagaaatagaagatggaatttcctttcgctttttccataaggagtacacacttacatgaaaggcttaagtacacttcttggttttcacgattcctgtaaaatcgatctctagaaaggaatttctgggttcgagaaaaataggttttgggaaaatatttctggtgctccaatttgcaagaaacctagaacgaatgatatccataatcctacacttaggctcatgcacaaatggattgctatgactttgtttcctagaggtgatctaaggcccataggggagatgaattgattatcatgtttgccttggttagaaagatcaaaattgctcctgtgaattgtatgataaggcaattgttagaaagtataaagttctctgctcctgttgagtgcacttctctgattactcggatagcaaaagggctaagggtcgttagcgacgtgttgatgaaaaacacgaggcctaggagatctgcttaactccagtgtaggtccaaactcgccttcgggtatgctagcatgccagttgatttgatcctgcaatcaacaagaaataaaggcaaagaaaccatggttaaatctataaatgatacccgatcagctatgtgccgatgacatatcatttatccttgagccgatgtcatgtgtaaatcgatcggcagtcataaataaataagaaagaactatatccactcgatcggctgtagatattaacaatatatattccttatatcgatatatatttaaataaagtgattgggatagatcggtcgtcatgccgagacagtataaatcatttagatcgaaatatatattaataataggattatatatgttgatagcatagccgatcaaatggatctagcatgtatcggctaatactatgataccactctatactaagatattaagagaagtagaatatatcaaacaaaagtctaatatacttaaatgcaacaagatcataatataaagggtagatttaacatatcaatgaagcatatggagtaaatatagttaaatcaggtaagatcggctgaaactccgatactaccctaatcggcaaccagatggcaggctagagattgatattctaagcacgacttaatagatcaaactcaactgatgcagcattaagtatgaaaacaataacaatatctagacaatcaagcccatggaagtttcatagagtggtggatatcctatataatctaagtcaacatcgatgtttaacctaatcggctgccctctaccgacagatgttagccgaatgtaggttatatagcgatattgccagagattatgtaagatatatgataactcgacgaattacataaacaagatcagagtatcataaagatggaagcactaatcccgagaacgtaagccgtcataacaagttttacctcttgttgaagatcgaaaccgatgcagctcaacccgaaagcaagaactcgtcgaaataaaactaaagcaaaagggtggcgatgcgccgaaattgtattgaacgtgtgtgttaattgattacatggggttcggggtctatttatacccgaaaattacaaacaatgtccatatcggacacgactcttatctctaacaaactctaaaataccataagtctttacggcagacttttgcccaaacatatctctaaggaaattacataaaatatcctaattaatagatacaattgccttctcaggactctatccatgtgtggcaatcatcttgaagcatatcaactcaacccgatgtcatacaccaagtcgtattgtcggaatcggccgtatcacctaacccagtctgactcggacttagccgatcccaatcgtagccaatccggactccagccgattcttacactattctcgaatcgatcttcgtctttgactcagctttgacctaatcctcttttccgatgctgatatcaccaaattcggtcattaatacaagcccgccaagtccggaatatttggtaatgtttcggatttgctgtacgtcaactccaagcaagtttcgcactttgccgttttctgaccgttactcccatgctttaaatactaaccgtcaccctcgagagatctcgcaccgtcctcttccgtttttactgctgaaacagactttgccctctctctctccggcgactccgccgacgcaaaaggcgattccaaagcgattccatctcctgccggacctccgcctgcgatgatgtcgtcctccgccagcccgtctaccgcgccatcagccgagtacgccgaggtaagttctcatcggctagatcccttttcttcgtaagaattcgatttccccttccctcatcttgtttccttcttctcgaatcctttggatttgcagcacctctccaatttagttgcgattcccagcctgtcgcatgaaaaccattactttcttggtccaatcggcaacttagaccctactgatttcatcatcggcgaaaccaacagaatcccctttagattagccaaccctaacctaggtcactggaagaatacttttaagtcttggccatctcttgagaaaactactcctgagaatagttggaccacatggtacaagcgcctatcagctagcaagcgaacacattgggatgaaatcggaatcggccaagcgcttgcccttaccatagccaattcagctaaggatgaacctctgatggccgccgccacttatttctggtccaataccatcaatgcctttctgttcaaccaagggccgatgactcctactctgattatgatcaccggactagatgtaacctcatcggccaaccctatgagcatgaataccaagaatcaatttgattttagaaccaaaagcataggtggctggtctttctatgtggccgcatacatgggccaaggatctgttactcctcgagaacatgtggcctttctactcatgtggctggaaaagtttcttttctgtggatctagctgtggtcctacaaccaagtggcagtttgcagccgaagctcttgagtcaaaacgagaatttcctctaggcaaaatcctcctcggctacttataccaaatgctgaacaatgcatcggccaaaatagccatcggctcagtggttggagcaggtggaccatggtggctgctacaatcctagctcaacttaatggtcatgaaggttgtcaattggccatcagtaacagaagccgaattcccaaggctggagccgattgtagaagatgatggagaagaacgaacccatcgtaggtgcatgtcttatgtagattatgcatccacaccaaccgttgccggagcaaaactatcggttgagctgctcaaggattggttttgcagtgtcacgcctcgaactagtcccaaccggaactagcccgtgacgctccaaattaacctgttaatcaataccagtcccaggaaacagtgctggtatcacaggaagacagaatatcacagcaacagaggtctctttattatagagtaggagtacagtcatgttgggctgcggacagatcccgagctcacaactgcattactaaatggaagcggaagccaagacttggaccaaacatcacaggcgcgacttgggaactaggccgaaaccctaaaactcatcgtagccggcttgctcctggaagaactccatcttcttcagcaactgggggggggattatttatatagagcaagggtgagtacaggagtactcagcaagccatgggaaataagtgtttaatgcaggcttcaaagaaaggccgttgtttttgcgattgattttatttaaactcttttctgaaacaactaagggagtgcttctcaaacgacacggatgagacagtgcgtctcatccggtcggagtatgtgcaatgtttcagtcttttgaattgatcaagattggtacccggccaacagctttcaaacggccacccgggcctggctgatcccatcagccgtagattttccaaacatcaaacctattccacaacagcaaatttcacaaggcagtagtcaaacaaaactacgctaggaatcacctcacatccgcccatgaccatgggcacggctgttcgaacagttttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacattccccgatccgcagttttggaaattcatttagtttgcaagcaccgacccaggtgtcgggttttctaagtcttttgtaaaacccaagttttacccaagatgtttctcagattttaagtttgaaggcgaccgtcgatacccgtgcagagtgcacgattaccgaggcgcaactaggtgggtacaagcgaacatggtataacaattacaatggaagggtcaaatgcaacaaattaggtaggtccgccaatctgccttgcagacgggacaagcagattaagtgtgatcctatcaatgcataatatttttcaggcaacataattaagttcaaatataggctcaagatgttcaaaggtggcttgcctcgctcgagatcttgagcttcatcctcgaaatcatcgcactgcgggtcttcgggctccgaaactacacacgaaacgggacaactcagcaaacggcgaaaataaagccctattattgacctctaagcatgccattagatagatctcgagatttgaggaattttggaagttgaacggagtcaaacggacttacggttgggaagatattgaatttctaagattattggatttttggtctaaaggaaaaggatttatttaaatcctttttgaaaaagaaaagaaaagaaaagaaggagggagggaaattagactttcctcgggcggctagggcgcggcccaagagaatggggcggctcggccgagcttaatgggccggccggccaaagaaggcggcccaaggcgcgcgcgggcggggaggggagagagccggtgggccgggtccatcccgcgtggtcccgggtgggacccgcttgtcggcgactcggctcaccgtgagcgaggtgcacgcggggcgtgctagggtttggggagggaggcgcggcacatgcgcgcagttcgcggaggacgcggtgcggcgggcccacgcgcagcctcacggctcgcggtggaccgcgcgcgcagggggcggagggaagcggcggaccggggtctgcttgtcgcggccgaggtggcgccaacgtggcgcctacgtggctgccacgcgggccggcgggaggtagacgacgacgccggccggaacggacggcggacgacaacggcgagcggcggagcgaaccatggcgatacaggcgaaggcgagcacaccgggatgttgcacaggacgaggggagacgagccaatggctcggattcaccgggggatgctcgacggcggcggattgcggcggcggcaaccgacggcgggagaagggggaaacggcgatgaggtcacgaggggccgattcccggcggtgagagcatctacgcggctacgggaatccattgctagtgtcgaattgggcggagctacgccgaacgaggccggtgacgagcgggcgctacggagcacgggcggcgacggtggtgagcacacatcgagcggcggcaacggtcggggcggcgccagctagctacgggaaggctacacatgctactaccgaaaactaaggggaggagatggatcgaggagggagaacgggggaatgcactaccgagatgaggcggggcgctgtgacgagaggccgacgacacgggagtgatctctccggcctcgggccgggggagaggaagaagtcgagcgcccggagtccccttccttgtcctcgctcgtgccggctcctccgacacgcacgatggcgaacggcgacagcgaacagagcacgggaggcggcgacaagaggcgaatgggagaggaaaggaaagggggggaagcttgggtttatatgggcgacaatgtcggtttgggagaggggaaccgagtttggacggtcaagccagcgagctggcgctccggctagcggccaaatcggcgacagggaggaggggaatgacgccggtggagg

SEQ ID NO: 44406 - DNA, 18531 bp, Oryza sativa
cggagggatttgatttgggaaggatttggattcgggattgaacttgacgatagatcggggattcgagatctgagatggcacggacacgacaacaagcaaagaaacggatttggcaaatagggtttttaagagatagttttcccgctaggcgccacgacggaacgggcgctacaattaggctcttgtttgatatattttacttgttttagtatcctgatatagagtagtatcggagtattagccgatacatgctagatctatctgaccggctatgctattaaaatatataaggctgttatcaatatatattttgatctaagtgattcatactgtctcggcatggcgatcgatccatctttggaagaactagtcccaggaatatccgcaaccacctttaccttatacttctgcaccatagttcccttacgggtttgcataaatgaactcaagaactggttgcgtgcttgctgcatcatcgcttcaaaatccttcttttgatcgggtgtcagcttgtctagagtgatgttcacgatgttgccttcattaacttcagataggcccaactgttgtatcttctcattaacaggaccggggctagccgaggacggcgatgctggcggcttgtcatccatgagaaaagacttctgacttcttatatgtcccaccaggcgtgccaaaagcgtgttaatgaaaaacacgaggcctgcgagatctgcttaactccagtgtaggtccaaaactcgccttcgggtatgctagcgtgccagttgatttgatcctgcaaccaacaaaaaataaaggcaaagaaaccgtggttaaatctataaatgatagccgatcggctaagtgccgatgacatgtcatttatccttgagccgatatcatgtgtaaatcgatcggtagtcataaataaataagaaagaactatatccactcgatcggctgtagatattaacaatatataatccttatatcgatatatatttaaatcaagtgattgggatagatcggtcgccatgccgagacagtataaatcatttagatcgaaatatatattaataataggattatatatgttcatagcatagccgatcaaatggatctagcatgtatcggctaatactccgataccactctatactaagatattaagacaagtagaatatatcaaataaaagtctaatatacttaaatgcaacaagatcttaatataaaggacagatttaacatatcaatgaagcatatagagtaaatatagttaaatcagataagatcgactgaaactccgatactaccctaatcggcaaccagaagacaggctagagattgatattctaagcacgacctaatagatcaaactcaactgatgcagcattaagtatgaaaagaagaacaatatctagacaatcaagcccctggaggtttcgtagagtggtggatatcctatataatctaagtcaacatcgatgtttaacctaatcggctgccctctaccgacagatgttagccgattgtaggttatatagcgatattgtcagagattatgtaagatatatgataactcaacgaattacataaacaagatcagagtatcataaagatggaagcactaatcccgagaacgcaagtcgtcataacaagttttacataaacaagatcgaaaccgatgcagctcaacccgaaagcaagaactcgtcgaaataaaactaaagcaaaagggtggcgatgcgccgaaattgtattgaacaagtgtgttaattgattacatggggttcggggtctatttatacccaaaaattacaaacaatgtccatatcgaacacgactcttatctctaacaaactctaaaataccataagtctttatggcagacttttgcccaaacatatctctaaggaaattacataaaatatcctaattaatagatacaattgccttctcaggactctatccatgtgtggcaatcatcttgaagcatatcaactcaacccgatgtcgtataccaagtcgtattgtcggaatcgaccgtatcacctaacctagtctgactcggacttagccgatcccaatcatagccgatccggactccagctgattcttactatgttctcgaatcgatcttcgcctttgactcagcttcggcctaatcctcttttccgatgctgatattaccaaatttggtcgttaacacgaccaaattgcttttatctcagccgctcgtctgtgtattgatgagacttatctagtgcaagggcatattctgaaacatggagtagatggatctttgatttactttttctctggttgtacaaatgaaatcccgttgccaaatgcggggtatcatttgtacaactgccgtgaactaaccattcccctgcagaccatagaagaatctcgtgcaggtggagcatacagggagacgcgcaacatgacaagaaatgaacgagaaagttcatcatcctcaacacctgtgcagatgtatgaggcaggttgggagccaattggggatgcacccggatggacccaagctccacgtcacagtatcggagtctcaacctgggcaagtgccagtgaggaccggtggcgtgcgcctcatgacatccaatggggggacaatcaaccttccagatcaagtggtgcgcctccatctccaagtgaatggcgctcaagttcctctcgttgggacttgggtgaaatcactaggaggatggacactcttgatatgcagacgtcagagatacagtacaacctcacggaacacatagcacaaacgcaaggatggcaacaatctgctgatgcgcagttcgccaacttcaggaacatgatgcagcaacaggacgatgaccttcaagagtacttccgctttcaggggttcaatccttatcaaggaccctgagcgaaaaccatgcttgggggggggacatctcttccccccactgaggtaacttgtatcacatcgcatattttccctttccaattgcatcttataaaacttgaaaacaacataaaaatttgcaaaatagaaaataccaaaaagataggatatgcttgagtcatgctaggtaagacaagctagttctctttgttgaaatgatgaatagttgctctgttttatatctcttatatatgggttcttggtaagtgctctctcaaaggtcaaatatgagtagccaacaattatctgggaacatgagataaatgagttgcacttgctgatctaagtctaagttattgtgagctatgatatagtaaataagagttactatgatcctgatcctagtttgacttgaattccggatgttttgtttttcaaaattataaaatggaaagttcctcatttgatataaattcctaccagagccaaaaatgtgctatcatgtttaaaccatatacattttggttacttgtcattccattgaactctgtcaaactcttgtgacttgtgtagaaacttctcatgctctatgatcaagatcatacatccacatatatgcagatgccaaactcctacactgggagctaagcaatattccattccatttccttattaccaccaaaataaattctccatgctttcatgtgctttctcctcctagaaagaaagaaaaaaaaagagaggagggaaaggcatgattatgaaaaaaaaaagttatgctccatcaagcatgagcatgatgttgaaaaaaaatgtaatcataccctctcctaatcaataaaagaaggatttttgggagaagaaagtaagcgcaaaggagaagctttttctttattttccttcatgtaccacttttatcatataccacacacattttgcacgatcttgatcttgagtatgtttagtcatctgctttagtctaagtttttgatttagtaataaatgtgaatacaagtatgccatgtttgatccctactgaggtctacatattaaaaccttagagtaggaatcaaaaaggcaacaattggtaaggaattcattttgatacacttggagagactgagtgaatcatttgaggaacttggctttcttttgcaaaatcatttgaaaacttccagaataagagttgaataaatattgggtgattgatgctctaattactgttctatctttcaatcgctcaaggcaaggaaaagcagtgtcttgtgggaatcaggggtaagggtaagccaccgtgccaaagattatttaatttgagagatatgcagcatagtagcaactcctgatcaacaaccaagtctttgtttcctttcgtccttactcgggacgagcaaaggttcaagcttggggggttttgttgatagtcgttatcgatcagtttcgaccgtcaatattactaaaatagaggagaactagtgatgcttgcaatgcatatatttgttagaataataatattccactagtattagatatactaaccttttgcagagaatgacaataaagtggaggagaatcgacatcaactcagatgataaatcaatcggacgatgtcgagaactagacttatgtatgaatgggccaagaactcagaaataacacgacacattgggcccgaattcacaagtctacggaggaggacaacaaaggaggtcgctagccgaagataggcatatatgctacgggacagtagaggtgggccactgatggtgacagctcagtacgggtattcctctatgttagtatatattcctaagaaaaattcatagggagggtactcctccgtatttacccccggttggacggccatgataggttgtagtaaggaacttggcaacccggggtggactctcgaagtaccaggaggacactgttagggggtattggccacacgattgtatagtaacatatgtaaactagatattgagtgtatacttgaagtataggaattgagtgctttatgtttcttgttccacttagttaaaattaatttattatgaggatttgaacagctttgcttcttgtcactctacccctatattaaatataacccctacttagactttgataaatacaagtaatatatgtataaagtgtattagcaaagtccactcatatgatctttccttgggattaaaaatacgataccttggaatacttccgggtgaaatgctacaatggtatatctgtgcgcttgtggatttacttctgtaaccataaatatacgaggactatttctggcgccattgctgggaatgaatatttctagcaatgtccttaagaaataccaacaagcatttctggcgccgttgccgaggatgaatatttctagtaatgtcgttaagaaataccaacaagcatttctggcgccattgctgcggaagattaataatgagatgactataagctaaccttgattgttttcacttgtgtcgtgaaaatagggtagtgtatgactggtttcaacctaccggaaaactttaacgagaatccagaggccttcttctggagtgtcaaacctcgcgtcgtccctccgcagaagagactctccgaaaagaaaccagccatcccagtgtcaccaagtttcaggaacaaggccgagaagactcttcattaattcgttgccccgtctattgacaacgtgcctgctggcccagctgtcaacatcggagacaccgatttcgaccttaagaacaggctgctaactatagcataggcaagcccattctatggcaagcctaacgaggacgcaagcgctcatctgcagcacttacacggaaaagggtgtcagtccggacgccgttaggctatgtctgtttccttgctcactcctgggaaaggcaaagcagtggttctacgtgaaccgggcgacagtcaacacctgggacagatgctccaccgcgttcctctcaaaattcttcccgatgggatgatgccgcttattttctgcagtgatccatgtggaactaaatgaacagtagatagagcaaagggataagcacttgctggtagcaacttgcaatgatcaacaatattgttgaggcgcattttcacaaaacaataattttctagagtatggcatgaatcttggcacatctaaataagtgaaaagatagtcctttcttgcaaaactatgcatccacgccggtggcaaaatatagtccattggatatagacgatcagaaatttcatccgttagatcatccacatcaaaattttataaagccccgattgagagacttctatttcagaagggtcctctgaccttcatgtcggtctctgttgtcgaaacgccaactgcatacgtcaaaagtctggttacttaacagtggttggaaagaaagtagagtgtatataattgagaattttttcttgggatccccctgttacatggacctagaaggctatttatagcctcattacaggttcttactactagggtttaagttatacaggggaatttacatggttccccttatgaaaggggcatttacatgggtatacagtgtaattgaggtatatgggctcctaatgggccgtcaggcgatcgttggcccaaaggccactgggccttcgtgaggccgaacttgctatggcgaagttgtctcccttcgacatacactcttcgccttacatccttcgcccaagaggtctttggctctgcgaggcacccgagtgattctccgcccttcgccgtctttgatccatagtcttcgccatgtgggcttcgccccaactgatcttgacgtcttaggcttgaatccttactggtcgcatggtttcggcaggtttggtcgaagggcctcatgccaaaccgcgaactagcccctcatgggcaagggtgagataggagcttcgggcgagaccgtgcagaccatgtggtatggtatgtggcgccccctttcgaccgatgctcctgccgaaacctatcttattcctgcaaagaaagtgcgttgtgtcttttcggttggtattgttttgtagctttcacctcttgcggatggtggagttatttttttatttttcctgggccgaaaggaacagtaatgggctttcccttcgtgggcttattactgtgcggctcggttgatgggaatttaccgtttcgcctacccttgcgatacgtggcgctttattactggtgggtaggcgaaccgttgcctgggtgggctatatattctcaccctcttttcccttttcaccgccacacttgtcatttttgccatgcgcactctattccaccgttctttcctttcacggtgccccttgacccctcatatctttcgcccattccctttgtttgccactgcacacacccttcgccatggctcctcgaaagccaaaccccgcttcggcgaaagggcccgatcccggccggattgacaacgacaccacggcctttttggtgatttctctcatagatgatggcgagctggtgaagttggtcagctctggggcgttggttgaggggcaggctttcgccctgggaaggccgtggtaccaaagcccgtcgacaaccggacggtggtgttcatcgtcttttttgaggcggggcttcggttcccgtgcaacgtgttgttgccggagatccttcgccttttccaggtagagctcccacagttgagcccgtcggcgctagtccggatcgccatcttcgactgggcgtgccggacctccgggtttgaatctagcgctgaactctttggcgccatattttttccaccgtgaatttgaagacggtggtgaccccggccggaacaaagaagacgatgttcgggagcatgaacttcaacgttcgccccgagcactccgatctctggccggtgaatgctgccatgtcgaagtgggatcgccactggatggcgaggtggttctatcacaccatccccttcgaggctgggtccgagtcggcgaaggcccttcggtgtcggcgcagggcgattgcgccgaaccggaaacccaagatcgccgtggacggcgccatggaggaacggttcgccttgctgcgcaaggtctgctcccgcatcagctgccgcgacttggtggaggagttctgtatgcttctcattttcccctctcccattcgtggcaagtcgcggttgaccaagatgaagaggtcaacggtttgccgaagctggttcttcctgaggggacgaacggtgagattgcgctttcgctatgcgcttatgtgtttcgctatttttcctggctcgacgcttaatatggctacaccttttattttcacagtgttgactctcgatcaggccgatgccaaagcccggaggatgatcggcgatgtgtcggtcatcgagtacagccagctgctcacacgacaggccgctggtcgggtggaccgggtttacgacggcgaactgcctccccgggcgaacccccacaaggccgacgacgatacagggccttcgcgaaagcggacacacggacaagtgagactggcccctagaaagcaaagggtccatgcttccttcaattctgacgctgatgacgaggacgacgtcgaagagcgtgacggcgaggaggaaagggaggaagaagagggggcggacgctgcggccggaaaggctgcggacgaggcggtcgaaaaccacgccgagacccctggctacactcctactacaagtccagggcataatgacactggggtggagtcgaatagctcccccgttcattgaaagtatttgcagggggcaaaggcgctagttgcgttttcggcgggaaaggtggcgaaggggtgtccagttaagaaggccgccaagaagaaaggactcgtcgatgttgctcgtgtttttagcgacgacgagtcttctgacaaatccccgacttcacccaccggtcgtagcttagatctttcgaccgcccccgttcttccgatcgacgctagcggagcgggtggcagtgccgccgccagggcctcagcctccactgatcgtgtcgtgaaggctgcagctagggtttttggaagccctttgcgtcagccgattgtttcgctgctagtgaagccgaaggggaagggggcggccgtcgaaacatctgcccctgaatattctctcgcggcgccccacttcgcccctggcgatttcgagacccgggcggaacttattccctttgttgagggggtaagcaaccttgtctctcctgtcggcactctgagcctattcaccgagctgaatgagttcgacgaagggtattctgctattaaaagcttggcagttcgggtatgctgttcgctctctcttcttgtttgtctttattttcttcttacagatcccacaactaacatttgctctcttcgtccgttttaccttacatccagattcttgcggctcactgttcgatagagcgaaccgtgcgggcccgtcttgacagatttaggatacatcttcgagccaaggatgatgagattggccgcatgagtttggagatggaggccctcgccaacaccctcaaggaggtgaaggcgcaaaaacaagcgactccaagccgaactggagaaaggaagagaggccagagctgaggtcgatcgccttaaggccgaactggagaagggaagagaggctagagctgaggttgatcgcctcatggccgagcttaaaaaggagaaagcccattcggctgtgctgaccgactattacaatcttactgagccgaagatagaggctcttgacctggaggtcagcaaggctgaggcaagcgctgcggaggagtcgcagcggttttcgcgggagatggcaaaggccaccgagtccgcaaaaacggtgtgccaaatgctccgccttgccctcttcgacatgggtgtgagggtgcgaggagtccccgccgaagatgcctctgcctttgacttttcggagtggacacagcaggctgctggtgtagtttcggactgcgctactgcgtacggtgattgctgtgcacgtgtatcggcggccttcactatgggccttctgcaccagtttggctgtgagcacgtcgccgagttccctaactatgcgaagggggaatgggaggttagtgcgcaggacgtttcgcccgcgctccgcgcgtggtggagcagttctagcagaaggacggccgatccactgccaaggcgtgccttttggagcaaccggcggaggcagaggtggcagaccagggcgaaggtgaggatgcggcggttggatggggtggaggcgatgcctaggatcacccagaggtgtgaggccctccgccctttccttagatttttgtagtttttcttttttttcgtttgccgcaaaagacgaacaatgtatatttggccgatggccccttacccttcttaatgtagctgaaaatggccttttggatatttggaatgtatgactcagtcttagtcattttttatggtcgatgcctttggcgtatgtgcttgcgccattttcgtattacgtaatatttgctctttttcgcccattcttactatgcaatttgccttttgccctgtctgcactgtttagcagggtgttcgccgaaaattgtgcactgccccctctgggaattggcgaagcaaaaacgagaaattcgtggtgttgaagggtctgccaaaagtgcgatgcccgtttcggcctatttatcgcgagatggtaaaatacggccacagctataaggttttaaggttgccggctggctgcaggcgcaccccgggagaaccttagaagattacgatcgtgttcatacaaaacgtttggaggatatggttcgcttttggcgaaatcatcagaagaccttagaagattgcggttttaacgtttggcgagcgatgcttcagccgattcgtttcgcccccctagcatttttgctgatcaggcgtttgccttagggcttttcccacaaattatcaatcacacaaatagtaaggcgaaaaacacaaagattttatactggttcgggcctccgggatggataatagccctacatccagttttttttgtcttttttcattttcctctttttttttgcattttcgtgccgaaaggcatacatagtgccgaaaggcttacataacaatatgtacatttttacaagttggcgattcgggtgccacccgttctacacatagaaacgcttgagagaggcagcgttccaggaacgattgaactcttcgccttctagtgtcgctaggcgaaaggaccccgtcctggacttgtgcttgatgaggtacggtccttcccacttcgattcaagcttgccgaccgccaccgagttcgctttcttccttaggacgaggtggccgggcaatagctccgtcggtcgaacttttttgttgtaagttgccgaagtgcctgcgacgtatttgcgcatctgttccagtgcttcgactctcaccccctccaggagttcgagcgacacctcgcgcccctcttcgccccaagagaacatcacccttggtgaattagcccctagctatgttggggtcattgcttcatcgccatagagaagcatgaacaggctgaacttggttggccttgtgggggtcgtccgaagggcccagagaacagatagcatttcatctcgccatttacccttcgctgccccctcaagccttttctttagtgcttctaagatcttaccatttgtgcgttcggccgccccgtttgactacgggtgtgcgatcgacgtgaacatgatttccatgtttagcccctcacgcatctctctgaacttgtcaatgtcgaattgcttgccgttgtcagtgatgaactcttttggcactccgaaacggcaaacaatgtttttccatacgaacttctaaactgctgccgaagtgatcgcgccaagtggttcggcctcgatccatcaggagaagtattcaatagccacaattgcgaacttgtacccgtttcgcgccaccgggaacggcccaatgatgtccagcccccatctggcgaaaggccaaattggtgcgataggctgcagctcttattggggcgcagtttagcttcggccatggcgctgacagctttcgcatttcttgacttgctcaacacagactttcagcacggtgggccagtacacaccttgtcgaaacactttggaggcaactgttcttgcggcctgctgtgtgcctctgtgaaacaaattttcggcaatatgcaaagggggtagcgcacgagacctaaaagtagatggatgcagagacaaaggatttagacaggttcaggccctcccgatgagaggtaataccctactcctgtttggggatttgaatccgccgggtgtatattgatctgacgatcaagttgtctcattctcatgccccctagagggcctcctgccccccttatataggatggggggcaagattacaagatagaaaccttaaccaatacggtatcggtttcctaaatctactttacaatcttatcaaaccaggactttaggccgttccacaatatacagggaaacgtaatacccaagtcatgatccgttacatatttcataaatataagtcatcccctatagctagtcggataaccatgccgtgtggatatggggtaccataatctccacagtagcccctgagaccttcacagtcaaaaagataatcttctctcgaactagattactccaaagctgagtgctttaatcatcttcgctatggtctccgaagtacttttaaatatgaagactgtggagggctgaaaaataaagtcaggtgcatcgactagatgcacctaataggtgtagccccccgactatgtggttagctaaacaaactaagcatatagtcaaggaataaataatccaaccaaccgagtggttttgataattgtaatcaaccaagtgacttgatatcaatatatagcatatgcggtgtgaatccctgaataacatgatccgagtgatatactgactgttttgtaaaatatgatgagtgtaacctaaagttggctacatcattgaaaattcacatagcaaaacagctataaagaagtttgtatgttgtgaataaagaaatttccaaagtattgggcatacaccatgcgcacacttctttaacagatgtgcttgagtccataaaagacacatggtttcaccacacctagaaatatatgccatatgtggtataaaatccgagtaaataaactcataaggatttatcaatcgtttggaaaatgaccaaaatatataatcagcctaagccataatattggtcaataaaaatgcacacttacgtggcaaaaagcaatgatattgtatctaatcaattgctttatgaacccaaacagcgccttgacttatataaaaaagtcagcggggagctatataaagcattattgtttggcaccttttaaaatgtattgtaccaactcctaaaaagttgagtaactgcggtataaaaggattttaaggtattgggcacataatcacgcgcacttttgcctaagcaaaaagatgcctaagtccctaaaaaaacgtgacaggccacacctgaaaatatgggctgcagacatattaggcctaggccaaaaaatatgccttcgacaccctttaaaggatcacgcatgtaacatgctcccgagtaataaatctttcgggtgatatagaccaagtgtagctcatatgaatagcttctgatctgagggattatcctttatgggatactccaaaatagatataacaattgaatttcgactggcgcaagtattcggttaataacccatacggggaataataaatagtccagtctttgagcatagaaaatagacccatgatcatcaaattcatgttgcatgtatccggaacaagtccaaattggagatataatcctcacgcttgagttgatgagcccctgagcatatagcttgtccttctgtcatagtcaccattgtccattgatggtagctgatgcagttggcatagagacaagacgaccaatatagagataatattgcccaccagaggtggcaaaaatattggtagtagtgaagatagtgataccaatcaaaagtgatgaagttgcatagccgtggaggcgaagaaaccagtcggcaaccgttaggtcagccagcaatgaatatgaaggcacccagcgataaagttgtgtagccataccagcgaaataattagtcggtgacagacgatgcagctggtgaagaagatgaagatgcccattagtggcgacataatgagccatccatgaaggcgaggataccggtcggtggtgacgaaagccagccgacggtgaagatgtaggcacgcatcaaaggcgatgacgaaatccaccaatcatgaagatgaagaaaatagtcggcgacgacaaacacaaccgacagtaatgatgataagcagcaatcatagatgatcaaatataatgacgaagttgcccatcaatagcagtagagtgggctatgttgaagaggcttgataggatgttgataaagatgacgatgtcggtgatccagtcaatagcagtgtagcagccgatgataatgacgatgactctcatcagcgtttgcatagtaggtcaaccgtgaagacgaaataacaagtcggtgatgagagttgatgatgataaaagtaaccgaaggcgaagacgtagtcgccccttagcaatggtgtaaatgtcagggccgatgaagtacacatgctggtgatgatgtcagtgacaataatccatcaaattggtgttatagctgttgcagatgcttcacttggaggaaagtagatgatgttgtccaactggtcgaaactgagctgattggttgataactctgctctaaagcaaagacgaagataatgactcctggaattgactcgttggctgattaattgattacttcagcttgtcgaattttaagagtcttgtatttgtgtagcccccgactctttggttagttgggaaacaactgaacatagagtcgagaactgtaacttcttgtcgtcgagtagtcattacttgagtgaagataaatattaaagattggaacaccacttgttgtaataaaataacacggcatcatatttggtgacgtatgccgaggtgtcgaaactcttgtagtcgtcatggttggtgaagtagaggcaatagagtttgccgatgccgaagataataaaaatgaagttgctccaccatggtgacaaaattgcatagccgtgatgaagtcaacacgactcggtggcaacagaagcaaaccggtagtaaagacgcgcatttgtgaagataaaagcaccagtcggcggcggcataaccagtcgatgacggaagacgatgatgtccatcagtagttgtagttgtgttgaagatgctgacgcctattagcggtgacggcgatgtagccagccgtgaagaagatagcatcagttggcgtcataacaggccagccgtgcaggcggtgacaccagttggcggcggatgaggcggccagtcggtgaagcggtcggttggtgaagacgtagacgcccaacaacaccagtcggcggcggaaacaccagtataataggccagccgtgcaggcggatgttctgactgatccattcctggagcgtaagagataagcttaaagccatgaatcccttttatgcatatctggatctggatcctacagaacaaacatataggatgagtagtatctgatataaatataatactcgagaaaaattcaagtattttaaaatatttataaatatatatttcttctcttgtcaattttgatttccccgagcagatgactcattacgtttaaacattctgcccgactagtcatagccaccaaacaccgggagtcggcctaagcactttccaaacatgcatatgagtgacatgagttcgtcattaatggaacaaagtttcacgggtcggagtttactactcgggtacttttgcaattattaagagcagaaaataaattatcttatctctatgcttttgatttattctgaataatacttagcaccttgcgttattcggtccatccaacaagcccccgggtgctaggaatcagcccaaaggcaactatccattggcaaaccaaacggaaagcataggaagatggaactccataactcgataggcacttttgtactcagaatatgtcgcaagcaatcaagataaatattatgaaaattgtttaaaaaaaatgatataacatctatagcccccgactcactagtcaacggcgaaccagttgatgtagtgaggcaaaggaaaaggcaaaatatcatataaagaataaaataaatgatgacttagctttattgtattccctcggtgacagcaaaagtagccgatgtgggaacgaagcagtctatcaatggtgacaaaaacaccagtcggcgccagtggaaccaagccagtggtgtagatgatgaagcccattaacggtggcgaagtccgccaaccatacaggcggaaacaccagtcggcagcggacgaggcggccggtcggtgaagacgtggatgcccatgaacggtggtgtgaccaaccaaccgtataggcgaggacactagtcggcggcgacagaggcaagccggcggtgaagttgttgttgctatcagcaatggcggtggcgaggacaagccggcggagtggactcgcggccgatcgaccggaaagctgagacgcctcgaatccatgaccagcatcaatcgcctcaatagtgccgcgtaattatatgcgaacaacaacaaaaaatagcaagagattaatctgacattaaaaatcaatatgataaataatgataaaactaggcgtccggcgctagacgagtagttagcatgagtagatataaaaaattgctcaatggaaaatatcacataaagaggaaaaataaaggcacttagcttttttctcagtgtcctccgtatatgtgttaatggatggacaggagatcatatcggcagcttgtgacagacatgcaatacatgcatgagtgctgcacttccttgcgcgaaaattgctcctattggttggctcacattccacgtcgactccaatttagattggtaattgaatatcaccaggagatttaacgtcatctaaaaaaaacgctggcggttgagaattgatccgttgcttggtgatccgggtagattgatatcgccgaacagattaaaccagatgatggacacggcatgtcatacgatcaagttgacgactgacgtcccatcggaattttcggtggtggcgatgcaagccaaactccagaagagaagaaccagtccgaagatgaaggtggtgctgacggcagccataggagattgaatctgaaacttgccgtggtagattgttgtaatccctcgattgagtttccccctgactaatttggatcaagtcagagaagaggagcttgaagaagttatcgacggaaaggaagtgaaaactcccgaagctaaaacgaagtcggcgactcatgaagttgattccatcgcgctcgttgataggaaactcgacgcagcccctacctggcgcgccaactgtcgaaacaaattttcggcaatatgaaaagggggtagcgcacgagacctaaaagtggatggatgcagagacaaaggatttagacaggttcaggccctctcgatgcgaggtaataccctactcctgtttggggatttgaatccgccgggtgtatattgatctgacgatcaggttgtctcatgccccctagagggcctcctgccccccttatataggatggggggcaaaattacaagatagaaaccttaaccaatacggtatcggtttcctaaatctactttacaatcttatcaaaccaggactttaggccgttccacaatatacagggaaacataatacccaagtcatgatccgttacatatttcataaatataagtcatcccctatagctagtcggataaccatgccgtgtgggtatggggtaccataatctccacagccacaaagcccctggtgtatttcctttgccatttcctcaacttcggcgaatgagatgcagcgaagcaaaggttggagcaccccagatcgatatagttggcccgagaccatcttgtactttgcggctctgagctgtaagctctttgcttctgcttcgtcctccggaagccagccgctcttgaggtaccttatgaacgggggtcgccagtcttctggatcttcgcccagttctacctggtcgattgccataatatccaggctctctatgggcacgcttggtgcgtgtaggacttaaaaaagatgccaggcgaatgcgggcccctacaagcaacagatttcgccaaggcgtctacttcctcgttctggtctctaggtaagtgttcgaccgttatgccggtaaagcatttttccatagaccgaacagcctccaaatacttcttcaatccttcttcttttgcctcaaaggacttatcaacatgacttgccaccaacttggagtcggttcggatgagcaagtgccgaacccccaatgctttcgcatttttcaggcccagaagaatggcttcgtattctgccgcgttgttggttgtgtcgaaatgcagccttgcggcataccgaatcggcacgccccctggcgaagtgagtactgccgtagcgcccgcccccttgtgcgaccacaagccgtcggagtacatcacccagggttgttca

SEQ ID NO: 44407 - DNA, 897 bp, Oryza sativa
aataggctatgttgaagaggcttgacaggatgttgatgaagatgacgatatcggtgatccagtcaatagcggtgtagcagccaatgataatggcaaagatgctcatcagtgtttgcgtagtaggtaaactgtgaaggtgaaataacaagtcggcaatgacggaagcaaccagaagcgaatatgtgatcacccattagcaacggcggagacgtcagggccgatgaagtagaggtgctggtgatgatgtcaatgacaataatccaccaaactgctgagaagatatcgaagctcgagtagtttccttgatgcgagcgtgtgtataacaaagattgatgcaacgccccttgatttataaagatggcagtagaacttggtgtcatagctgctgcagatgcttcatttggaggaaagtagatgctgttgtcaaactcgtcgaaactgagctgattggttgataaccctaaactctcaaacatgtagattatctctcaaacttgatacttgagaaatttgaagtagaccgtggcatcagctgagagccagaatagtcactcaaaatgttggagttgctgaagtagaaagcttgctctgaagtgatgatgaagataatgactcccggagttgactcgttggctaattaattgattgcttcatcttgatataacaccagtcgaattcgaattttaagggtcttgtatttgtgtagcccccgactctttggttagttgagaaataactaaacatagagtcgagaactgtagcttcttgttgtcgagtagccattgcttgagtgaagatatgtgttgaagatgtccgagtagaaatcttgaaaattggagcaccacttttgtagtataataacacggaatcatatttggtaacgcatgccgagatgtt

SEQ ID NO: 44408 - DNA, 718 bp, Oryza sativa
taaggtcttgtccctagttctggtctattctttccttgtttgcttcctctctcaacctctacattgtgacagatggataacactggtaacaaaggctatgtgaatgatggatccgatgactcaagaacccaagccaatgggaatgagaaaagcatcaacgaaacctcaccagagctaatccaaattgtggttaaccaaaccaacatgttggcaacagcatttcaactattacagaattggaacaacccagcaggggcaaccaacgttcaagtacctacagtccagcaacagtgcaagttatcagaatttctaaaaactaagcctccaacctttgccattgccgtcgatcctatggaagctagtgattggttgcgcacagtcgagaagaagctggggttgattcagtgcacagaccaggagcgggttgtctttgcaactcatcagttggttggaccagcttcagaatggtgggatagctacgaagcatcacggccagaaggacataccatcacctgggatgagttttcagccgtgttgaagagatcacatgttcccgcaggaatgatcacactgagaaaacgagaattccgctacctgaagcaagaagatttgaccgtcacagagtacctgcatgagttccatcgtttggctcactatgtaccagaagatgtggaaactgatgaagacaaacaagagaagtttctgtaggggttaaaag

SEQ ID NO: 44409 - DNA, 2757 bp, Oryza sativa
tggatccccctttcataatattcatggcattcctataacaagatagaagagaaaagttgtgagataaccttgtttgtttgtcgttgtccgttgtatcagcaccacgctcactgccagcaaggtcaataaacgacaacttgccagccaatctgggtggttttgagtcattgccatcaacacgctttttaatagcaagctgaagaatggcatgggatcttgatgactcttcatttgcaccagtagtaccggtacttctggtggcattgcctttctcaatcaactcctttatggtttcaacatcagacacccgatactcttgtaaaccaacaatgcaaactttctgtttcccatcctccctcatgcaaagtttactgcatgaagtcaaaaatgtttcgaacaagaagatgtaacaggcttcctgaatatatactgtctataagcataattgattgggggctacttacctcctttcattgagaagatcaaataatttcccaccatatatttcaaagaagctcacgaataactgatagccttgattgcgatatgtatgatgcatcaatctcagaatgtcttgggaggccttgagaggcagtggacgcatggtgtaggtctttccactacctgagtggacagaatgagattgaatatagcgttaaggattctgtacacacacatgcactataggcaacaaaataggtgcaacccaccctcactggttgcatgctaagggtggttgcagctcagatgttgccctgagtctacagaagattagacatataccagtttgtccataagcaaaacaggtagctttcgtacgattaaaaatagcaggaacaacaggttccactgtttctcgataaacctgtgaattaaatgagtaaaggctgttgagaatggatctacaaaacttaatgatatgaattactaagcgtaggtggtttatactttacactcacctcatcattcgaaacgtcttcatctaggacagcatcaaacacaaattcatgtttctcaacatattcagtgaggtcaacctgcacaaaaataccccaagacattgataaatgagtatagactgatagtagggagcaaagaatataaagaacattcgtcataacaatgcagatgaatgtaaatagctagcttggaatgaaccttgagtttggtctcatgaacagtcaaggagttcgactgttgttcaatgtctatgatatcttcttctttctttgatatctccttcttattaagtggtcttttgcggacctgcattcacatttcacatcaaatctattagaagtttgcaggttatcttaagctcagcttttctatgaaggaataattatcaaagattatggacaaaaccaagaaacataccaccactttgattttcgcaacaggagctgccttctctttctcagggaaggccttgaggaaattactttcagcaaaaacagtggatttgctcatctgtttatttggagcgaaggttgggtctgaatcatcaaagcctccattgccatagccaaatttttgggcaccatcatacatgccaatccctggcacttgaaactgcatatgaatttgagctccagttaatagaatgatttcagtatggtaaaagattggatagtagataatccttgatcctcactgcaacaacacaaggttcgtgcaaacatttaggtttaaaatgcaccatcaatcaacaaacctagtacactgcatcatgtaaactcaacaacgaaacttaaacaaaccaacaactggaccatatagtcagtattgatgcggtgccacatctcaacaaccgtccacgattccaccaaagtattatttgtttaacatcttgacattccaatccccaaaagaattgcgcatccaacctagcattcctaaaagaagaccaaaagcaccaaagcagtgcacttctccatttcctttccaaattccaactcactgattaactgaaaagaaaaaaaaacacccttaaaaaagcgacagttctgactgcccaagcggccatgccatcgcattgggattcagagcatcagatccacaacgtcggcgtcaatttggaaacgcggcgatttaacccccaaccatgcgagacaatcgaaacagaagggtgggcactaactagaaatgcagctggtcttacatcgctgataagctcggtgtcgaaggcgtggagatcgagcagcccggggctgagctgctgcctctgccccggcgactcccccgccgccgcagccgccgcctcccctccccgcagccgcgccggcgtcgtcggctccaccgacacgaagatctccccatccccgcgccgcaccccaccgcgctgcacacacacgcacacacaaacacaaacgagacacacccattagctcatcccggtgatcccgcacggccgcacccccacgcgtagatctcgaagaaccccgcacgccgtacctggccccacttgccggcgccgcccccggcattggcggggacgtcgaacatgagctgctccgaggagtatcgccggcgaccgcccccgttcatcgtcgccggcgaggctggggtggggattcaggggctccttccgaggagagggaggaagagagagtggaggggggagagaggggggcgacaaggggaggcgtggtggtggagtagagtaaaggccacccgtttttgcggcttccaccctgggactcgcgtgccgttgcggagacgccctccggtttgaattttggagtggagttcaaggca

SEQ ID NO: 44410 - DNA, 6095 bp, Oryza sativa
gggtgggtttgtgttaggtggacgccgtctaaaacccgcggagggggttagtgcggatttcgttttcatccttttcagtcaggatttgttgccctgtccttaagccggtttaaatagagagttacgtcgatagggccattcgattatcattgtttttctactaagtcattgtcgaaatgattttttatttactacttataggcaaatgtgggttttgtttttcatttgcgatgaataatttgtacaagtaaagcttgtaaccatgtttcttcgataagtttagtaggtaggagtatatgttaaggataaatctgtgagaatgagatcatagaaaaagtgctagagtatatattatagttagagttatattaggatatgcttgatttgtgttggactccttccatatttgtaattattccttatctctactctatgtatctcctatatatactggctcatgagccccaataaaaatatgtccaatattcactatattcttatctccctatactattcaacatgatattagagcggacgaactagggccgaccttctcacgcttttgcgtcgtcacactcacacccgggagtaaggatctcccgggggcggccaccatttcattctagttgtcaccaagacgccaagtcgttagcctaggagaaatcgatctccctgggtgtttttcttcgtcgtcatgcttcgacgcagagatcgatattgatctcctcggcatgtctcctgcttcgtcggagtcttcatcgttgaattctagtcttcgtgtcgtcaagtcaagcacagcaacaactccctccatgccaccatcctcggtctaccgcgctcttcctgctgacggctagccgtcggtcttggcgtgccccatccaaagcacgcgacggcttccccacctccgtatgtttgcctcctcactgtgtgctagagcctcactgtcgtcggccaccgagtcccactaccacgccgctcccgatcgcaccccctccgccttcgtcgacctcctctaccgctggcaccgctccggggtgacaaccacctctccaccaccttttcaccaccccaccagtctaccgttgacaaggaccactcctccgctgcctctatctaactaccccatcccaggtcggcgccccatgggcctccaccaccgccgacatcatggagctcgcggacgctcgcttggtcgtcgctcgtcatcgacctttgctagagcagccttgccattgatctccagatgctcgtctctagcttctatctgtctacacatgtgtgttatattatataatagttagagtcatattaagatgagattgatttgtgttgactctttccatatctataacttttttcttatctctatccccatgctcctatatatattggcccttgagcctcaatacagtgtgtctaatattcgtagtattctcttatccttatactattcaacaaagagttacattctcactatgtctttagctccaccaagtccaaagctcaacaattttatttcatcaattgtcttgtttacgaactcctgaacccaagttcttcattcttgaagactcgtctattacactcactccatatttcccatgtaagagcatctccaacaacatatctaaatttgactctccaaacatccatttgcccagcttgccaaaaatttggatagtcgaatttgcctttcactccaacagactctctattacagttctccaatctgtcagtgggtcccacatgtcagcctccttatttatttttcaccccttcttatcctcttcttctctttctcttcttgttattcctttttctccgctatcttgtcttctccacagtcgaatcctggcggcggcggaggatgcggtgatggcggcgaggaggagatgacaaggttccgccgccgctagagatgtgggggagataaaaggagacaagagagcggagacaaggaggatgttggtcgatatagcgacaaaggcggcagccggagctcaagacagcggatccggcggcgacactcctccctcgacggatggtggctgtggcagggaggggcgaagtgtagcagcaagagtaaggagggccgccgcacaggaggaagtcgccttcgtggctgccgccaccaatctagaagaactcaatggcacagtggaagaggtcgacggcgcggaggagcttgtggcgccggaaaaaggaaggcggttgatggccaacgccgagaaggaaaggcaacggtcgagggaggcgagcggccggcactgtggagagtgagaagcggttgatggccgacgctggagcacaagagatgagggggacattcgtggggaggaggaatagcatgtgggcccatcgtttggtgaggcatattggctggcaattcaagccacatcgttttttttcgctcgaatggctaaaaactggtttggagaggctaatagagaggttgttagagcatcaccaacagtccaccaataatctatccccaaaaattaatttttgggtttcctaaactaaaaataggtggtgaaaaaaccccttcctccaaaagatagcctaaattcaatccccaaaaactaaaagtgggcccttctgttaaactatcaatagaaattctagttttttttcctttctcgtgcgtagaaggagatcgccccgacacgggaaggagaggagaaacgtggaaggaggggagaaacgcgcggaaggagtggattgggagtcgttctctctccctcaaatacacctcccgagaaaattggagatgggaactccaaaacgttcagagctcttttgggaatctgttagaccagtttttttaaccaaaatctcaaaaaaataggattaggaatggaatagatagactgttggtgatgctcttagagatgttataacggatgagaacatgtttcatttctcttgaattgtgtttatcttatacttcctccgtttcacaatgtaagtcattctagcatttcccacattcatattgatatcaatgaatatatatatatatatatatatatatattcattagcatcaatatgaatataagaaatgctagaatgacttatattgtgaaatagagggaataaaagctatgcaccttaaaagcaagtacctttagtaatcctaaagctagagctaattagtgcagtactaccacgaaaattatcatgccagatttactgcccgcacgtacagtcacggttccccccgaagaaatgaacatgaagtgataccgtgataagtggcgcacgactgcacgctaagtaaatacttcttccgttctaaaatgttgctatctaggatttgatttgacccatcatgtccagattcgttgttctaggatgggtcaaattctattctaggtagcaacattttgggacagaggaagtacttcctcagtcccctaatataagggattttgactttttatttgcactgtttgaccattcgtcttatttaaaaaaattggaattattatttttttgacttactttattatccaatgtactttaagcacaactttttattttttatatttgtacaatttttttaaataaaataagtggtcaaataatacaagtaaaatgttaaaatctatcatagtatgggacaaagggagtatttcatgcaggaaaagaggagtatcatctctgtcctcaaagtttaaacagctggcgtgataaacctttctcgccaggaaaattttcaaaaagcacaaggactcgacggcaagaaactctcgcaaaatgagcgagggccacacaggccacttcggttttgaatagcgcccccctcgggtaggcgatcgcctttcaccggcacgtggcggccctcctccgcgccgggctcggccggtgacgcgtcgaacgcgaccgaaagcggcccggcgcggacggcgctccccccgcaggccacccgccggttctgcccaggcgccggacgtggggcccacgacgcaggaccctctccctgtcaagcgggccccaccccgcacagcgtccctggctgatttagacgtttaattaaaacacaagtgttttgctggttagagcaagtttaatagtttaatagtatagcccactactaactctaaatcatctatagctaatgtaatagctaattcatataatagttgcttattaatatctggttccacctatcatacacatattacgtcttaaaatccgtgctgcagctagttacaggtctatagcccgctgcttttttttttctctttttttatctttttaaaatatatttatagctggcttatagcctgctattgtaagtgctcttagtgggcgcgattatttattagcaaggactactaaacaaatcaacgcggctgatagcgttgcggcccatgtttgtggcgctttgctcgcgaaaaggtcaaaaattgcttgaaccctagcgccggagccatgcaccgcggctgtggtgcgtgtcacagactcacaggtgggcctggtttcccgattcaaacaattccaaggtaggtctgcaaagcagctgtgctcgagtttgaacgcagcaagcgagacgggtatatggcgtacgtacacgagaaccctaatcggcgaccagtcgcgggggaaccagtcgcgcgcaacctcccccgcgcggagaggtggcgtgggcggcgcggtttttattttttccgaacgatttttctttcttttttttttcggatggttttctttctttttgttttttctgttttttttttctttctgtatctttgccgtgcggttttttttgttacgcacgtttcttttttctgtttttatttctttccatatcttttttagttttttcggttttttaatatgtacatatacaaattttgtatatacgtatacaaactttatatgcatgtatacaaactttgtatgcgtgtattttttgggttttatacctacgcataccaattttgtatacacgtatacaaagtttgtatacacatatataaagtttgtatacgtgtattttttggacttttttacgtacgtatatcaattttgtatatacgtatataaagtttgtatacacatatataaagtttatatacacgtatttttttaagttctttattcatacgcacctaaactttatatacatgtatatatacaaagtttatacgtatgtatagatagtatatacacttgcatatacatgtaatattatagactagaggatatagtagtatatatactctagtatgggcaactcatcagtttcccccgtacgtacacgcctggtatccctaatctcgacgctttcttcgttctgcctcagtttcaagacgatacgctaatatctctccccgacgtttaatattagcgagccccgaaagcaaagcatatagattagtaccaccatgtttgggcaaggggacgcaggaggagtacgtgaaaacacgagaacacgtgacaggagaagcaatttggctaaaaattttgcaagcagccacgctgggcgtgtatcctgtatgagcatgggcattggcgcattgcacgcattccagagctcaaacctgagaggggccgaaaacgttcgggatttcctcgtttcaggcccatgcggtagtctaggtctacgaaaataaactacgacgggccaaggccgacgaaaatattgggattaagttcactggaggtccctcaacttaacagcgagattttttaaggtcccttaaccacagaatcagaaatgtgtacccttaaactcacataaaccgtgcactcaaggtcctatagcagtatatatgtgtggtttcactgacgtggcatcataatcagcaaaaaataataataaaacaagtgcgtggggtccacatgtcatccttcttctcttttcttccccagcctgggagagagggggaggcagcctgacgccggcgggagaaggggtggccgacgcgggaaagggagggggaggtggtcggtgcaactggcgggagaggggaagaggtggccagccgcgccgacggcgggagagggaggagagacggccgtagttccagcctgcggagaagcgcgccccgtgaccgcccatgctaccatgttctcggagcc

SEQ ID NO: 44411 - DNA, 10195 bp, Oryza sativa
cgcgccgcaggagcagaggaggagggtaagtcgtcggacgcgtagtcggcggcggggggccggcgtcgagctcctgtccgcgtgctgctgcgactcggcaacaaccggctcgccgacctccttttccccctcccgccggcacagccggccattgtggtatcctcctcctcctcctccgcggcggcggcagggggcggcatcgagctcccgtccatgtgcggctgtgacttggcgacaaccggcttgctggcctcctcttccctcctcccgccagcacagccggctgccgtgatgtcctcctcctcttccgtggcggcggcggaggcctcctccgctgtgacaaccacaggttgagataagaagcaaggagagaagagagaagaaagaaagaacgaaaaaaataatagatgtggggctcacgtcattttctcttacacgtgggtctcacatattttatttttattttttctgactaggatgtcacatcagtgaaaccggacatctatacttctacggaatttaaattacatgcctttatatagtttaggagtgaatttaaagtcgaggaccggtaggtgaatttattccaaaatattggcctacctgttgttttcaaggtttcgacgaaacggaggcccagaaacggcccagtgtactggcccaggacaagccgaagacggacgcacgcagcaggcacaagtgcagaacggcgaaagttcactagcccgaccaactgataagagctgccgttttttcatggcagcatcacaggcctgttgatccatgcatatactgtactacgcagtagtgctcatcgaataaagacggagtttttaggtttgatctattgcccggtctacggaagtgaaaagagtactggtacaaatacaagtgggtttctcttttattgttttctggcatgatcgtgcattcgtgcgtgctcacactgtcacacatcagctatatattctcctcgaaaggcaggcatcggctatattctcgaattatcaaattctaagacccacacttgttctctaaactaacaataaacactacgaggtcttatgcttattaactgctagtcctagttggttgttttagccgagataatgagatttagagagagagagagagagggagagagagagagagagagagagagagagagtataaaaggtgtggcgtgtacacgaccgattccttttcgcttcgagggtaggcagctagcagcacatggccggcaaaacagttttgcagcaggagagattcatccgttcaattcgctgcaccctctcattacctttctgaaactttttcttaagtccagatgatgacggtaatgacgtgtggattccctgaaaagagggaggggtacatgatgatgatgatgatgatgggcaataggaatacgagttgctatctcacaagcgaactcgtcgccgcgagcaacggccgatcgagcagggcaaggcatgcggagggagtggaggagaggacccttggcaagctcgatcgggcgcttcttccgctccaaaatccacgaggttcaggccgtccggcaacagggatggctcctccgttcgttattcccctcctgcaagggccgcatctaattgatctgaccaacttgcaaggatagtcattagtcattgattactcgttaggtgctcaggtatctgtatatatttcggcttcgttgcaaagagacagctgacagccgtcggcccaagagcccacactttgagtggcgatataaagcaaatatttcagggtgggaattgtcctgattcatgtgagattgcatttcgttttgtttatgtgaaaaacctgaaatatacttgtgaatagtactttaaatctaatagattgtgcccccctttttttaatatgcagattttacctaggtttccgttagtatatatgtttttcaaactgctaaacggtacacttttacaaaatctttttatatagaagttgatttaaaatataaaatattttttaaagtttgtaacaattaaaacttaattaattatacgctaatgtcttctcgttttatatgcgctaactttgacatctatctcagtagtccaatatttatgttgagaaatttcttacatcctcccgaattttcgctcgatccttccattccatgcctatgaactttagcttatcccctacatatttttcattttgattccctgttgtgataattatatatcaaaacctttgtttttatgaaatttaatctttgaaaaatatataatgggaataggtggggtgaaagatttactgtcaccactatcttttttcaaaatagtatagatattaggttagaatatgcaatgctgatctaacctattaagacgaatttctgttctataatctcaggggagggtgactggattagcaaccctgaaacactagccacctttgatgctctgtgcctctggctaaaggggggcagagactaggttgaccctttttactcattagtaacatgtattaatgttatagggtatgtttggttctctactttgctaaatctttggtgccaaaatttagtaagttttaactctaccaatttttttggtagggtaaagttatgatacatatatttggattgttaccaatgtgaagccaaaatttgatgatatagtgaagaaagttttagaataatgctaaactgttcaaaggcattgccaacaatttggttttgatacaaaacattcactagtactatccaaactaccaatgaattggtccgacacatttggcatcaatccgaaataacccatattgcttattacggagtagtgaacctccttattttaatgcgtgattttttagatatgtttgataattagtcttatttttttaaaaaaaatgcaatagttgttatatattaaaaacggagatagtactggtcaatctttagctttagctgcgcattgcaaaatcctaacaaacaagcacgagcagaacggcaggacgacgtaccactccaaccttatctctactttatactgttataaaattgaaaatgtttttaccagtactttggtacatcgtccgtgcatgagtcagtttttaagtttgttcgcttttggaaatacaaatatgtatttgagtcggtttttaagttcgttcgcttttgaaaatacagaaggaatcatataagaaatatttttaaaaaactcacatgctaacatgagacaactggactcctaattgtagctcataattttctaaaaaatatatatatccaaacaagttctcatagtagattttatcttaactaaaacgtataataacaataataaaattaaaataacattcttccgtagcaatgcatgggtattttttttatattagtaaaggatgatggcagtgaaagtacttaaacacattcacgtgttggccatcaacgagaaaaaaaaagcaccccaaaccacaaacataaccactgtagcacgtagtggcgaccggccgaccagccggtagcggagataacgtcaaaccgcgcgctccgtgtcatcgctcaccgaaacctaaacacccacgccctctcttatccaaatcaatcgcactcaccaagcccgcaccaccacgtacacgagacatcgctagcattgcactccccgtgcgccgcgcccgcgcacgtatcgctcctgcagcgatcgaaatcccccccgtgaatccgtgatccgcagccaccacgcgcgcggcgcccggcgcccggcaacggcaagcaggtcagcagcaggggccgcgcgcgcggccgggcgctgcgatcctgtcgggtcgttttcgcggccaaaagcggcgcactccaccgtcgctttggcacgtaccggcgcgccggttggccggggctcggcggccccacgccataaactacgaggcatctggagatatgatgcatatggccaagatctcgtgctgacaacatatatacgtgctcgatcgtaccacgggggggatctcgctctctctgccctttgacatttgcacaaagtcagtgagatgaaaaggggaggacaatggacacgggagggaataatagccggcgcctgatggctctagcagtcaaggtgcaggcaataataggggcggtagtattaaaaaaaaagggccaagtgtaaaagtttaattccccccacactcgcgtcttttatggcgcgagaggcgagagagagctcgaagattccagcccttttggttctcctctctctctctctctcccttttgacatttggacaagtcaaagaaaacaatacgggagcctatcgccctagcctagcaagcaaaagaggcgaggcgacgacgatcgatggggtccctcttgacaagtgtacatagcaacaactgatagaagaatccctttccaaacaccagcaagctgctgtcccatttggcgactagtttatcaccaattacgacttgtttatcgccaattatcggcatatctcttttttcctaatcgcttgctcccgccgtgcccaccactagtagcgtggcgtttgactctactcccgctagtcgctagctaagccagtggtactagtagctagctagtgacacttcagaatcctctcggaatacgcgtctatgtacagggatacgcgtgtatatatggcgcggcccggccaaaagtcaaccccccgcctccggcgcgagctcgcagcagcacgcgtccttttagctgctagctcacctcgtcaaactctcgcctctccccccacaacgcgagagcttgccgacgtcggcgttcatgcgcggcccgctgctgctgcgcgccgtcgtcgtcgtcgccatggagcacttcaacgactgggacctgcaggccgtcgtgcggagctgcagcttcccgcaatcggagcctcctcgcgtcggcgtcggcgtccccgcggcgccgggagcgggcggggctccggtggtggtggcgccgcccgcgcgcgcaccggatggtccggatcagatggcgcgggcgtcggcgtcggcgctgtacgacctcgagtacctggatttggatcataagccgttcttgctgcccgggtcgtcgtcttcgtcgtcgtcgtcccgagcggtggcgcgggcgcgaggggaggatgacggcaaaggcagacacgaggtgatgatctctttccccgcggcggcggcggcctccacgtccggtgcgcagccgcggtcgccgtccggtcggaagccgggcatacgcaccccgcggcctaagagaaggtagtacacactactagtttgcaaccgttttacgtaccagcgcattggcagcctgatcgctccaagaaaattctcagcttatttcgaagtgatcgattattgtgatttccatggtgtgaggagcagcaagaagagccagctgaagaaggtggtgtacgaggtgccggtggcggacggcggcgtctcctccgacctgtgggcgtggcgcaagtacggccaaaagcccatcaagggctcgccttatccacggtaactaattattaccaacactttctttgaccctgccgtcccctttccacgcgtcactactcactagctactcctgcatatcaccataatcatagcgttgggaaacctaaaattgaaggaaatgagcacataaatttgatatttttattacataatggcatataaataacctgctgcacattgagatcttgagattatggccacaacaatcgaatgcaatgccttgcgtttccaattggacatcatggctttggtcacgctccacgtgacatgtacttccggtgtagtacaaggcaattccctgtacttagcagtacaatcggctgtaagcatgtatactttgcagttgacctaatgacctgtgcgctcggctcaactaacttggcgatacgatggttcgttgggtggttgtgatggatacaggggatactacaagtgcagcagcatgaaggggtgcatggccaggaagatggtggagcgcagcccggccaagcccgggatgctcgtcgtcacctacatggccgagcactgccaccccgtgccgacccagctcaacgcgctcgccggcaccacccgccacaagtccgcccctaccggcgacgacgacaagccgacgtcgccgggccctgcagccggcagagcggccgccggcgagggagtggtcaagtgcgaggacgtcgacggcaacgagctgtcggcgatggccgcggatggcggcgcagaggacacggcggcggcggcggatgacgacggtgagttgtggccggaggggatggggctggagctggacgagttcttgggtcccatggatgacgacgtgttcgagttcgaccatgtcttggaggacgacggcgtgctggggcgacggctctcgctatagctgcaagagaaaagctgtactagctagctttgacgagccttttaggacagttgactgtcagctccaacctcttcaggagatccaagccatgtataggcggtttttattcgtgcgtgtttgtggcatgatctctctcaagtcaaggttccaagtttcaagtttgcacaagtgtatatacttgtaatattcgcagggatgtcagtgcgcattgacacttttgcattcctgtacataattctcgtggttggtgactttgtcccaacacgtggaccgggctcaaagggaagtgacagcttcagtgcagtttgcctgcttgccagattgctattgtaacatccaagggacagtgcagataagagcatccccagcggctcctctatccagacatcgatactgtgtttggtgtatggaggtgaaaaattgcactccagcagaatctccatcacacacgccatttttataggtcctccaaaccggggagtggattttaatccctcaaggggatatcccctcgtatacctttttctttcaaattcgatgcaaatagttgtgaaaaattctgaaaaaaattgacaatgtagagtataatgatacctactagtccaccaaaatttatgttcaaattcgatctacacatcgagaaacaaaaaagacaaatttagatataaacagtgcactactattcatacgctgaatttgtcttttttatatctcgacgtgtgagttgagtttggacttaagattttgtgaagttgtatatatgtgttgtatgaatattgtcaaatttttccagaatttttcataaccgtttagatggtttttgagcaaacgaggaaacatcccctcgagggattagaatagtttccctccaaaccgagcctttcacaagccaaaaatggcggttctctctcctcatgccatcctcaactgccgacctcgcgccactatatggactgcataccgtgggagagaggagctgcataccggatttggaggtggagatcgccggagtagaggtggagaggcagcggatctggcagtgaggtcgccgccgtccccgccgctcggggtctctgccgctcctctgaccccgccgcccctctgccccgccgctcctccgccgccccttcgcagagactgggtggtggtggtggcggcgggccatcggcgggaggaggagggagatggacccaccgggaggaggagggagatggacccgccggccgtcccttgcgccgctcctccgccccttcgccccttgcgccacccgcatcgctcctccgaccgcgccgcccctttgcccagccgctcctccgactgcgccgcccctccggttggccctcatcctccccgtcctctcggcgctggtggtagagaagaaagaaaggtggggagatcggcggtagagaagacatacagatggggagtttttttttagagtagtgataagtatgtggtagttgtaaaatattagtaaaatataggatgttggtatatagaggatgtaatatagatgatctgttagagtgaaaagtaatatggagtaggtatcttttttatgactatctaaatgggagtatggaggataaaatttagatgagctgctggggatgctctaagcttcctcctaccgaacattatatttgaagttttgaatggcacaacaccgcaatatccactagtaatatatgttactataaaagaaggattcgattaaaaaaatacagaaacttcttgatctcttatttctgaacaaaatcaaatgaattcaatgtatctttgcactctaaacatcggaacaaatgtttgcaaagcaaaagacgtataaattgcacaccttacaagtctgcaagaattgcagtaaagaatatatactccaaaattatcaagtggattcattactcgtcaccatttctcatgaagcatttactatctctgttctaaaatataaaagattttgtccatgcacttacatagatatgacatatctattatatttttagaacgaagatagtagacattaagctattatcttctttgtgcttcgctagttgccatctactgatccacgtctacaaatatccgatgatatcaacaaatacattaaacgagcacatcttttttgaatcagttgcatacatacaaggggaatgcacgggtctccaaccaccagtgctgcaggatcggagagagaacaggggagagggaaatatggctagcggagcatagattattaaaggggaacaatcgaggaaagagtactgaagaacctgcatgctgtacgtaagatacattaggtgcttgtttctaattttttcttcaaacttttaactttttcatcacattaaaactttcctacacacataaatttctaacttttttcttcaaacttccaattttagcgtgaaactaaaccaattttggcgtgaaactaaacacagcctagcctgcggaattgattatttttcgatggaaactgagcaattatttttcgatcgaaactcaaacaattattctaacactcattggttgcatatatttgtgttaagttattttatttttgttgtatgcatatgtacgttttttaatctaagtctttgtctatgttacaataagatgagtttttttttatattggacataaaaaaaatactctagactttcagatgggagagtaaacagatagtcaacaaactaactgtgagcattgtagaggctacaattaagacgaacatcgcatttcagggatgataggagatacagcactactttgcaatattagtaaaacgacagagcattctgcacttcggagcaaagattcagataacgtattcttgtgtccagatgtatcttccaaaactaggataaagtcttagacaagctagcctgtcacacagagagcttacaatatggaaacgcaacgaagagcatcacacaaaatccaacttgacaatgatgcgcgaaatctccagccaagtgatgactcacgacgataacgaatttacagcatgcacgaaccgagatcttagtactcccatttcttaagctccatcccatcaggtgggcttccctctaccttcttcgagccaacatctttccaattggtcgacagaacagtaccgttagattcaacctgcaaacaagcacatcgttgatgtataagtatacaaagttcaaacttactaaacgcacttctgtcagcaaggtcactagttataaacatttcatcaattgtgctaaagaaagacatacaaaagatttcatcattgctcgtcgcatgtcttcatcagcatcactgtagatgtcacggaaaaatttgttcaatgcagcatcgccttcaagcttctcctccttctcctgttggaaattcaaagtcatggcaattcaataattaccagagttcaaggaatgtccacaggcagtgaaacgttgaaccatgtgcatcatactaacctcctttttaacttcagcttccagtttatcccagtctttcttggattttgaggaaggatatgatggcctctgggccgattcagctgataaaagaagggctatcagtaaaactgtaggagagatggggaaagaataacaattgaaccccaaaaaaaagccagacttgatcttggttgtattccagtcatgtacagttcatgcttaagccgatctggcagtaaaccatcagcctcaacaaggtattagcaagataacactcagaaccctcttccattttcatttaaattcgattaccaattttttgtgacattaatgtgttcaacaagcacaggaaccagcaaaatggaaatgactagcctgacatgtgagccagcga

SEQ ID NO: 44412 - DNA, 7407 bp, Oryza sativa
  unsure (1)..(7407): unsure at all n locations
aggtgcatttccagaaaatgtcagtaccaaatcattggggttaaaatccagccctaagaagcacttggtttagtgtctgagaaagggtgtgggacattatcccatatattcatgtggattctgtcaagtggtttccaaaatataaagtggacccctcaattcagaataacttgatacttgactaaagaactgtattgggaaaagaagcacagtgttaaaggattcatgaactggttacctgtattttggcttcacttctaccattggtggtgtattatccatgtttgcagcatcatccttttcctcaacaaaagaagcaacagagggggcagctgctccatcttcagccttcttaacagggacttcactaagctcctctgaaaagaaaatgcacagcatcaaagtatgagaaagatgtctcgtgcatacatttcacttcaacttacaggactgctgtggatattcatcccagaggacaaatatgtgtgaaaatgcatactataatatggtagtctcacgtaatggtatgccccaggtaaaaatataacacaatactgcaaatgtattaaccaagcaatggactcaaagggacagcttaccagcaatgcgctcatcacactccttcattaggcgagtaaaccttgagtcaccagatgcgaacgagtaacccaattcaagagctgcttttgcagtttgatactcctccagtcgtatacatgcagcgctaaagatcatttgcttatcagccatcataataaattaatgtgcctagtcttttttcataacattaaataatttagtcaagactgaccctttacgaagataagccttgtgcattgatgggtcaagttcaatggccttgttagcatcagctacagcctctgcaagacaaagtgcaatttgttgctttaatatgaaacagcatgataatgtctttgcaaacaaaacaaaataaacatgcagctaagtcattttagcaccagcacccttatactgaggtattttaagatatagcagtgctgataatttagggctacaggctacaaaacaacttacagctattactgataaggatgattaatgccttgtttggcaataaaattttgcaacatttcggacagaattgtcaaagatatgtgcaacctgacaaatttttacaaagatcagaaccaaggggaatgatcaaacactagtccaacctgacttttttttacaaagatcagaaccaaggggttttctgctggcaagcagcaagttgtcgccagatatcattttagcaccagcactcttatactaattcaatactatgataacagacagaaaacagtaatcagcaaacatgcaggagtatagcatttccttgagttggcaaatttagctgggaattctcagtaagtaatagctgaacaataacaacaggtagacccatcaaaatctgccacggctaactattgctctaaaataagagtagacctactctcctacatagctagctaaacagtcaagcacacatatctttataaatttcttgttttatcttactttgtaaatcaaaaggaacaggcaagatcagcacactaaggagttaaatttgattgtttcatcaaattttaaatatctgtttttgtttgctatatgcaatcattaggcatgatatgcggtgcagatgaaatttggatatatagaacaagggaaattttaaacaatcattaacatgcatcatcttggatcattagttgtcaattttttctacagcgcacaccagctttgtcatatactccctccggttctatattaattgacattttgaacaagattgatgtcaaacttttataactttgaccatcaataactttaaaaatatttagtttaaaggaactagaacaacatatatagatttgtcttttaaagcactataataaaagtaaacatgcatttatttattatatatattataatagaaaaataagatcaaatatatatcttgtagaccgtgtcattgtccaaaacatcaattaaaatgaaaccagagggagtacaataactagaaataaacaagcaactaagtatggttcacttaatgaagtctgacttccatacaaaatggttagtgggttcaatcaagtatactttaacagttgaacaatactttctcatcctttgatttttaactactccaaatatctctcacgcttccaaactcaatttaccccctaccaattcactactgcgcaccatcatcattcatgcttgacgtaaatcatttaaaagccctctgaattgtgcctaggattctggtcagaagtgtcaagtgtttagaaaatggagtatagcaagtcaactctcacctatcgaacagatttccccagtccaataacccccgacctagaccaaatccaaatcacacagtacggcacgcgaacggaatggttcgaattcgaaacatggtatttgtggcgtcctcatatcccccacaaacaactatgctgcttctttcgactaggatggtacctgccacaatgcagctatgccctccttgcgctcaatatctcctcctatcagcaagtcaactgtcactaataaaacttattttggcccatcccatgaccttcaccctagatccttctccaaatcacgaagcgcgatcacacacacgcacacgaattgcttgaacacgcaaaacaaacaccggtttgacgtaactcccgcaaataggcgcaacaaaccacgaatcaaaaacgcacaaaaccacacaccccacgcctcacgatctcatctacatccacacagactccccagaccaccaccaccaccaccgcacacacggcaaaccaatctaatcgaaggaaggggaggaagggggagattgcgagagatggattaccagtgtagttgcctagcttgatatgggcctgggcgcggtcggcgtagagctcggcggtggcggggctggcctcgattgcctgcgtgtagagctcggcggcgagctcgaagtcgtcgtcgacgaaggccgccttggccttgctctccagatccgacgcggcggcggttgccatggcggcttggcttttgcggctgcggtgaggaggccgggggatgcgggtgggggaagaccagacgaagacttcgcggaggggtagaataagatcacggtgaaaggcctttttaagggcccgtgtggcgagtttctagagagttcgatgcgggagaggccgggccgacgcttggaatttcatttttcttctctctctttttttctttgcctttttttttctctttatctttttttttctttcgtgtgggtcaagtcgtctctctggtggtttgttttttgttatccggaagccaggaagtttccggaatcatttgggtttcattgatgtttaagcgttgcaagttgtgtgtttagtgcacttattcggattgtgattaggaagcgactactagctggcagaccatcctcccttgtcatcatggtctcatactctcatgtggcgttgagaatttgagatcaatatccaaagttctaagcgggttttcctggtggctggtgatcaagtcggtgatatggataattcccgtctcccgatcacagccacaagccatgccaaaattcagcgtgtcgatcggagtgtctgaattcgtagaagttaccacgattgtggaactcaatttcagaggacttgtatcaaaaagtagcacacttttcggtaggagccactagtgagtactactccctccgtcccaaaatataagaatctagaactggatgtaaaatttacatgtccagattagtagtactagaaaatatcacatccagtcctatgttcttatattttaaaacggagggagtatctatttgcatagagcaaacttttttttaaagattaaggtggcaggagctctgccgactatattagaagaagtaaaacaaaaaacaaacaaacaggtccgagagtatatattacataaacattacaaaacagaaattaataactttaggccatgtttacttcccacctggaacgtttgaacacatacataaagtagctaaaaaattaactaattgcacagattgtgactaatttgcgagacgaatcttttaagcctaattgctccatgatttgacaatgtggtgctacagtaaatataattaaaggaatagaaaaaggagcatccacgttcgctctcatggcctacaaattctcacattaatcggagaaaaaaaaacagagtccatatagaaatacaatttagaaatagctgaaattcggaattaaaaaataaagaatattaaaagaggagactagagtccatatagaaatacactttagaaatagttgaaatttggaattaaaaaataagaaatattataataggagtatagagttcatatagaaatacaattaggaaataatagaaattcggaattaaaaataaggaatattagaagaggggtatagagtccatatagaaatacaattaggaaataatagaaattctgaattaaaaataaggaatattagaagtagagtatagagtccatatagaaatacaattaggaaataaccaaaattcggaattaaaaataagaaatattagaagtagagtatagagtccatatagaaatacaattaagaaaaaaatagaaatttggaattaaaaaataaggaatattagaagtagagtatagagttcatattggaatttaaaaccaactaaaattcagaataaaaaggagcctccacgttcgctctcatggcctagaaattctcacattaatcagagaaaaataaaaagcagagtccatatagaaatacaatttagaaattgctgaaattcagaattaaaaaataaggaatattagaagaggagactagagtagttattacacattagtagttttgaaaagttattgcaaaatttaaaattatgttgtcattgtaatatattttataataatataatgagaaaacatatatgcttttatatgagaaaatataatgatgctagccgcgcaatctacgcgggccaccatgctagttttgctaatgatgaattaattaggcttaataaattcgtctgcggcttactgatggattctgtaattagtttttttattagtgtccgaacaccctatgcgacactctatataatatctgatatgacacaccaaaactttacaactctaaagctatacaaccccttagacacagagtaaaagaggctagtagctgactggaagcgtaaacgcaagtacgctttgttctaggtcttctatgattaagtttattgtcagcttccttgaattctccctgaaaaattctactatttcgttgcaactagatatgccaccaggttgtgagtagtgcccccgtcctctggcgggattgtgcctttgtggcgctgtttgttatttgaatcacccaatctataatattttgggcttgtgcagccacggacagtggtggatctagaaagaaataacaatggagtatgagtaaactagatagcaatagagtctcaataaactagatagagttactagatagagttacagttccccctttcatctacatatggtaaaaattttagtagggttttttttggagactcttatagttttcacgccaatagtgagggttcgagacccgccatcccatgctagatccgcccctggccagaggattccttctttttagtgagtgtattccagacttgtcttgtgtatgcgcagtcacggtacaggtggtctacatcctcaaaagcttctctgcaaagggagaaaatccaatcacaggccaatgcctaattaacaagttttcttctattagggtcttttggtgcaggatcagccagcccatgaagcgttgctttagctgtgccggcgtttcccaaaccgtggtcacgaactgtgtttgtatttgcataaaacaaacttaaaatatatataccacttcacaaaaatgttgagtctaaacttcactcacatatcaatattattttctaaaagaagtctagcattacgcatttactgtaatatttatgctcagatttatcttttcttttcttaatatgtaggtcaaatttaaacttaatttttgtgaattaaataagtcattacactgcacatcattaattttttatacaaccatttgcacttgaatttgcattaattcatttttggagtttgaaataaccaacactcaattaatcatgtgtttatctcgttttacgtatcttatcattttttttcttttcatgttctatcaaacaaaccctttagaacagatacaataacagactataagacagctataaacacatattgaggagataaaagaagagagagataagcagcaggctataaatctgtagccaactgcaatacggactataagacacaatgtgtgtatgacaggtgggaccagataatatgtgtatgacaggtgggaccagatattaataatgtactatatatttataggtaactattgcatgaattaactattaaattggttgtagataatttggagctagtggttgactagtatacaattaaacttgctcttagtgagcgaaggttgtgttatctagtctaagttcataactcatctcttattttctgtatacacgttttctaaattggtaacaatttataagatagtccgatggatgatgggtctattcgctgcaacttttcggcagctgcagccgttacagtgactatattgtttatacacattggtactgttgatgtagttgcaactgctgcagcagcaagctgcaccgaacagagccgataagtccaatggatgagaagtccgatgggtatgcaatctatcgaatgattgttcctgtgaacttttatggggatgttttgcaaactagtataatgggtataatgggtttatagatgttattgttccttccaatgcctaagattagacaaatcgtcacaaccacaatttgtgagcagataagaaacacggttgcatgggctgatgggcagcatcaccagagcctgccaagaaaatacagggccggagtacacatatcgaagattggcaccaactagctagtataatctgagcaatcctaacgccaattaaatggagcaaacagcaaacaactgacaatgctgcaacaagattttcaccgtacgtacattccttattacacgcaagttaaattaacaaaccacttgggctatgccccgatgaatcagaaaggttttcagaagaggaggtcccggaaggtggggagcttcatctcaccctcggtggcgagcgggatggtgaanctgccgacnacggggaggtcgatggtgatcccgacctccagcacgtagtcgatgtcccagtccccgctcacgtccttgatcagcgacacgatgaagtcgtacgg

SEQ ID NO: 44413 - DNA, 12466 bp, Oryza sativa
gaacacgaactaactggatgcgccggctaacaattatgtaaataatgcacgcacttgtcgccgctcgtgaaggtgtaggtgagctcgcagatggggatgcggtgcgagtaggggttgttgacgtcgaggtggctgtggagcgtgatgcactcgcggctgacgcccttgaaggagacgcggtccagcgtcgcgtcgggcttggggattttcgcgatcttctccgccacgaaccccttggccctgtccaccagcccgcccaccccgcctcgctcccgccgctcctcctctccaccttccccatcgtcccgctcctgccgatctcctctctcctccgccgcgctcatcctctcgctcgcgcgcgcgcacgtcgtgacggatcggtacacgtctctgttgctcgtcgcggctgctgcgctctcgcgtacgcgcggcgtgttctgcctgcgttaccattccggccgtgtgcatgcgcacgggtcgcgggctcgcggctaggcgcgacacgcggggagtgtgtctgtgtgtgtggatcgatgcacgcatgcgcgcgcgcgcactggtgcacggccaccacggaaacgtttggtccgcgaagcgtgcactgcgcgcggcctgtacggcagatcgggcaatgattgtttacgctgtcttgcgcgaaacctgggaataaagcggcgcagggagctggaatctttggacgtgagatccaaggcaagctcgcgtgagggagggaccactgttcgtgttgggtgattgggtcggccgctttgtaagatcgaaacaaatctgcaaaccagggcccgggggattgtgggcttgtgatattattgtgtacatgggtgggtacaaacgaaaacaaaaatataaatgagaaaaaaaatgaaattgaaaatgattttgcttcaaactaaccatatccgacttttattcttatggtaattaccatatttcatattatgataattatcgtatttctaaatatgcatttatgatctattttcttatttgacatagtttagaggtctatcaacttcacaaccaaatccttaactcgagtacaagattaaaagaagataatttataatttacatagcataaccttgaatttattttaacatattatatagttatgcaaagttaaatgtgtgattttatagttcaatatttccaatatttgttatggcttcctattgatactgatatgtttctgttcgtatagttcatttctggttttttaattgtttttgtttccgcttttaccattttttattcagtttttgggaaaaaaacatggctatggaaataatcgagatattttccaaccgttttcatccctaattgtgcagcagcaaactaggtgatcaaatctgcaagggagaaatggattcacatgaattgaagagtgtacttcctttaataagaaaaagaaaagcaaacatgcatctgatgtccacattgttttggtgttggcgcatctcattgtttactgtttaaagtgattatagctggtcattttctgaagagaatagtgatctctgaattctgggccgaactgtcatatgttgcatattatggccgagaacatgatgagtttgaactacagaaacagagcataaggatcacatcttttgcctataacgtatatgccaatgttaaaatttaaattttaaaacttactagttgattttgagatattttattatatttcatttttcagcattgatgtttaagttatttgtaaaagttttaattataaattattttttcgctaatacactctttggtgtattatccgtaattggccaatcgatggcataggatgaagaaaatcttctagcgttgcgctgctccgggcccaatacagaatggggctcaaaatggatcgcgttatcagcctccatatacttaaaatgggccttctgcaaatgggcgtctgactttctgacttgtaaactcatagatcgttttttgttccattttctcatgtagtagaacccgttcatgattacaggctttcagcgttgatcaacaaaacgttcttgccctcttgataaatgataatcgaccgacttgccgcatttgcggattgagggctgctatataccgaaatcccactccaaaatgggatgaggtatcgggtgatacttatcaggtatcatgtgatacttgcgaggtatcatatggtacctatcaggtataatacgattcttaccacatagaaggagataattgcgaggtatcatgtcctataacctaaccggtatagggtgatacttataaggtatcatgcgattctaccacgtatcagatgatacttgcgaggtatcagatgatcctcgtcgtctccactgcaccgcatgcccattccttcccccggcggcgctccaccaccaccaatgcatcggcgccccagcagcaggaggaaggatcccttggagtacaaggagtacatcgtcctcctgaggccgtggccggacgctgccaccaccggcatggacgatgacggcgcgtagtggagctagtacatgcccttcctccccggcaacagcactgctggcggcaagccgcaactggtccgctcgtacaagcacatcgttgacggcttcaccgcaatcgctgtgtccaagaagcccgacttccgacgctgcttccaggacggcatcgcttgcttgcattgctggtttaaacaggaaggaggatggcaaccttgcctgatccggccatggtgacgacacgctatgcgcgcggcgagagcactcgaggcagagctgctgcggatgcaccagggcagaggcaacggcgacgcgccgcctgcgcggcggagttcggtgaggtgggaggacgcgagggacgacgacgccgccattctctctccaatccaatcccttcgtctcgcgctgcagggtggacgacacggtggacaaaagtggatcctatcccgtcccgacgggatcccgctgtttagcatttatgttgcggatttatcggcagcatcaagtattagccattttggactcggttcgtgtaatatgttttcaataggttgtttggaacaaagaaatgtcgaccaaaaattcgttgaaagctctcgtactatttatctatttaaaagagattggaaattttagaggataatgacaaggagggcctatacagccattcgctcgcccgcgtagcctcccgcacaggtgacccgggtggaaaccctagccgccgccgctgccgcccccctcccccaacccatcccttgcctcaccgccgcttgagcgagtggctggcaaagccgacggcctgcaaggacagcggtagcagggctcgcggctgcgaccaccatagttccagcgcgggcaagtccatggtggaagctggccgaaaagacgacagcgtcgaggcggggtgccggcgctagcggggcacctggatctggcaccccccacgtcggatccagccgtggcgatggcgacagaggaccagtggcgctggcggcgaccgtggctgcggcggctgtctggcgtcgtggccgtcagatctgggccacgacgttgactgcggcggtaagctgcgggtggtggcatcagcggggaggcgtgggagattgcggtaggcggcggcaggagcgacggcggcgcacgaaggagcaggcgcctggccggcagcaggcgcgacgaatgtgctggccggtggggctggcggccaacacggtgaaggagactcggccggcgccggctaggcgaaggaggtgtggccggtagcggtgcagcgcgaggaggagtggccggtggccgcggagtgaggaggtgcggccatggcacgccgaggacggccagtgcgcgagggcctccgcagcgggaggtgaggctggtggaggtggagccagtgaggtggtagcacatggagattggccggcggggggcaccggtgcaatggtgcccacgtgccaacggaggcttagatgacgatggagcaatggtacacctgtggtagatcggtaggtgatggatggcgtgtgaaaacctagcctggtcttgaccgggctggcaatgatgatgttcgagcgtcattcccctcctgggagcgttgttgtgttgtctcatccctcaagtgtggttgcctggcgaaagcccagtctcggctctctttgagaccttgacggacggcggtggcggtgtttttcgtcacttctctccttggcgacgtcgtttaggcacctccttgccgaaacccccaaccaattggtgcaaccttgctctaaatttcatgctcttgtagtgacatcctagtttctataagttggccacgtcggagggccttagggggagaggagttccattcttctctctcaccctctctccctaactcctgaagacttggatagagtggggctttgtgttggttgtaatggtttaggttttgggcgatctcggctgtgttccgttgttggcctagcggcggtcgttcacgcttagcagcggctggtccggtgctagccttctcctgtatctgtgagttggcactgtcagtgtatgggtagtggtatacctttttccttttcctggttacgacctttcaagtttgtaatcttgtaattttttttcttgttctatccatagaatttcgcaccatatcgtgcgagtcgttaaaaaaaagggagaggggggagcatacatgtttggaaagataacagcaggggggtttccagaagggattaaatattaaacatctactaatgcagtcgcttccatcattgtagaagaataaaacggtgggacataacacgacgcgaaaacaaactccaaccctatccaccattgtccccatggacccccatactgtttcttgctgctaatagcagctaacttcgtaactggatagggacgctaactccccgccgattcctgtaatgtaaaatataatcttgtttatactagtactgttttttagggggacatactcaacaaataccatattcacggtaccaatcaggcacactcactcatgtactgatgcacatgcatctagtacacatgttcgaaaattacgagacaccaaatcctatgtgagcgccgcaaggatgcatgcatacccagacatacgcaattatgcatgttcatctctctcagaaacagtgaacatgaataatttctctgtttcacgttataaaacgtctggggtttttaatatattcatgtatgaatgtatgtatgagtttgaatttatatgcatatcagcgaatttagacgagcatcttatagtgtggatcggagggagtactagatatccatgtttgatgtttctaaaaaagaaaaagaaagaacataaccatgtttgatgtaaaataacatcacctgaccatttggatactatttttttgaaaaaaaaatgatcatgttcctactcctacctctatgaatgaaaggaacaaacccactgcttattttttttctaggagaacacggagacagagagcgtctcaacctccggactccagagaggtttcttgtgcttgcagggccacgttgaggatttgccattggccctgttttgatccaagggttagagttagtttctagctctcaactaactctgaactaactctagccctagaggtgtttggatggaagggttagattgacaataaatatacttttccaatcatttggctcctttccaaccggatttggtgtggcagactcatgtgtagcctcctccctctcacaaatgacacaaacaaatcatatttcaacccctccgccgccggcgcctatgagttgaggtcgaagccgacgccggcagaggaagcggtggcagggccactcgccgacggctgcgaagcccacgcgctgaggtcgtcgaagccgtcttcgtccatgcgtggccggcggcgcagatcggtggaggcggcgacgcggatggtcggaggcagcgcggctcggggttggcggcggcgcggttggagggagggcgcggcgcgggtagtgggggaggccacgccgcgaggatcggcggcggaggcgcggatcggggacggcggcgcggatctgtggcggcggcggcgtggatcggggaggcggcggcgtccagcgagaggatcctgtgcgggatcgggaagagatggggatccggtgcaagcagagagagagaaaagtggcttctacggtgggccccactcaaactagctccaataagcacctcttgaaggggctagtttttttgtgggttagatgcaactagccccaatctaactcctcatgtttggatcctttaaggctatttgagcctcaactagctcaaactaactctaacccttggatttaaacagggccattgtcttcattgtaagttggaataggtggtgtgtggagtgtggactgaggagtgaggactacgagatgtgtacgctgcagtgcacgcaatatattgcgagggtatatggcggcttcgtgtggaagtgtgtgatcacactgatgggctgatggcgatcgcgaacgaaaataatccaagatctggatcggccaaaaaccttcatcacatgttgcttgctctggatgattggtacgcctgctgccaagacgcgaaagggcaactggtgctagaaaattcaacgatattaagggacccttaacttaagtactcttatccggcatgtttgcaaatcggttactccctccgtccaaaaatataaatatttttagactccgacacaatctttgagatactactttgaccaatattattaaaaatataaatgttttaaataaaaatagttacatattatgattttgattaacgataaatctagtaacaccaattttacatgattgatcttttttttactattaatagttaaaattaaaaatagttgacttgacactatacttaaaaaagcttatattttaggacaggatatatataagttaatataatatatagttgcaaatcgaccgcggtgctgacggaagggtgcgtcaagtgacaatgcagctctcgctttcgttgtacttcctccctaatgcacagtataagagtttcatcggttgtctatattctctaataaatcaaaacgacttattagataaaaaataattcatagataaaaattttatgtgttacataatgatttaaaagccaacgctaaaaaaataggttaaaagaatcttaaaaccaatcttaaaatcatcattaggcaatccagttagtcacgacgacatgatgccagaatcagtccgctcccgcttcactctacacgttgctgcacacgtcgccgaaccccctccagtttgtccgaaataaaagggcctacccacaggccaccgcatcgaacagcaatctaagagcagttcaatactatagtcaatccatacaatatttacctataaacatatactacacatatctgatccaacatgtcatatacatacgtcttagagttcgtgttgtagctagctacaaatctatagctcactcctcttctctctattcttttatctccttaaaatatgtttatagttggcttatcctagtctgttccaaaaaaaagccaaactctagctatgaacctggacacatgtgtgtccagatttgtagctaggattgaaacttttttgggacggaggggtagtttactattgtacctgttctaaagatatcgtcattgccatctaaaactatagtacacatcattaaagctgctctccctcttcagagatgggcatcattaacaacacccacattagagatggcaatggccccgaaacccgacaggtaattactccattaggtcatttccaatccaataattaggatggtgtctatagcattaaataaactaccacataagatgaaagatgatgtggcaaataaataaatgaggaaagagaagaaaaccaggtgttgtatgagacatagtttctacacaacacccactagtaaaaaaacacccataggtgtcggccacaaaggtgccggttagccaaaaaccgacacctataagtcatttcccgccaatttagcaaaaaaccggcacctataacgattaataggtgtcggttttgttgggaagatcactggtgccggcactaaaaatactcccgccaacggtctgaaaatctcataggtggcggtcatggacaaaaccggtatctatacgaaaggtggtggttatttaaccaaactgacaccttcatataggccggcgagggaaatatgtgccgtttttttatccgaaccggcacctatatattctcactattataggcacctataatagtataaccgacaactatattattataggcgccggttatagaaccggcaccaatgactttgataataggtgccgaccaaaaggtgttgggcttgaaactggcacctatagggctttaaaaactggcactaatgactgttctgtttttgtagtagtgatccaagacatcatgtgagataagtagcattaaatttaggtatggaaatgtgatgtttgtattggaagagtagtgtctagtactagtttcttgatgacgtggagtttataaaaactatttctagtgtcgactggtcttagtttttatccacgtgggtctcttaacgggcaaaagtgtcacccgtcgggtggagcgggtgcgggtccattatcttgcccctgtacctgttaacccttggggctgatatgcactgcttgtttaatatgtggcccaccagaatttttcacatgcatttacttgcccaaggcccatgcggagaagagcttttcagcaaaaatcaacgaaccctactctcgttcctctctcttctcgctgactcgctgtagttcacacgcggacacgccgccgccgccgcctctgcaccacgccgcctgcccaccgcgaccccgttttgtccgccctccgtgctacaccgccgcctcgatgctggccaatagatcgacgaccggcggccccaggcgcactgcgtgctcgaccacaccgcttcctcccgttctgcgctgctcctcttttgttgttggcttgctgttgtggttgctgcagtcgggtgggtgtgtagtagactctgcgggcctggacgggggaaatctacacttttactgctacacccgtatgcggggatggggatggtgacgttcgattttttctgctgcggggatgggtacggggtggtcacacccgacgggtgcagcccgttaccatcccgcagcacgaactggttgacagacagcccacgccggcgcgcgcccgcatcaggagccgagccctccactttccccgccgctcgggccgctttctccattgccaagccgtaccttcgacgcttcgccttgtcagtcactgtccccttcgtggtcgtcttcgccacttctccccccgtctccacttgccccatatctgcggcagcctccctcctcctcgcggagatttgacccctgcgggctcgccttaaaatagaggcgcatcccattcccaagtggctgcttcctgcaaccacgaggtccgccgctctcgggagctccagcgagccgcgtcgccttctgcgcccgccgcccggtggccggcttaaatttgtgcgcggaggcgagccgtcgtcggtgccgcggggcttcctaattcctcccgggggagtgtggtcgagtgggggtttctggggttcttcgccacttcgccgcccgccggtgagttcgcttcctctcttccaagttccagtaagggcttgggtcactcgattgatgctgattcggcgcgtttcgcttgactgggaagttcgtcacgcgattgtcatacggttctcgcgtaattggtggcgtgtttcgatgagaatggccgttaggcttagcttgtagactgtgcaagactgtttttaggctgttgctaccgtggtctgtttggtgagaaaatggctggccttcctgattccttgtggtgttcgtagtggaatttgatgggggtctgatcgttgtggggggtcgcttgccggtgaaggaggctgctcttcggcaaatggttgggtgggtgggtcactgggtgctcaccgttttccggatctgggattctgaggtactgaaggtggtgtcgtctgtggttggggagtggtgcggttttcaagtttaggggcgtgtttaggacctgatgatgcaattgtaaatttgtaatacgatttgcaacgtccatatgtccacagcaacccaaatttattggtatagctctgatgaaacttcgggagtttcatttcagtatccctgttggtgaaaattatctcttctttcttgtattttgttcatgaagagtgatacaattaatagtattgccactgttactgtttttttctgaaaaaatttggcgccttcttttgtcttaacctgcttggatgatacgcatagttaatcacatcattaatccattatgctgtaatgatgtgtgaattttcttacaaactttgttttcttttgcagtttagtaaattcaacattttggacctacatgagttgattaacaagtccattccattgtccttcatggaggcttcatcttggttgtgctaccaagctcgtggttttggttcatccagagtatggttatggcttcttctagctcttgttcttctgaattgcagcctggtactctcagcctcgccgtatctggtcggtatggggagcttcgacataacaggacctgcagcagatgttaacatgatgggatatgcaaatactgagcagattgcatcgggaattcacttcaggctgaagtcacgtgcatttattgtggctgagcctaatggaaagcgtgttgtgtttgttaatatcgatgcttgtatggcatcacagattgtgactataaaggtgcttgaaaggctaaaagcaaggtaagagttaacatttcttgcgaccttattaatgcttgcatgtttgttgcaactttatgtgatatgcgcttatagatcgtgtataaaatgatccatcaacctttctacatgcatggtatgttccccaaaaaagcagacccgtaactcattgtcaagttactcatcatcatggattgagaatttgagatcctctgacttacttccctttgacttggagtcactgacatgtgggcccgctacctaaagggccaacatgtcggtgatccctgtcagaggtaagtaagtcataggatcctcttcctcaccatcatttgttgatggccgtcttattgttttcaaagattgttcaagtgaggcactgcctcaaaatcattggccattttgcaatgcatgttgcagaaacattgaggaacccagatgccctcatgttcactggtatgatcttgtttgaatctgttatgtcccaaagctcagtgaggcattatagcacgccatcatgtaggctggtgctgacaatgctgtagctaaggtactcatgttgcttgtctgttgtagcacgcctagagtctcagtcgagtcactttgttggaagttggaacattatctcttaaatcgactacctactcaacatggtattgtatttcctatgggtaaataaaccaaatttctagtttatattttgtccaactgaacctcaaaaccttgacttacagcatcaggattcttcccagtgcttctggccagccttgagacccttatgcagccatgcacctaataaagtctgctcagtagtttttcataacatcagggatcctcaaatttgcaggtatggtgatctttataatgagaacaacgtggctatcagtggcatccacactcatgctgggcctggaggttatcttcagtatgtagtttatattgtcacgtctcttgggtttgttcgccaatcctttgatgtaattgttgatggcatcgagcaaagcattgttgaagctcataacaacctccgtcctgggaaaatatttgtgaataaaggtataaaattagcttttgcttggactagccaaggttttccaaaaccgcctccggagccaatttttgctgctgtttaattaatgagtaaattacactttggtccaccttttattacccaagtttcactttggaccacccttaaatctatcttttcaatttggaccggataaatttaccattgttgcggtttgaaataccatgaaaaacttttcttgtcatgtctaacttccctttcggcaaacatatgaaccatacatagaggtgttcgcccgtatacaagagttgatgtgtttaaggttgttgattgtactgaaaaaaaatcgtttgtggtggtccaaatcgcaacaatggcaaatttatctggttcaaagtgaaaagatttgtttaagggtggtccaaagtgaaacttaggtcataaaatgtagcccaaagcgtaattcactcttaatgagtaaattacaatgcacctgttttctgttatttgtgacggttttaatctcacatatatgcatttcatttagttgcaagtaggccttcaaatgtcattacttgaattccggttatttctttcttatcattcaga

SEQ ID NO: 44414 - DNA, 33817 bp, Oryza sativa
  unsure (1)..(33817): unsure at all n locations
aatttttaaaaataaaataaaacatattttttatttattacctaaaaataaattgtcataaataatgtatcgtgcaacaaaatgataattattaatagtcttatgcgataaacttttatattttcaataatgtaatttataaaaatttctatgttcatccaaagggtaaaatggtcaattttatagaaattagatggtcgactgacgggagggatatggaagggaccaaaataaaattttaggagtatacaaagaaagcaagtaaaattcagaggcataaaaaggattagctaaaattttagagatatataagtgattttctccaaccggagttgaaatgggattgcactatatgcacttcctacttccaagacatgtagtcatgcacgcctgcacggatagtctggtagatatatgtactgtatttgtttagatttgactacattagcaagtttttttttggagataatagaattgaatttgataataaatcatttcttctctttcacgagaccacaaatacactcgatatagttatatatactttatataattatatacaactataataatcgtcgatctacttcattataggttgcattcactatgatcaacggtatacgtctttatttttcctatcaacacatactactgataggcccacagaacgaacaatctcctgtcttacgtcctgtttcgttcatgggtctaatccattagtcccttcattttaatctgttttagtctctaagaatttaaacaagatgactaaaattaactaaaagtgtatgttaggattaaaatccattaatcccttatggagatatttgtaaggaagaaagtggcagcctctctcttctctctccctctatccacatacctttagtcccttttagtctctggatctaaatagtaggagactaaagtttaaagtttttagtttagagactaaatgatccaaacaagaccttaacatgatactccctttgtttgaagtatttcaaaattgagggcagaggtggttcaaataacataatactacaaaggtacgaataactatactttggcacggagtaaatagatagataaatctatctattattatatactaaaagtccattaatcttcctacaaacactctcaaggagccacgtggctttctaaaaacgttctcaagccgtcacgtggcactctaataaattagagaaaatcctacaaattctgagaaaaaagcaaaacatctagcccttagttttcacttaaattggtgacccaatatttcaggccattaaattaaatctattaaaatcattccttcttctaatatagatacgatgcgtggagaggaaggtacgatgtactattcgtaaacagtaaaaaaaaatcctatgcgatgcatatggaaggagaggaatgtacgtatgtactacctaaaaaaaattacatgatatacgtttatatgaacgtaatgtaagatcgtacgatcggaaattaaaaagcataaagcgaaaaaaccaaattatatataaaagtccactaaactttctacaaacgcttttaagctgtcacatgactcctacaaacgctactaagccatcacgtggcgctctaataattaaattagagaaatctaaaaaattttgagaaaaaaaaggaaaacattatatcattgattttcacttaacatggtagacccatcattttatctcctattatctcacctgctcacttctttatccaaattttctagatagcagctcagtacataacaataagaaatgctatattaactatctattatatagtacaaatcaaataaactccgtacaaacgctttcaatctgtcacatgcgtggtgtgctacaaacgctcctaagatgccatatggtactcaaacaaattaagattcctaaaaattatgataaaaaacaaaccattgattttcctttaaataggtgaacccaaaaattatatctactacaataaatattttttaaaataatttttctatctatattgattcacatgcataactaattgcacatatatgagaagtaattaaagagagggctagcaggatggtaaaaaaaaccaatgaaagtttgttgatatttcttcacgaaagagatatataaagaacactcaattcaaaatagaaaatacgttactttaattttaatttgatttgttagaactattttcgaaacaaactaatgcgcagcccgcgtaaatgcgcgggctatcttcctagttaaataaacaatatagaaaacctaatccattagaccaatggagacaggtgttgaacataaaacatttcacgtattttcttttttagcaaagcagtacgtagtccatgatttcaattagccgcaaaagatatcatctgcgaggacattattaatttatttatagaaggtataagaagggactttcctcttgtagtaagaatgactttgtcactaactaattccactgatggatctaagctaggaggcccaaacgaattaggcaggataacctcacaaaaccacccaccaacaccaaacccactactactaaaatggagtaatggtactactggtagctgatagtaagaccatatggacacagaaagtggagtatcctttcattcctaaaaagggcatggaatagaacaaccccaattttggaaacggggagcagagccattcagctgtttggggaccaaaggcaaggaggcatgaccgaccgatccccatccattccaagccttcaaggagacaagatattttcgaagagagcacacctaggccctagctagcacagtgcgcgctacagtatagtattaggagcacttcttttcccccgattctccaatcaatccaatccaatcctcgtgtaggccaccaggaggcccctccatccgtcccactctgccctaccgcccatctcatccccatccatccggtcgctgaaatccgccgtgcacgtacaccgtcttgtcgatcacgaccaaaccccggccgcctccgcctcctttctggtggcgcgcaccgcccgcgatctcgatcgttcactcccggccgtgccgggacgatcgcgcgcgctcgccgaccggtgtcacggatcatatcaaatctcgcgtagctagcggtcgaagtcggtggccatcgtttgttcgccttcgcacaggtgtccgctgatctcggcgctcacaaagcggtcaacacctagtactagctactgaagtactgtcaagagatcgagccaagccgggccggccgggtatatccaggggcgatatgacggatctggcaagtagattaggcatgcggttagttgggattagatcgagaggcatgcacgcccgcgcccgctttggcgttgccgggtgccccggatcacgctgttggtccaaaaggcggcactgtttagtgtcatggcctcaaatctcacgcgatggcgacgtacgccacagcgggaagggtcaggagcccgacacttgtcgcgctccggcctcccggacacttctatatgaacaacccccccaacgccccaatagtagtatatgccgctcatatcatcacttgtttactttagatcatgtcctgtcatcgcagtataagggttaaccacgatcgagcgagctagccaccgtgcgtggctttgccttttgagggatttgacgtgtaggcaaaagctatagctcggagcagtggagtggcttggcttggcttggcttgctgctcggtcgatcgatcgagagatggacgggctgcacacggagctcgcgctggggctgatcgggtgctgcggcggcgacgggcagcagcagacggcgccgttcgtggcgaagacgtaccagatggtgtgcgacccgcggacggacgcgctcgtccggtgggggagggacaacaacagcttcgtcgtcgtcgaccccgccgccttctcgcagctcctcctcccctgcttcttcaagcacggcaacttctccagcttcgttcgccaactcaacacctacgtcagtatcattcaatcgccggcgccggtccgccgtactcccgatgattaacgctttttccgtcttgtggtacgtgcagggattccggaaggttcaccctgaccggtgggagttcgcgcacgagtcgttcctgcgcggccagacgcacctgctgccgcgcatcgtgcgccgcaagaagcgtggcgagggcggcggtggcggtggcggcgcgtcctgctctttcggtggcggcgccggcgagcaccaggtggctgctgctgcggccagcgtgggaatgtcgggagaggaggaggatgcggcggaggacgtgctggccaaggaggccgcgctgttcgaggaggtgcagaggctgcggcacgagcagacggccatcggggaggagctggcgcggatgagccagcggctgcaggcgacggagcggcggcccgaccagctcatgtccttcctcgccaagctcgcagacgaccccaacgccgtcacgggccacctcctcgagcaggccgccgagaggaagcgccggcgccagcacctcccttcccacgagcccaccgtctgtcccctcccgccggngccgccgccacaacctccgcagccgctcctggctctcgccggcgccgcggccatggacggcacctactggtggacgacggagcatcatcatcatcatcatcatcagatgaagcccatgacggtgttgccatccttggagccgcccaccgctagctgcggcgtgcaccaagtgccggagctcgggggtggcggcgtgatgggcttaacgacggacggtgaggccaaggtggagccgccattcccattctgtctacttggtcaagctttcttttaattaacctgccgaatcatgcccatgcacgtagtaattcttccattccacttactgattcagtcactcgatcctacgtacacactgccaagaaaaaaaaaaacagatgttagttctagtgcaatgcatgcagtaacaccagcatcgatcagtacgtgttgatctgattattcttacagggtacagattagattacagacgatggtgtaaaaccttaattactactgtgtacttatgtacaacgcatcaaacaatagtggtacggtgttgattactagtacttttttgattgctagctgatagttaattagtactactattattagtaagtagtgttttcattaggtggatgcatggacatttcttcttgccctccaagtttgtagggttcatgatttcatcaaagtgcttatattaatctctgctgcataacttttgctggaaacatgcatttggcttcctgtgattgcccatctaccctgatgttaacttcagcaatacacttagtttattgagtggtttgtgacttttgtgagaagtggcttttgctttcagactctttaatttctccagggcccactgcacacagccaataagaagctaggggtggtgacgaattgccgatcgctgtgctgtgttaatggtccaggtgtctgcttccattagcattttctgtagtgatgatgttaattaaagtttggatttggacgtcgatgccggaagctagctagctagctagctaagggaagcagaagaagaaatgaaaggctcttagagctcacgagagggcgcgcggcgcgaccagcgatttggcgatttttgacgtgattttcccctgtgattttctcctctcttcctctctcccccgtcgctctcgcgggcgccgcgccttcgatcgagtccacttcttaattacgcgccccgcggatatgcaggagtttgcaggtataggagtgtacttgactcctttagtttggactgagatcgatcgatcgcgtggcttaatcgtggctaagcatcgcgaaatctttgtttaattacaccactaagctggtcctgcccccagctgttaacttcggtggcgcgcaaggtgtgacactccgattgatatatgatatataatcctactagtaatctaccagtagtaatttgctttgcgggattattattccaacctgccggcaggtgtagatcgatcgatatttacaaagatttggctgtccgccagcttgatcgtcgatcgatatatcgatcgagtggtactacgtgctagctagctactggctgagctatagctgtgaggagatatatatgtatatttatgggcgtacggtaaatcactaactaaaggctgagctaattaagtactctaggtggtatatatatagtagtaccagtatagtactccgtcttaaaataagtgtagttttacactattcacgtttaacatttgaccgttcgtcttatttgaaatttttttatgattagcatttttattgctattagatgataaaatattaataatattttatatacgactaaatattttcaaattttttataaattttttcaaataagacgaacggtaaaccgttagacacagatattcacgactgcatttattttgggacggatgcagtagaatgtatagcgcgatgcatggccactagccaatatccatccaccacccacgtgacatgatatggtccatgtccccctcggccggaatatgcttatatgcaaatgatatgacggctcgtataattacgctggtctccatggtcaggtagccagacactgacgcgctagctctacatacattactgtatttcgtaattcataaaagaattaattgaaatatataaataccgtgatatcgatggtaattaagggaatgccattatggaacgggatataaaatgatttttttatcattgttttctatatatcggagtgatcgatgtcatgtcactgtacgacgacgcaagtggctgtaggactgcgtacaagatcggatgaacaatgatcactctcttaattgttttgacccgtcgcgcgttgagattatagcgagagggcatatgggcaaagtaaacggatgtgtccaaaacagggtgggccccgcgatatatattcagcagcaggtggcccccagttggcaggtctccatcgggcacaaagatgactttggccatgtttaggggagcttctcctcttagctgcagtttttttcaaaaattgtttctgttagaagctgcctcaaatagttacagattctaaaaatgaaataaaaagccagaaactggagaagttgggtttcagagttttttcagattctcataagctgactatcaaatagctgcttctcagaatttaaaactccccaaacatatcctttgtctgtgtttactgtgtgaagcaccgatggaattatgtctcgcgggtgtactgtgttacgttggcgaccgtaggagcccaccttgatcacgccggccttaaaggtgcccatacacgtacagttacggttactgtgagccgcatctccaaccgtcgcgtgacgacaggcgatatacgaccagctgttacactatttaattaagccgcgtgacaacaaagttaaaaacaatcgatactcattatcaatcgacgggctaattaactaacaacgttctggcggtcagttaacgagttgataatacacggtgtaaacccacatgcatgcaactgtagagtatatacttctactatttacagcacgcgcgcaagcaaagaatgcaggatagctaaaggcaaaggcgacatgtatctgcctacctatctatcgatcgacctctcatctcaaaccatgtgagaaaggaggcaaaggcagcgtgtgtgcaggcgtgacatgccactgtgtgactgtgactgtaggattgcctgggaggtcatgcatgcaggcggttctctagctagctatagccaacttgatcgcactgttgcgcattcaatcgcatgttagccggtgcggggctcaccatgtcaggcataaaatatgttatctatgcacctgcttagctgctaggctaggctgctgctagcagaaatcaagcaagctggctgagtagtacggaagtggatttcttgctccctagctccgtcctaaaaataagaaattttgaatggataaaacacattatggctatatttagtttatttaaacttttaaaaattccatcacattaaatgtttagacacatgaataaaacattaaatatggacgaaaaaaatcaattacacagtttgcatgtaaattgcgagatgaatcgtttgagcctaattacgccatgatttgacaatatggtgctacaataaatatttactaaagacggattaattaagcttaataaattcgtttcgtagcttacatgcggaatctcgtagttatgggtttttgttattagtctacgtttaatacttcaaatgtgcgtccgtatacgtccaaaaaaaatttgaggaggaactaaacacggcccatatttttaaataaaaaaggtcaaacgttggacacaaacccataactacgcttaaaatgcgatagatggagtaaaacccatatgtcggtgacttaagttaattatatttccagtttagtacatactccctctgtaccataaaaaacgaatatagaattggatgtgacacatcttaacactatgaatctggatatatttatgttcagatttgtagcactataggatatgtcacatttggtaatagtttatttttatgtaacgaggaagtacatcatcgtgcatggccgttcaatgttatccatcgatctcgctgtttcatactccgtatgtgcatgagaccgagttcatgacttcatgtgtgtgacgagttacaaacttagtacgtggtatatatgcccgattttagggtttgtcgacggatattgggatggaaatattatatcgtggagttatattgatacttccttcgtcctaaatataagagtttttagatggatgaatacatcctagtactacggttataaacatactcttattcagattcgtagttatagaatgtgtcccagcattcacccaaaaacttttatattttgagatacagggagtatatagagtagacatggaggaaaaggaatatttacgtggtaaactcctctgccgccatcacccctctgcctgatctgggagggagagggagagggaggggagggaatcaaggaagtgaaggagaggggtggaggatgagggtaggaagtgagggacttagccgagatgaatggttggaggcagattttataaggtatctaactttttgtaagccgatatttttacgtctcgtgtgtgaaaatcgatttttacatgtgtgatctaaagaggtccgtctgtaaaaataattcttacctcttaagaccatacctgtaaaaatcgactagttttaattttataggcaagactagttttattgtacctttacttatttttgaaaatggtaattttttttacctttacttatttttgtaaatggtaattttatagtctatctggaaaaataaaataatgatgttggaaaaaatcgtcttgaaaattcctacagtatatttttccctcaaataaaaaaactcttattttttattaaaaaaaactatgattccgtatatccgtggacagaggaagaagtttttgtgatgcgggacggggggtaacaacagcagcatatgcatgtttgcacgcatggatgcatgcgaagggtgtcgagtagtccccccttgcacgtgtgcgcgaatggtttgtgttcccttgcaatgccgcatggcatactgtgtgcgggatattggacgcatattatggcttatggggcaccgatcgatcgattattctatcatagattcaaatatacgatatctacactatgatcgaattgttcttattcataaacattatggtatacagcactattatgttcctgccttcctggtatatatccattaagttaggcccttgctctattgtcagtggactggcatctcttaggacatgtacaatggtctttattagcggtctctctttattgtcatgcaagcatatttggtgacgtggaagagagaggaagtaggaaagagaaagatggttgctacgcatgacaacggtgtagagtcgactcttagcatttattagaaaatttttttgttgcattgagtctaataaaggaaagatgactagtaagaaagtattttggtacattaatggttagagactgtactggcttaactattgtaacgtgatagcctctaattaacgtagagaccacaccgatctctacctttgtacttgcccttatttagccatttttctgcaacgagaaatggtaattaagatatggacattgatatgtctaaattaattaaggatcccataccttctagaaatcttgctgcttgtaaccctaggcgttatatcaattcagcggatattccatgggcatgcctttacgttgctattgcatattctggctcaactgctaaggctctaagaaaacaaaaggaaaatgggaaaacgttatttcgctggtgttattatattttgctagagagagacgacatatgtagatggttttttttcttctgaaaactcatgtatttattcgatataggagttctcacatgcaaacagattacatgtgccatttggacatctctcagaaaaagagagattgagttgctagctctcagtagaacaagcagctggtagaagtacaacacaacatgcaaaaggatccttgaaaaaggacaagttatacaaaggtccttgaaatatgtaaagaaggacacgaaaagaaaatagaaaagcattccagtccttgcttcgctttttctccctcaccggtgacctagatgatgaagccgacaacggctatggtgaaaacaaggttgactgcaaaagatgacatccagccacaaacccaacaggggcctcgtaaagtagaggttgaaatgaactcgacactactgcaggatagatttttgtggacgccgcccccttttatttccatgcgatctgtaagtggaaccgcacgggaaaataggaagaccggcgccaagccgtcgcccgcacgggaaaacgaattatcccgtgtgggcggcttaagccaaccgcacgcgaaaatagaattattttcccatgcggatccttaagaggcccacacaggaaaatcgattttcgcatgtgggcctcttaaaggcctgtctataagtctatcattcctccccttatccctcctcgatacttcaaaatttcatccttatccaccactcttccttatcttcaaaatatctctcctctctcactctcacctctccttcacatccttatctcctcgcctcgggattgcatcctcacatcctcacctcggttggcgcactgatcaactgcatcgggacgatgacgacgaggaggcggccagcttcctcgccctccggcggcggctcccttgccctccagccgggagctacgacgacgaggaggaggcgaccggctccctcgccctccggccgggagctacaatgatgacgaggaggcggccgggagcggcgcagccggccgaatcaacgccgcccctgtagccgacgacgacgaggaggcggtggcctcgagcgagcgagcgagcggcgggtggcgcagttccctcaatctctggcctcgagcgacgacaacgaggaggaggcggtcgggagcggcgccgccggcctgatcaggccgccgacgaggaggcgcctgtcgcggctgctggtggaggcagcgcggtggccgccgccgacgtcgaggaggaggaggcgacagtcgggagcggcgccgctgccgatgacgacgaggaggaggcggccgggagcggcgccaccgtccccacctcatgcggccgccgacgatgatgatgaggaggctgctaggagcggcaccgcccttcccacgccaggatccggcggtggcggctgccctccggctagatctagcggcggcagcagggagcggtggatctagggttagggtttcggtaatttgtgaattttatttttttttcaggtttttatttttcgtgcgggcgacataagcacccgcacggaaaaatccaattttcgcgtgcgggggcgcctcccgcactcaaaaatcacgattttcgcagacgagtagttgcgtgcgggccattcattcgcatgcgaaaatattttttgactgcacggaaaaacccttcctgtagtagtgcgatgaacaagagaagtttcagtcaaaccttggagataccccatcgaagacaaggaaggacaccagaccagcagcgacaacctcactggagatgatttgaaagaccagcaccacctcatcgttgtggaggaagaagtgttcccaccacagggaatatctgttgcacttgtggatctaacaccaacagaaacctccatagcaaccctctgaaccgcatgaagctgagaaatcccggattgaactcaagctgagcatggaagggagcatctgggatgaagaagatgggtgttgacatcgccttcgagctgtacacaaaagaggaagaagaaaacctagaacgagataaactcgatacataacgggataaatctgaccacgggatgaacacaatagctccctgaacccccaccccccccccccacgcgtcaacggcgactagctgccaccacaagcgtaggggagaggggtttcagcgaagtggaaaggaggagtctggctgttcactttttaccgccaacgggagagaaaggataaggttgagagagagaccccatgacatacgtagatgtggagtattattaatgcaagcacggaaggagaaataatgaattaatgaacctcggttgaaaggcctctctgtttggcccaatcgagttagtaataagtccgtttcatctccctcatcttttgctcttgattgagtcacatccctcgattacaaaatcaggtataatgcttcccttaacttaaaaaacaggtgcaaatcagctcattcattggtttaggaagcagtttcttcatgtggggcccacatgtcagtgagacatgacaaaacatatgcggtgggccctacttgacagtggcagtagcggccgtgtgtgcgagaatgcagccatggatgtgcgcaacaacactacttcaacacccagttccgttgatattgctcactcgtgccccttgccgcctcgtcctcctcctcctcctttgcagatggcatggtggttgtcggagacccacgctgcgagctcctcccaccgaccaccgacggggcgcctaggagaactgcaccacgaactcctcccgtactgaaggcaggcggtgcacacgtattggaggatgctgggcacgataacctctacatcagcatacaccatgcgggcactttgccgtcggcaacgaagcagccggctgggggaggagccaacagcgtggaggcacgggagggttgggagaaggtgcagatgcatattcgaaggggttgggcacaactacgtatttgccagcttacactatgctggcgctatgctcccaccgacaacggagccaccgactaggggaggaagctgcaccggggcaacaggtttcgatcactgaagctatccatggatgagctgctccccgcggagcccgttggtgttacgtatcaggcgctgctcaaactttccatcgtagatgccaccgagcttctcctccacttccttcaccatgcacggtgcccaagaccctccctcatcccctaagcgtagaaccgccatcgtcactgccactggccattagaggatgatgcatcggagaaagaagaggacggacgggatgtgtatctgggcgatggacaacgaagacgcaacgggacagcgaatgtgatgccacgttaggggaggaagacggtgtatggaatggcgcatcgccggctccctcgcttccctcctctcctcctccactgctatagaccgccttcctcgccggctgccaccctcactaccttgaagtcaatagccgggaatgtggacaagttgacacgggagcatcggcttcctccgacacaaccttgaggttattgggtcgggaacagggacgggttgacacacaagcggttgaggtggagctcggccacacagacgacagatgcgaaggggtagaggagaaaggtgaggtcaatgaggagcgcgaggaagagtaagagtaggagcgggcgagaggaagtggatgaggatggggacgaagaagaatgtcagcggtggggaggtggtgaaagggggagagagaagaaggaatgagaggggggtgacatatggatcccactattatttttttaaagcttgtactgctgactcagcaaaaaacgcttcctaaccaatgaaagagctgatttgcactggtttttgaagttgagagatgcgttatatcctattttatggttgacggatgcatttttggatcaagggcaagacagaaagatgtaaaatagacttattccctcgagtcatatggaattgaatgcccaaagaagtaagtcacgtatgttcaactggatcgttgggccgtccaacttgggctcacttgtgacgaggataacgtaacacttggaataagttcatctaaggtcccttaactttacactaaatcctattttcgaccttaaaccccaaaaccagatacaactggtcccttaactatcaaaaccagtgcaaacaaagtccctcgacggtttgtaaggcggttttgactgacgtggcgcctacgtagctggtttgactaggtcttcatcccacgtggcattgacgtgacgcttatgtggcaattctatcccagaaaaataatagaaaccgtgggctcacatatcagtctcactcctccatccctctctcttctctctctgttcttcctcatcctcactcccctcttcttccctctcccctctctctcttcttcttcttcttcccggggagtgccggagcggacggggcgggtgggcggcggagcaggcgagcgaggcgggctgtccgagctccggcggtgggcaacggcgccggcgacgggagcctcgaccgggggagaggaggcgccgcggtagccggagccggggtggtcggcactgcggcgggtgaggtggtggttggcgcggcggcggagagaagctgctgctgcatctccagcatgatgcagactctgctttccggattgcttgctattggaagaattgaggagtcgatccctgctattggaagagttgagctagataacatatcactgacagttaagctatagctatttttttctccatatcttaattttcttttgttgacaaaaccattgctatgcggccagttcatagatcatcaggcacacgttcaattcacaacaagtacttttctttgcgaatccacaatccccgctacgaccggccgcctcgccatgccagtatatgccttggcgaccccttcccgaccggcggcgtggtggtcggcgccgccgcggggtcttgcgccggccgcatccccgccctcagtaccgctgccgccgctgtcgaactccatatccttctcgagcgtgacggcgatggcgccggagtggtcatcctcgtcgtcggagcccgcggtcgagcgctccgactcctgcggctactggtccagctgtcgcgtgagcagccacggtcaccaccacgaggccgcggaagacgacgacccgtcggagagtgaaggcggcggcgagggcgccgcctcgccgaggtcgctggccgcagtcagtgtccgaagaagagagaggataatgggaagaagaggagggcagtgaggatgacatgtggggcccacgtaggtcccaccattttttattttgtgtgtgtgaaactgacacgtgggtctcacgggttttattattttttcggatcgaattgacacgtacgcgccacgtcggtgccacgtcagttgaagaccgagtcaaattagccacgtagacgccacattggccaaaaccaccatgtaaaccaccgagggatctcatatgcactggttttgatagttgagggacccgttgtatctggttttgcggttgaaggatgaaaatcggattcgttgacaagttaagggacctcggatgaacttgttcccgtaacgcttcgctatattttggcccgcaaaagcccctcggatttccttctctgattctccctcgcaacctcctcgtccgcatttttgggaacacgcccggacgttcccacgcatggctcacgaggcatgtgagttgataactgataaaccggttcgtcggagcccaagtacgagctgaccaaggaggttctccgaaaccaccacaccgagaaccaccagaccaccggtggaatcgccgaactccacgccagcgacgaaaacaaaaatactcggtgaagaacgcgcgcgtcgacgtcagtgagcagcaacgggccgcgccgcgcgcgacgccatcgggaacaggggcagcgcgccgcgccgcgcgcccagctccgcacatgcgcgcacgcacgcacgcacgaacacgggcaaccgaactcgaggccgtataggaaattcccacccaaaaaaacaccacaagtagacgatagaagagcttagcgcgcgcggagtcggcaccacccaccgttgctctcgcggcgttcgcgcgggggcgggaatctgaagacccgctcgccgcgtgcggacaagcgcggcggcggcttatgcttgttcctgcacgcgcggcgagctacgtcaccgattaccgaattaccgaccgcggtcaaagaaagttctactgtagggctgacgcgtgggcccactcccaagcggtcctctggtgggccctacgtgccagtcgctgcgtattgcttctctcctggggatttgggatgattaattattggatgacgcacttgctagctaaaccatcttggcttgtttgtttgttgtcaagatggagagcatatatgctcctctggtttcactgcctcctcctagctaatactcctactcctaccattttatgtaatcctaaaagttggcgctcctgttgctacttggtactacagtgcttctgatctgatgagtagactaggatgtgatgtgagcgtgtgagcgaccacatccaattcagggtggttcaaattcaccaagatgcctaagcgatcaatcagcataaagctgtggtgtggttggccatacaaataacagcatctagcacatgcaaatttggcctggatattgtttgggtcaaactttctacttctctgaaagctatcgttaaaacattgatgtgatgttacagtctcgcgcacgcagacctgcaggcgtcctttggcactatggatccaaaccacgggttcgcttgcaaaggttgcatggtgtatacaattgcagcaaccgtgttcccctttgggatcagatattccaaacacaattatgaactcccaattttaacatgcgcaaaaccagcgccttgcccccctgattggatttcagaaatttgttgcccgccgggccgtttgtgatcatgagcatcgaaatggaagaacaatttttagaacctaggattgatcgatcgttcaacggtttcttcctgacttcctgacactacagttattcataacacgagcacatatgcatttgatggcacgatcgatatgccaattcttcatgtaaatacaaagtagacttaactgcaaaccaagataacacgcattaatgccgatcgctcgctgcatctcctaactacgtacacctctgctctactggcctcacaacgaacgagttatagcttggttggctaatcaaacaaggctttggtcgatcggttggttggccactgtcactgatcagtgatcgctcactcactcctcgccgaagacggcctcccatacgtcctcgaaggcggcgaggatggccgggtggtgctgcggcgagttgagcgagaggtacgaccccaggagctcctccatctccggcacgctgcagatgcgccgctccacgaccatctccaccatcgagctccggaagtcggcgtacgggttgctcgaccgcttcaccaccgccatgcccgcgccggcggcggtgtcgtcgtccgtgcccagctgcctcttgatcgccgtctcctccttcttcttcatgtcgttgtgctgcttcttcgtcgccgccacggataccaccggccggaaggcgtcggccgggtcgctggtgatcctcgccgacgcgcgccgcgccggcgggcggcgcgccggcgcgttcttgtggcccttcctggcgaggctgctgctgctgttggtgtggtagaactccgaggtggagtcggaggagaagctgagggacgagaagagcgtcctcgtgtcggcctcctcgccgccctcctcgtcggtgctgaacggcgcgagctcgtcgtcggtcaccgtggacgacgaggagctgtactgccccggtgcccccctcgggagccgcgcgcggccccaggaggacgacgggcaatgccgcctggatgtcgacggcgaagagcgcgcctttctcctcgccctgctctgtttcctgccatccttcgtcggcaacgacgacgagtacggcaggaggggcgcgtcggagtggacggagcggcggccggaggtggccccggccccgccggtgcagtcgatggagatgtggaccagcgacgcgctgcgtcggcgtcggcggggacggccgggggcatcaagcttgggcctctggtaggtgcagggggtgcagaagtacggcgagggcggcggcggcggttcttggtgcgtgtcggcattggtcttgtcgaggctgacgaaggccgtggacgaggtggtcgttgtcgtggtggtggtgttggtggtgcaagtagatcgcactaggatctgagccagcctctgcttcagccagccaccggcgcccaagccgtcgaggcggcggtgggggctcttgtccacgaaaggcgtgtgcatcgcggtattctttgggtgtttggaaatgggttgaggaggggagagtggagtttttttttggtttatctcacgtcgcggcttggtttgcgcctccttataagcttctcgggagtgtggtttgcatcgtgtgaaatgtctaatggagattgcatgagacagagaatgcagtaggaagccggtagaaggggagggggtagaagtgtacaaagtgtacatcgaaatttctcggctatgtacgcacgtgtagtgatgcggtggagtggtggggttaggcaagagatgtgataagagaaggttgatttgcacatttgcaatcaggtttcatatattcatgaatatatgacatagagtactaagtaggagtatgtactttttttagataatgaggagtatgtacttgcattacaatggtcaatgggtcaatgctaataacattaaaaggagagtgggtgatacgtggatttaacataaaaagaggattttttttatccagacatttctttttctgcttttctttcacgatttttttttcggagcgcaccattcgttttttttttcttagcgtgcgctacgtgccagggggagaagtgggaaggacagctagggtgatagaaaaagaccgaaccaagagaccgagaccgagaaattcggtcatcaattcggtcatagatagtgaaagatgaaattttattcggtcaattcggttagtctcttcggttaaccaaatagacagaaaagaccgaattatcaaaaaaatgtctaaatgcaacctacaatccactatgtttaataggattaaactctaattttcacgtacctacttcttctaggcatgcaacctaataagagtctttactcataagtacttacgaattttttttgtgatttttgtgttgaaaatttccattatttctttgcatatatggaaatgttgttgaatttcggtcgagaccgagaccgaatttgtcggtcctaacatttttttcgctgaaattcggtcttcactcttttcaaagactgaaaccaaaattttcggttagatcgaatgtccgcccctaaggacaacgacgattgtgcttttatagttgtagatatttgctgctccaccattttgcatgacgggatgatgttagctgtcaaaacaatttatacgaggaaaggcaacaatgtccttttgtttccttgacttggtgttatcctcaatccttcaatcctaaaacctccattccagtctctcgcatgaaaaatatattcctcttcttttttttttttttgcaaaatttgatatatgacacccaaagaacgtgtatcttcttgttgatattgtaaaaatgtggtaattagttactggacacccaccgtattattttattatttccgatggaaacagagagagaaactttcataacagacaagtttgcccacgggccatctgtataattgatgtcattaacttcttagttaacattttataagtcgggcccactcgtcaatctcatatctccttctctattcctcttctccctcggcagcaggtggtggtggagctggttagccgcgatagcggcagagtcgcagagcagtcgcggggagaagagtcgcagagcagtcgcggggagaagaaaaacccgaagccgtcgtcatcgccgccagtgaccccgagctcccaggtgagcagcacctcctcgaccacccctgcggccgctcccctggacagcgcgaggagcagcgccagcagcagcgcgaacgccgccagtagtgactgcgcgaatttggctagtggcgtcgctgaggaggaggctggtggccattgccgcgcgcgggggaggagagtggccgccactagggcctgggggccagttgcagaggaggagctatgacccgcggacggtgaggtcgccccacaggccggtggcgtcgccgaggaggccggcgaccatcgccaccctctgccgcgctcgctcgcagaagaagaaaagagaagaaaagagaggaaaagaaagaaaagaggagaaaagagacatgaactttcaacgctctttctctctctattttcaccggaaataataaaataatgtctcggtgtccagcagctaattaccatatttttacagtgcccacgagaagatatactttttttcacagcaaaggccacaagctttaagtgtcatgtagcaaattttgtctttttttatccggccggtggaaaaaaaagggctccgaccgatttttaataagattgaggaagttctagaacaagtgcaacatcgggccaactccaactagcttagggcctatttggcacagctccagctccaactccacctctcagccaaacaatttcagttccaccaaatatgggagtagagttgggtggagctctatcacaaaatgaactagagttgtgcagctgggtttaagcaaccccacaactctgcttcagacccaactcctgtagctaaatttaggagttgaagctgtaccaaataagtcattagtaaaactgtgctgcaaggagagatgttggcgggctccacttctattataagtgatggcaaatgactaagaacatgtttgtttggaatgtttccttcatcaactttctcgttatccattagcatgttttctcaaccactgaacggtgtatattatgtaaaagttttctatatagaagctcttaaaaaatcaaataaattcattttcaagattatagtatacgttaatgatccatcccagcggcctacaactacagccatacaaccgatttaaactcagcctaaaataccaagtaacattctttttagtgttatatctctaattaagcactttggtgtggtaaaaatgtgaatttcccaaaagaagctacttaagtgaagtactgaatgaaatagaattgtcaaagaaatgtcactggtggagtttgtggatgttactataatgtttttatgaaatttgtcaaactttcaaaaaaaaaataaaacaccaaaacttgttaaaatatggaacagagggagcaggtgacattatgaacttattgaaagtttcctttaggacgtgaggaactgaggactatttcaaagaaggcttccaagtttttattttctttcccaatcctttatatattaagtatcatgtatatatgccctgccatctctattgtccattggtagctgccggactgccgcgttttggccttggccaccggcgtccggatgggattatgggatgcggtgcggaccatgcggtcatgcggatggatgacggatgcacactcgcagtcacaggcagcactgcagtgccgcgcacgtcgttcagagcacaatcacaaaaaccagcaagaatgtggcgggcccgacgacgccccgtacgtgccaggcggctggtcgaggcagtcgaacatgctggctgccggccgcgctggtggtggtagcgagcgccgagcgcgcccgccgcccgtgtaggtgtcgggtggctgtgcctgtgcgtgactcgctcccgttgacctctctgcgcgcgccggccggacggaccagcggtcggagccgcgcgtcgcggaagtggaggagaataagatgtcctcatgcgcggcagccgcgggcacgcggggttcggtggttcggtcggtggctctcgcgatcgtccccgtgatccggcgcgtgcatggtggtcgtcgtacgtaccggttcatcaccacgcgcaagcagagcgtgatctggcccacctcgcgccgcgccacggccacttgccgcatattccgccctggtacagcgatggatcatatatatcccagccatttcgctcatctctctcttaaaatgatagagaattcattgtggcatttgtttcatagaaactataggagtactatacaaagttgtaggttgaaatcggacgaactacaaaaacaatttaattaaaacaagaaaaaattttgaaacactagtctaaagagagtcgtaacgaacctccatctacgcggaactatagtggcttaagttacatgtcgtttttgttttcctcaatctataaaacagaaactccgaaatcagcgggtaataattgtgccgattgaatttcactatattgtatgatccttcttttctagtctattgctgctactgactctacaacgggttttacctagcactagggtttggtaaattttatttgagaattcaaaatttccaaaaaagaaaagaggataaacatttagaaaatttgatgtaagtagtatttaaattgtagtgttatctagtgaaaaaatttcgtgaaaaaaggaagttaacatcatatttttgagccaaagtgataattcaaaaatgacaaagaacaaacgagatttttaattgcttgaatgttaaaaataaagcaaaagtcataccgagttttcctatgttacattaatatatggcatttctacatgttctaaatgtcccctacatacttttgtaattatcctgaatttccccttaattttttactgcttttcattttttttctttcattttgttttcttacaaacagttagcggtaaccgcgtcttatactgtacagttcccaatagccgtcgaaaaagttgaattctcaagccgtgaagaacgattgtgaaggcattacaaatttacaatacataggattaggagtacgttgatcgggtttaatataatttacgagatacccctacttcgtcgctaatgtctggacttgctcggtatcacgactcacgaggcatcttaaggtgcaggataagcatacacatttcacggcttattctctctgattgatgttccactgaggccgagaagacattctgacctcaatgtgcaatgtttcaacagagtagacggcaccaaacacaaacaaacattctgccttctagccagctatatatattcagtactactccctcacttcgatttcaaaccaaagtacgggtttaactaataatcagtacaaaaccaacggcctaatttcgctctcacctaggtgatccttccaccacaaagtttgtaaccacatgattaggatgtagcggaatgtttcatcctcccaatgcagtaggaggcagcctaattacagcatcgtcagtgtacgcgtcctcctctaccgtaacacgacgaaaggttaggcatgtacagatctactgcaaattaaagcaaccatatgcatataatctcatacacgtacaaggctaagtccaaggtggagaaattaaagatcaggtaacgaaagaacagttaaaggctgcacggtccttgaatcttgaccccgtggactgaagtacaatgaaaaagaaaccaaaaggtcttcgtagatttcaaatgcctttggacttgatgtgtgtaatggccaagaacaaagggacaggtgatgcaaaacaagcgttgtgttttgcagcgtaagcttgctgtgccagttacaggagaaatggtattaacttattatgagtactatggtaggtaaggggatgaagggatagtggctaattatgtagtactacgctggagtggtgatcagtcttggaaaaggctctaacacagcgattatattatgaaagagaagggagagggttttgttcctttctcacttgtcttgttatgtcacaggctgaacttaggtgcagtggtgcatgctagagatgctcctcctggagtctctcatctctgcatcaacctactcatgcatctcctaaattccaacttgccatcacgttgtgtttagcttctgacattggcatgtgaacaaagataagagcgatctggctgacatgattgcgagcagtcgtaaaacgcaccttcttaatttgagctttgattgtataaacgcccagaggccctcttccgtacttctgctccatgtataccacgttggaattcacaacttgtcttctaaaaatctctgttatctgacacgcatatctagctacgtcattggtcagtgacatacttctaccaccataccatagcaaatcaggggtcagtactgctgactaccttcttcacctgagccaaagtgccccttgacgtcttgatcatcaatcggagctagagtagtgtcacgcagagatatctctgcgattccggcaggtgtaccatgcacgtggaaacacaactgaacggggccaatgtacgcgctggctgtggtcacacacaaacacaaggggagagctactccagtagactgtgtcgcgtaacggatccggtgcagatggggggctaccaattccggcctagctaccactgttctggtgccgatccagatgagcatgcaggcgcatgataggtgagtcactgctcaaacgaatccgagcgacaaaaagaaggttatccatatacggcgcacgtctgtacggccgagggtgagtcttggaaaggttcaacgaacgaacaatccgaacagtcgtacgtgccttctggccgggccttggctagtcatccacctttgtgcttgccgctttgtggttgccgtcatccaccttcacggtgcctccaccgtggagagctgatgatcgagtaagatgatgttcatttctatactaatggcactgcaatggacaatcctagctatcggtgatactactatacactgattgcctctcggtaattcaaatattgctaaatggcaaaatggacagatctcttgcttttgtgatcagatagacgaaggagctcctgttcggaatgaggaatttcacaattaagaagattcatagggatcaaaatagagttagtcatgaattaacaagtattgcttgaacccagaagatgtcaaacttctagctggatcatgattgtaccctcaccaaacagatgatcattcaggatcagtctgagattcatgattaatgaaatccccttttccccgtaaaactaatataaagttagaacatacaaaataaaaaaccattatcgtgtaattaattaaatttgaattactacaaacttttaaaaatggatctatctaatattttaaaatagcttttatatatatataaaactttcacacaaaatactttggtttagcagtttaaaaaacgtgttatcgaacacgaggtgaaatcataaaagaacgggcctaagggattgtttggttaccagccaaactttgtcatagtttgccatacctaaggttaagcaagtttgatcacattggcaactgtagttgtgacaaaattctctttcaataaattgggtctcacacatcattggctcaaaaagtgttggcaaagatttccttaaacttggaatttgatctttaagatgtagctaagaatttgatcatctcaacttagataagtataacaatatttgttgataaagagttgtagagtatagccgagaatgcgagaaccaaacacaacctaaaaccacgttatagactgtacgagacgctctcccccttccgagaccactcctgagtcctgacctgagcagtgacttgctttaccgtgaataatgtcctcgattgggggcctttggatgctgacgcagtttacgacccttttcttctcttctgctgcggcatatgtaggcgtggatctgcgtcgagcagtagcactgtagcaagcaacagcagcggatgactgacagtcgctgcaaggcggtacgcctgcctgaagtcccatgggtgcccggcaacgtgggttgctgaacttctcatgatgcgcggctcccgcggtccggccgctgcaaagacgccagccagtcagtcaggcacacagacgcacagttcaccgttcgcttccaaatccaactggagtatcacttgccactggtttgagtataattgagtataatcaatggatggaaaggaatagatggatgcatttgagagcctacgagatttgccagattgatagacgcatgtgatctcgcaaggccctgcatgcttaccgggcgcaattaatgaacgctaacaaaaccctggttctgaaatcaacgtctccgccgctgagtgcacggccatatacacgcgacttgtaggatccaggtcccagctgtagagatcgcgtcgttggctcagaaacatcctgtcatcttcctatactacaatagccataaatagcgacatccaaacatgtactaattgcaatactagtcgtatatgagacaatctatgtcgattggtgatcaagtgtcaatatagctgaaatcgtcatgatgtttcggttatggatggatgcgaatataattaatggcactaacaaatgatcaatcatggcagtagctaaaaaggtttctcacagcaatagccatcacatgtagtcatgtactaatgttactaccagacattctaaaagctactagttaggatacttgggagaagaatgatcaatacctcttgaataaacaggggaggcatggttaatgacaatgatccatattggtcccctgtcctgtctgctagtttgtcctgagaaacaccacaaaagagttccatgagtcttgctccaaatgttgccaaataagtaagaaaaaaattgaaaattgtagcatgatgaacaatagaaggctttgttccattcagcatggacgtaaccaaaacttacagcagtatgacacagggagatcacgcaaactggtagcaagcaagtgggctaaccagacataaagcacaatttacgagtaacacagaataccagacatgattatgccaatacaatatcagaaagattcggacgaaaaggaagaaaagacagacacccattggaaaaactttcacgtgtccacaatcaagcactaacactgcagtagtgtgtgcgatgtaactgggcagatcagatcctgacccattccacttatcagatactagttcagtcccccacaaaattggtggttcacttgtgtacaatggtaatagtaagcacaagaagttgggagtgggacatgtcaatgagttggcatcacccaacacacttccatccccagatgggcatatagaaaagagaagacctatggagctactgtgatttactataccaggaagcactctctttcagtctactatgtatggtgatttaggtagggtaagataagccttcacagtttcactgtgatctgccccaacacacttgaagaagataagaactgtgcaaaacaggaaggaagcaggaaagacgaccgagaaagtgaggcagtcagctacatcaaatttcttgctattgcagggcatctatgcggaaagtgggaactttccattatcacgattcacgaatgaagcaagctccagtgaaaataaacagtgattggtcaaacagaagactgataataaattttacagtacatatgctatttatttcaactacagtttacagaagggcctcccaactgttctttttcaactaaatggacatgccatcgttctgcaaattagaatatttgtcatttattagagagtgtgcttgtcatgcaaattaatccattcggcacaactgtacgttgtgagaataaaagaaacaaaacagcattctcaggcatgatctcactctagcagttcatgctggtaagaaattttgtcttcatcaacacatatggaaaatgcaatgttcttgatatataactattgtctgcattctttctattaccagaagatggcagcagaattttaaccttgaagtttaagcaggatgatctttttaagaaaaaggggtcagctgccaggccattatactattcctgatccatatccgctacctaattgtttcttcaaaccaaacttagaagccatattaaaattctcaacaagctaaccagtcaatacaagtatgtcttccattggtaattgcagtatctgctcagctaaccacaatgcttgacggaccaatgttttaaagacatttgcagactcagatactgtaaactataaaagttgcctttgcatgtaatattaggcttaaaagctggagcctaattagtaattaactttcctgatccagcctccaccctggagagaacgaatttacattacaatccattcatcacaagtattattcattatgttcaaattccgctaactggacttatcatcatatagaagtcaggaaaacaaggagaaggtcaagaaaacatacatgaattcttaacactgcaagcttataaaagattcagaatctatattgccaggagtactttactccctctgatctcaaaaccaagttgttttggactttccatggtcaaatatatacaacttcgactacctagttctttagcacatattaaaaaaaaggttacacaagtgtaatattatgaaagctcttgttataacaaacttgaatatcatttttatatacccaaaatctatactttgaatgatttttatggtcaaaattaacttgtgtgactgcacgcattcttaaataacttgtttttgagaccagagggagtactagctacttaggacctataaacttttgagaattgaaatgctttgagaaaaataatatgctgctactgcagcagcttctaagaattccttagcttattgaaaatgactaatgagtacttattctgctgtagattcacttattgagtggtcttgataaacacatatacaaattcttcactcattcctgtactgccaatagcatcttccctagtgaagtcaatagcattttaagtgagatactaacacatcattctaaattttattttccatacaaactagctggaaattaaccaacaccccaaatgtacagaggtgataacaatacaaaaaaaccaacatctgaattgacatttctttaaaaaaattagaacggtcctctagatagtagaatttaggcactaagacaaacttggaaataacaaatttggttgtaaagtaggtcatgcgtgtcctatagacacatgctaagatggaacgatacaacgcggattagagaagagaataggagtgaatacagataagtatcacattaaaactttgctatcttccaaaaccatgaactcactagcaaattaatttgtattagcaccattcagtacccttgttgcatatagtctagaactctagattagtactttattttgacacagtcgtaaattactggctatgaccatctgctttgtaagcatagaagaatcaccttattttattttcttgtggtaatataaacaagattttgttcctgtaagccaaacatagcaagaaatcagggaaaattgttggttttgcgtaggtattttgctagtcttggaaaaatgagactgttgttcaaccaggtgtatgggcggttttgcactgctatgagactgcactagacattactatgatgctcacatttaaggcaattcaaaaccaatgatggtatgtctcacaacgttcatgtattccacccagggcccagttaaaggcaaattttgccgatgattgtttgcttatgcatcgctacataatacatgaccaaaccatgaattggaagatttgatgcactgatactccatgaagagacatccatttggcaattggcatcactcaacagtaaaaagatgacggaggaaatagcaccatctaaaaatgtcactcgagaagccgtgcaatagatagaaccagtaatgacgatatgcaatatcaaattttcaattttcactgtaagacatgaattagagatcatgtagagcaaccgaccattgcaatcgcagaacagtccaataataacagtaatgagttcaccaacacagttccatcggtcgctccccaatcagcgagaagatacggcagtaaactagaaccattcactgtatcagactggttcctgaggaaggggttagttaccgagcacgaagaaagcgacaaagaaaacgtacgaaggcgcggttagccggagaggtctcttcgtcgtatccattgcgagaagctgcgccgcatccacctccggcggactggcggcgcgccgcccttcccgtccatcgccataggcggcggcggcggcggctaagtgggttttttcgcgttccgcgcggagaagaaaagctgaagagccgtttccccgtctcttcttcattacagcgacaccaacgttgatttccgctaacgacacaggaaggcgtattctggataatgggcccacttgtcagcctcccgtgaaccagatccaggttcccaccaaacagaaaaacagaagctccaccactgcatcgtagtcgtcttcttcacgcgcacggcgcacccagatccaagcgtccatcgccgcggccgcatccgccatggctccgacggcgcccacggcggcgaagtccgcctccccgtcccagccatccgggtgcgccaccctcctgctccttcactcctgacggcatctctttcatccccaacctgaaccctaaactgaccaattttggggggacttgtgagttgaggtgtgcaggaagagcgaggtggcggatctgaagcagcagctgcggcagctggcggggagccgcgcgcccgacgccgacgaccagcggagggacgtcttcaagcgggtgatctcctgcatgacggccggcatcgacgtgtcggcggcgttcggggagatggtgctctgctccgccacctccgacgtcgtgctgaagaagatgtgctacctctacgtcggcgtccacgcgcgcaaccacccggacctcgcgctcctcaccatcaacttcctccagcgcgactgccacgaccaggaccccaccatacgcggcctggcactccgcagcctctgctccctccgcgttcccaacctcgtcgagtaccttgtctcgccgctcgccactgggctcaaggaccccagtgcttacgtccggatgatcgctgctgttggtgctgcgaagctgtatcacatatctgccaccgcctgccttgatgctgacttgcctgcggcgctcaaagcgcttatgctctctgatcctgatgcacaggtgagttgccattccacaaacaatgttgtgattatcatgcaactatgatgctgctacctgttgcaatgattcattatctgtagattatagtgctcacaataccgtttaattaccaccgaaaagtctatgacatctgtagtgctgatttaaagttggaactggtagacaatcagtaaggatttaatacttcttgcatgccaatgtgagctgtaacttgaaatttggttcagcatgcagccggccaatcgttttctactttgcagtttgtctaatagaacaggtggagggaaatgcctaatgaagctgcatgctagtgatattaatcttcattgataatagtttgattttgatctgattgatcatataggttgttggtaattacttggaccgacatattttgtgatggaaagtatagtgacttaacattgctgaagtagcttgaagccttgaagtgaaaccacaatgctagtcaagacaaaactactgaacctagatacaccctattcttttaaggttacataatggaagaaatcaactctgaaccaatctgatcatgcatctatgtgggtttgatttctgggaaggatttggaggctattaggtgaattcatatatttttgctcaaaacattcttgttttggcttaggcttttaagatttcagccacaagttgaagggtagagtcataattttcttctggttattagttctatcatgatttttggcttttaaaagtccctgtggtaaagctgtctgttacttaaggcttagaatttttggtttataagccagcgaattagctgaagcaagcagggctcaacatatgaatgtggttctgggaaaatagataccatggtactcaaatataaccttgcaagaataagagtctgaacacaggtaaaaatggtactgagaggatagataccttggctgcctttattggttctgtttctaactcgctatccccattttctaccgctcttgtccatttttcattgttgcatgctgttgccaccttgagagtccctgcctcaccatgccgccacacctttgaagtgtacttttgatattctgtttgtctgctacattttacatgcgtatgatttataaattttggaacaattgtttcagtatttgccaacataaattcctacaatactattgatgtatatttctattatgtgcttaacatttctggaatgttcatgcataatatccacatgtattcatgaccatattcatattaaatctatctgcatgtaatttgtatttgatattatacgaatccatatcccaaactgaaagaaacattatataggatgtgaaaaacccatacatggccacattttacaagattgcagccctacattcagtattgttcctgactgcctgtataagatgctattcttctatacaccttttgaataaagttacacaactcttaatattattcagatgtgtacaacttaagaaattggtcacacactttaagtctcaaatgattgtaccttgtgagagtagtgtcagtcgtctcagccgtatgctgttttatatctaacaaatactccgcctttccactccaaatgcacgattggctatggattttctcacatgaacatataggagaaatactaaacactgcaatttgtttttggaacaacacaggagagctgcatgttatttcattaaggaggaaaaaacaaagtacacatggtcaagaaggaaatcctgacctgaatatacatattcacacacactaaacactgcagtttgtgcaattattctagattcaacagcattttgcttgtacccttgggttcttgttttctcacaatgccttcaacagtataatacaacataataggtttacatagtgttcactagccaaactagatagggtacttcagagatagtatttaccaagaattatattgcagttttttagttatatttaatgtttaaagacatctcaattttgccatttatgatttatcactagaacatattgtaattctttttgttccacgagtaatattggtgttctacccaaagtaattgaaaccacagtaggtgttgaactgcccaggtgtttggcttg

SEQ ID NO: 44415 - DNA, 1778 bp, Oryza sativa
ctgcagccctaattcacattagatcaacatcaactccaccaccaattccttgcttcctatataactagtaaagacgcacacagtggacttgaaatctgaaggatttgttgctaagacctgctggatagaacggccagatgtttttatgtttatctagtgtcgatcacttattttcacagggcatttttgaccaactttaaaagaatgttaatgagaaaaccgagaaattgaccagttccacttttcttgatgtttacaatagaagctatccacagagtacttgatttgacttcactgagtttaccgactactccctccatcccaaaaaaagccaacttctggctatgtatctagacatagcctatgtctagatacatagccagaagttgtttttttttttggggacggagggagtactcattaacatagtaagcaaaaaccggactagactggcagtccaaaaatccaagtaaaaatatatttttgttaaagtttggagctgagcgggatcaaaccagggacatctggcctcttcctgcctgaggcttctaaccaagtgggttttacctctgatttgtaagtgatcttgcacattcactcatatgtgtaatctcagatccaatccaaaatacattgtaatataatattatccaacccgcctgttcactgtatagactgtggttataccaggtagagtgacacggtttgcccatgactttttgtactatgcttgtttgttactttgtgaaaagcttaactgaattgctagtatctgttgacttgagagagttacattatccttttaggtggctggttagtgattacacttgtgaatttgcaggtagttgcgaattgcatgcatgcattacaggagatctggaccctagaagcagctaagtcagaggaagctgcaagggagattgagacactatatagcaagccagtagtattttaccttcttaacaggtagattaccacctactttttttttctgttaactactctctcagtctctaagtagtattttaccttcttaacaggtagattaccacctacttttttttttctgttaactactctctcagtctctagaagagtgtagttttagcctaatatttttccctagaagagtgtagttttagcctaagatttttccctaaaagagtgtagttttagagtggtccactggacttctttaatactactatatccttttcttgtcatttttagccactgaaccaatattattccctcctcctccctcattgttttctccccctcgttttctctttgaattaatgggcatagtagtcttttaagttttaaccttgtgcttaatatgtctttgactagctaaaactacactcttttagggacggagggaatactcaataactctattccgtgcatacttattgttttatttgtcattgcaggatcaaagagttcagtgagtgggcacagtgcctcgttctagaattagtgtcaaacttcctaccatctgataacaacgaaatttttgacatcatgaaccttcttgaggacagacttcagcatgcaaatggagctgttgttttggcaacaatcaaagtttttctccacttgacaatgtcaatgactgatgttcaccagcaggtcttactcttgcagcatagttttgatacttacgctagtggaagtttgtcactgttatgcatacagatatactgaaattccattttgcataactaaagccccacataaatgctttggaagtttatatggtctgataatttctt

SEQ ID NO: 44416 - DNA, 2321 bp, Oryza sativa
  unsure (1)..(2321): unsure at all n locations
nnnnnnnnnnnnnnnnnnnnnnnnnnnnnnnnnnnnnnnnnnnnnnnnnnnnnnnnnnnnnnnnnnnnnnnnnngacgacgcccagagagagatagagcattgtttagtctgacctttgcttggctttaggactttaatctcgttcgggttaggaaagccatggcataactaacgcaaaagcttggcaaaagctacgctgataacgtgagttacgccgtgcatcgtcgtcgtcagcattagcagcgaatccgaggaggcctagcgtgcatctaatgtgggggccatggccatgatgcccaatggaaaaaaaattgtctctaatcttatattctgcgaaaggaggcttcttttgttcttggctggcctttgtactgatgacaaaactgcatccccctctctgcagaaacttgcgggtgcaatgatgaaacgcgatgtgcaggatttcgcggatcttgactgcttggagaggaggggagagatgcttcgtttgcggtagatagatagggccttcattgtgcttgtgcatagcagtagtagtctgaacttcagtagagttggggcaaggcaatcgattcagtcttcctagtgagcatagagttgggctatcatggcaaatggcatatgcaactgagattgctactacggacactcattcacaatcgtgcgctatttgagcagcaacgggaaatggtttgttttagtagtttagtagtagtactcgtactgctttggatcatagcaacacacatctttcccatgaaaaaactatgagttcttcagattgtgaatatctagcttaattatgagactgcaccacgtttgctacctttggatttggatgcatgaatcccgttttgctcgttctcgacaggagccgtaagacacgatggtttagagagattttaattagagggagatctatcacctcttcaccttgttgcagaacaacaagcagcctccttggatatgcctcttgctgttgcctgaactattcgggttctttttttagataacgaactgtttgggttctacgttttctgttcatgttttgagggtccagaggtgcatgaacacatgtcacatcgggcaagaacatcactattcggtttcgtggttctagggtatcaaacgtgcctctaaatcacggacaaggatgggaccgagatgataaggggatctagtattcccaatgccaagaaattgcacacaggttctttggagtgagattacatggcgccttcctacactgtatggcttgcaaaggcagcaaccgtacatatgctctccacatggaagaacaagaagcagcatttcaccttcggcctaggaaaaggaacatattttttagttcttttcttttttatgcttttgctttcccaaagtgtcttctaattttttttccatggttcctttggcagaggctactctttactctttcaataggtaaacatgaacgctttacagtgctatagtttttgtcctttgcaaggggtcaactgctggactcaaattccttgaatgttggtcagttggtcacagccgatgcattaccgagttaccgaccataaaattgtattgtatgaatttttttggttgtgtaagatacggtttcctcgctagacagaagtgtaggatggcattgctagtcaaatgatcctagtaaaggataacacgaaggctctgggaaatttgtacttacatcttgtttagagcaagtttaatagtatagtcaactactagctccaatttatctatagccaatttaatagctcattcatacaatagttacatactacactattaatatctggtgccacctgtcatacacactgtgtcttagagtctatgctacagctggctacaaatctgtaacccgctgcccttttatctcctcatttatctgcttaaaatatgtttgtagctggcttatagcctgctattgtacctgctcttagtcgttgcataatgaagaatgattgccgttccagtggaccatgctgaattagtcttgttagaactgaaaggatggaatatgatttcatttttagtcctaccaacacatctcctttctcataaaaaaaatgtcttcgtattcctttttgacatagttcgttgacatcagtgcattgctagtttgctggcttgccgcctcttcgagtgtgaaatgataaaggtatgctaggcttcacggagatgaagtttgtcaagacgataattcataaaggctgtgtttaaatctaggggtaaaaatttttatcgtgtcacatcggatatatggacatacatttaaagtattaaacatagtctaataacaaaacaa

SEQ ID NO: 44417 - DNA, 830 bp, Oryza sativa
atttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagcttttttccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattc

SEQ ID NO: 44418 - DNA, 5924 bp, Oryza sativa
ttcctgcagccctatgaataatcggtaaaaagataaaagtatcaactttttttttgcagaaacaacaaaaagtagtaccatctagttcgttttgttcatagtctatttatgggcttggttgtcaagtttcatacagggcacatttatataaattttgttttcgttgcagtatccgaggctttccctcattcccggtaaccttgagatgcttaacacaactgggctcgcggcagatcacaagaaaaataaggagcccatgctgactatctggtaaggccaattttgttttttttcacaaaatcggcttctgagcccagcttacatcaaaatttgttgggcctctgtttgatttgctatcatggctgtgaactcaattcaataagccgaaccacaaaccaaatggttgactaatttctggattgccaattgttctggtttggttgagtttgggcacaaataaacaagccctgtatctctacgtaaaattagacatgtttggcttttaaaaattattttacaagttattcaccttaaacttgctctactagatagtaaaaataaaaatagattgcacacaaaagctagctttggaccctctcatgtatttccatgcctacagcctactagtcgcagtccttgacctgcatctaattattcctaacatcaaaattacttgaaatttgcgtgaccaatccattcaaaaacaaattgaatgacctaattattggtctacagttggacttttattttccaacccacatgagtaccgactactgaactctttgaagagacatttgacattgtccatttgtacctgccatttgagtttgttagacgctctcgtcatcaaaataaggctgtgtttagttcacatcaaaattaaaagtttagttgaaattggaacgatgtgacggaaaagttggaagtttgtgtgtatagaaaagttttgatgtgatggaaaagttgaaagtttaaagaattattttggaactaaagatacagtgcaaatgcaaagcacgaagaaagctcatgcagaagatctggtcttacaaatttgaaaaagccaaatggaggacggatgcgagccgtgtgcttccgtaagttttgactttataataaatgaaatgacatagtatcataatatcaaaacgaccaaatcgtctacaaataaactctatagtatatatgcagtctgaatgcaacgaacaaattaagaaagaaaccccctaaaagaaaatcgatccacatgaactgagtgcaaagcataagcatcaagcaacgtgatggcctgcatggttgatatggaaagcgtcttttgcggcctctaccgacattcagaagtcagcactaacctcccctgcatcctttgcttggatgcatgagacctaacctaattgacctgcagcattaacaatcaagtaggagtactaatcaactcctagttggaacgtagaagacctgcttggatgcttgcaggctagctagctgcagttagcagaggcgctacgctttgtcttagaattttccctttaaacaatttagattttcatacaaattctgaaaatttgatgctataaaatgcagaaaataaattagaaataagaagctaaaagaacctattttttttaactctcaccaacaagttactttatcggttgtttcttctaatcttaatattttccaaacagagctttcatctaaaaaaacaatttatctaaaaaaacagagctttcatcttcgactgttcagcgccatttgcacactaaattatcctcagagcaggtacaatagcagactattaatcagctataaacatattttaataagataaaagatgagaaaaaaaaacagcgggctatagatctatagccagctacagtacggactccaagacgcagagtgtatatgataggtatgaccatatattaacagtatagtaagcaactattgtataaattggctattacattgactatagataatttgaagctagtagttggctatactattagagcaggtacaatagctggctataagctagctataaacatattttaaaaagataaaggaagagagaagagcagcgggctacatatttgtagccaattacagcacggactccaagacgtaatgtgtgtatgacatgtatgaacagataatttggagctagtagttagctaatactattaaacttgctcttacaactaagaacaatgcacgcagtccatgcaaattatgtattcaatcgagacagaaggtgtctatctccaagcgtcaacgctgctgtacgccgtagaagacggtgtgcaacctttaatttgccagcgaaagcttgccatcttgaccccaattaattaactatccagcgattcctccccagctcgtccccatcaacatccagatcagctcgtcaaccgagaaaacaaagaagaactgcaaaccaagcggtagtactagtaccagtttccagaagtacagggcattggcataccgtgtctgaatggcattcaccaaaatctcggaggtcggtagttgatacagcaggacaatgaagagataaataaatacagggagttcttatcctatgctatgcaatgtaaactcccacaactacggaagaagatgcgttcatatactctcaaattacttgttatttatagtatttgtttagtatatatggtttttagtcaaacaattgtaccttcaacaattgatttttgagaaatttatatagtttaacattgtaagatttacattttcttatatttatcactgaacatacttccataatatataatatactccatttaaactttaactacccatctttaaaaaaaacaataaatacttgaaaatatgttatattaccgaagtacatggtgtcataaatataacccaataaatttcatccatcatactataatagtaacttattaggagtaatttgtggtcaaagtgagaccgccgtagtgaatatctatagttattcgagaatagagggggtaattcgcatgttaatatactatatgagtttttgcttgtgttcgtgaaaaaaaaaagagtttttgcttagctgtttggaggggcattgagcatacagctctagctccttgttagtctagtggcggtcggttcgatgctagtctttttatggttgtgtgcgaaggcgattttagtgtgtggtgaggacgtttttttgttctcttttccttggctatattgttttagggttatagtcaatttactcatgctttgttcactgaaacttcgcactatctaggtgccactgttaaaaaaaatatgattgtaaaatatagaattatttaatttttaataaaaaaaaagattgacgtcagtaatacacaaggctaaatccggtggatcttaattttttaaaaggggaagtacagaaggagagagtgacactccaaatctcaaaagcccttttgtttgtgaaaaggaaaaacctggatgcatcatgctcctgcatgactggatgtaggctgtgcagcatcaccaaacttctgggcgcggcaaccaaccaaaccaaccaacaaacaacaaacaaccatgcgtgcgcgggctatctggggtaggccccgcgccgaggatatcaagccaaccccgcacagcaccgcccggcacggacgcgtagccccgtccatccgtgtcgcgcgaccttcacctgatcctgcctccctccccctccccacccatccagaagaaaaaactgacccgagatatgagatatgcatgatcccgttcccagtttctaggcttgctccacgaaacgtgccgccttccctcattcgcatgtgcatctccccaaactttgctaactcttttctcgacggtccatgcatcgaaatccttcgtgaagcaccatccaccatcatgataaccactaatattacgtgtatgtaagagtgtttgtaacaaaaatttagtgagattagaaatatatatatatcattaatttccgtctggtagagcatgtgttaaggtacacgtatataaggtgtgagtccggtgttatgtgtgtagtgatgtgtatgcgtggtgggaaagagaacacaataattaaggatttgtcacttatagtctatgacacatgattaaatatctctggaaactaacgtgcgccggtgcgcgtacgcggtacacctttgcccgtgacttagcgatgaagtcgggccagctagagactgcgtgtgacatgtgcaccgaggcggccggcagcggagagctagctaagctaagctagatcgacgaatcgtacccgagaaaagccggctcgggcgcgcggccaccaccgccgctagctatctcctcgcgcgcgcgaggggacgggacgacgaatcgattccatctcccgtgcgcgcgcggcggccgtcccgtttcgtcggctggtgaatggccgtgcttttcccatgtggatgtgggattttttttgcggtggcgcgcgcgcgcggtccaggtgatgaggagattattcgacggcgcgcgcgtgctgcggcgtacgacgtacgcacgtgtgtgggactgtacgtgaggtggtccagtgcaacgatattgcgcgtgtagcgtgtgcgtgacagcgtgaggggacgtggaatggaacggatcgtcctactgtgactcctgcggctgatcgatctgtgcgatgggtgactgcgacgtcggcgatgtttcggtgccgatgacgatggagttagctgggaatggtcgagcatggtttgacttgaccccacaagtctactgcaacgcaaagtatcaataggaggtgttatgaaacgactgataaataaacgataaaaaataatagatcaatcacagtagacacaagatttaatgtgaaaaactctctcaaagcaggagagaaaaaagacaggtgcaaaccggcaaaatatttttactatatcggagtgaagttataatgccgaacggtggcttacagaaagtatatatatgaaggtaaaaccctccgctttgctccgtccgaagttggccttatcgatcgtgcgtacgtgagacaagcgtctaatgctagctagctcagctgtgggcaattgtgatgatcaggtcaaaccagttaattaaaagcctgtatatgtagcatttttcaactacccttttgttcttgttggtgaatctatagcaaggattagtttcactgcaacttgtacacatgctggttggtagctcagttctattactggtacagacagtcagacgtactagacatcatgcatgtcacgtatggatgagatttctctccgcaggagcaagccacgccagtatgagtatggcagcatgcaatgtctccactaaccttgcccccctgccacaactccaaccccatcgatcgatggccgatcgatttatcactctctcagaaaccactcctgctactccacgacagacttgatgcatgggtcctatcaattctgttgaatagtaaaagaaggggatcacactgtataatattaaacatctctgtaccaattttgttatatatttgtcgacaaatgttctcctaaatatttgatagatgtaattacagtacaatcgtagtgtaattacactgtaaattgtatgtaaactttcatatgattttaaactgttagatttgtttcaagatttatgcaagtgaacaagaaaaaagtcactgtgcgtatatatgtgagagaattcatttccacaacctccgcttcaccgaaatagcatgttacggagagatttttgaaagttatttgtaagttacatgtaattagcagtgtaattacatcacgattgtactataattatatctgttaaatttttaggagaaaatttatcgataaatgtataggtgatctattagagtttcattcatatatactttaacatcttcggcaatttaaatgtgagcttgacgtttgaaa

SEQ ID NO: 44419 - DNA, 3305 bp, Oryza sativa
cccagaatgaggctagctagaagcagctatgactatgatacgatcgagagacgcttcaagactgacgtgaagcgaccggtcgaaagcgaagagaagaaagaatccccttcaattcgttcgcggtggcacgcgcgccggccacacgttcgccgagccgcacaaacgagagatcgagcatcctgcgtgcggtcatgtggcgcgccttctctgcgccctgcaaaagatctcgcgcgcgcgcggagagaatgatccaggtaataacacgacgccgacgtgcggcggcggcgcggtctggaggcggtgtcagcgcgcgtcacgtcgcgccgccgtgcgcgcgcgggcagccgtggtgaaatcgctggctaccccaagacctgttcacttggatgataaaaaaaaaacttaccaaattttagcaatgttaccaaaattttaacatgatttcttatatagttaccaaaatttgacagcaaactaaatgtagctacttttttgataattttaccaaaacttggtaaggttaaaaatgacataaaaataaacaagcccttatttgaacgacgaatttgtctgggcaccatgcgcagattgtattacgtagtaaacctctgtttcatatcacgggttgtttgactctttttacagttaaacttgtttaagttcaaccaaatttatagaaaaatacaataatattttcatcacaaaacaaatatattatcaaaatatattcaatgttagatttaataaaactaattttctattttatatgttgctaaatttttctacaaatatagttaaacttaaccaaattcaactaggaaaaataaataaaatggcttataatatgaaatagatagagtatttacgtgcgactttgtcactttgggtagataaagatataaaaacttaatgaaatatggctctctggtgagaaagcgcagtacttaatacacgcagagaccaaatcgaattatgcatccactataaatataggagtttatccatgtttgaatttggggcaatgtcatccacgatcaggataattaagaagacacggaggagaaaatttccggtcaaccagcgaggcctatagcacgcttacgtttaagcccatcatagttcacctcatatgtgaccaccacaagaatatccttcatttccgtaatccacccaaaccgcctcgaaacagaacgcaaaaacaaacccgaccttgaactcgaaacaggcgcacatcccacacctacccatttgaccgtaccccaaaacaaccgagaaattagcgggagagatcgacaagcaagaaacacacccgaaactaacccaaacacgaacaaaacccccaaagctaataaaaaaagccatcctaatctgaatcacaccgcccctagccgcaaccccaacaaaaaaaaaaaatccccttatccccaaacgcgactcgcgcgcgcgcggtcgcggcttggctaacgacgcgcgacgcgacgcggccacgacgtggtttggtttggtggttacggcgcaacggccggttcagaccgcgagatcggctataaaatccagcgcgcccgcgtcgcaacgaggagacccctcctcccctcggcaacgtaacacaagagaagaagagatcgccatgtccaacgtgcccacctccctccgcgactcctccctcaccgtcttccgcctcgccatctccagctccgacccctggcccttctccctttaaccccatcaaacgcttcttcctcttccaagaagatcacaagcttcttcgtgttcttgttcttcttcggatcactcggttggtttcttggtttcttggtttcttggattgttgcgagatgcacgggaagcatcagcatcagcagcagcagcagcagcagggggggatggtggtggtggcgccgaaggggtgcgtgacggtgagggtgggggcggagggggaggagcagcggcggttcgccgtgccgctcgcccacctcaagcacccgctcttcggggcgctgctcgaggaggccgagcgcgagtacggcttcgcgcagcggggcgccatcgccatcccctgccgcgtcgaccgcttcgtccacgtcgagcacctcatcgtccaggacctccacggcgccgccgcctcccacctcctcgacctcgactcctcctcccaccaccacacccagatccacctccacctcccccgcttcgccggttgcttccgcgcctgatccttccatcatctccatggatgcatcgccatggcggtggagcggagctcccagattgctcttcttcttcttcttcagggttggttggtcgattaattacttagtttagctagttttttggtttccttttgcttcgtcctccgatctctcggtttgttggggatggatttcgattgggtttgtggacgggagaatcggaggacggattcgatgctgatgacgacgaaaaattgagatcgatctcaaaagtgtaaagacagagtaattcttcttagtagctttattctagttttattttttttatcttttttctttgcttgtacatccacttcttgaaacacatcaataatacagtatactttgatcgatatccttgttaatttaatttgtactttgtttttttttgctaattgtttagcctttgacaacgcaattgccacatcacaaacgcgtggattcaacgttatttataatgataaaatacgtcttttttcggcaagcatgttgctttcgcttgaagccttcgacggacggaattaatttcgaaggaaaacttcacacgaaatgagttataattagtagtattattaatctttgcgtgcgtttggtaagaaataatctttgtgtgcgtttgggaaagaaatagtcgctgtactggtttaaagacagaattagaaacgtaagtactttcgttaaagttgtactacaattacaaactcaaattggcgcttcatatattccgttccccacctttctcattactcattagcttattcctaagtaatattctatattccgtgtaatattctttttgaaggaaggcaaaagcttacttttatagtgatattgatagagaagtaaaaacctctctctgataatctctcttgagttttacggtccccgccttgatttaagtttgcaaatattcgggggctaggagtatttacatggtctgcattaaaacaacactgaccaaaaaaaaagttgtgggaactactctccgaaggggataatctgtgaaatttgagggaactactctccaaaggggataatctgtgagttttacggccactgcctttgtggttgttttaa

SEQ ID NO: 44420 - DNA, 35209 bp, Oryza sativa
  unsure (1)..(35209): unsure at all n locations
atcaaaagtccgggtcttcgcataatgacaaccattagcttttttactttgccaccgtaataaaaaccctcaattaggaagccgaggctttgcgttgaagtggaaatgaagatgaaagatgcaactattccactcagaaatattccctcgttttttaatagataatgttgttgatttttaaacacatgctcggctatttattttattaaaaaaatatgcaaatgtataagatataagtcatgtttaaaacattttaaataataaaataactcgcaacaaaataaattataattatgtaatgtttttaataaaataaattatcagacatgtgataaaaaaagttaacgggctcatcaattagaaacggaggtactagtatttaaaaaagaaaagacgaactgacattagggcattaggcttaatcaagtggagtacatgcatctatatgcgccgaaagcctgggagcagaacaaagctgctttccaacgacgtttcctctgttgctgtcacactggaatatcattctacttatcaactgtgctctgctaaaattgcttctagaagagtaggaaaagttgcttaactgtactttagttgccatgctttgcataaagtttatagtatgggttatctattttgataattaaaattagcaaaatgagtactatctggtctaagaaatacgatatttttaaaaaaggaaaaatatttttagagacatgatcaaataatccgtggcaataatacaatgagctattccccttattttaaatttagctgtctaagtcaatcatgtctatattaatttgaccatcattttttaaaaatacatatagttttaaaaaatataaattatataatttcttaggtgattaaaacataaatcttactatcaccttccccaaatgtttggcgttggttagttaagttttgaacaaaccaatgtcaaataaaaaaaaagaaagagtatgatgctaaactatataagtttttacaaatcgatgatcaaatattaaaatatttgacttagagaaaaactgaaaacacaagtaatttaaaaagagtagctaaggacatccacaatgtagtaaaaaactacagcaagcattaaatattctcttgttacctagcaacaagtattgtgagagtgatgaataactactacttggttatatggctactaccgacaacaagtaataaaatgttatttgtacagtgttgatgagtattaatgaattcttttcttggaagagtcacgacagctgaggattggtgagtttttatggtgggctcatgttataccctaccatcaaacaaaaacaatgtggagttcatctcctactactagggtttaatatttcggaccgaaatttcggtcatatcggaccccccccttacgatatcattttgacagaaattttaaatatttaattttttatgaatgttagcaatatttgttcaaatttaactaaattttgtttaaaattttagaaatctcgccatatcggcatcctcttatacaaataccgaaaccgaaagattgagctctgcatgctactactgcctgttgtccggcctacattactaccgagctcggtaggaaatggcctacattatagccctaaaacaaatgggcgtaaactttttatgggctttattgggctgaatgggttgaagagaccgaggtcaaagcgccacggtggacaaaaccagcgccacgtaggacaaaatcgtgtgaaatactgccctaggaccacttgtgaccggttttagtacaatactgccctaggaccacttgtgaccggttttagtaagttaagggacccccgatatctggttttacggtttgaggatgtttttttttatagtgacaagttgagggaccttcggtgtactttttccgaagagaaatcatataggacttaattgaacagttgttcatgggctaagttagggcaaagacttgtttatggtccaagtcagcgcaaacacttgttttgaggtgctcgccagtaaaagtgacagatatgaatggcctcaccaattgctttggaccaatgtatgggcaagtccgattcaaaacaagaaggtactgtactgaagtctgtaactgtgcctctcatcgttttaaggagcatcaagaacttaattaactaataaactgataattccaagagctaacacagataaactagataaatacctatcttagttaacctcaatatagattaacagtgtctgttggatacttggacgccatcatattacaagctaaaaaacctatcctctgctgtctgctccatgcgtgaaactggggcaggaacctatgcaagatttgcatttcttccccttgctaacaaactcatgtatcatccaaccatgcccaatctcaccccaaaaaccatccataacttttcctttgatatagaaagaattagcgaaaggaggaagaaaacaagtgaccagatgatatcttctgttatgttacaccgaaatggcaaaactccgatgccatcatcacagctctgaaaacaatcgggggttcagacttcttcagtcttcagagaggtagccgagcctgtgttctgtgctgtgtgcagtgtgctagtgctgctctgattcatcagcagtccagtatgtcttgaccgccacaaggaccttctccgggttgaagggcccgtcctcatggtccaagatgcggctctcccaccgcatccgcttcgctatcgcctggaccttggtgaggacgtcgaccgtgtcgcggatgatcgccgtgccctcgggcctcaggatcctgtccatctccaagaggatgttggttatgtcacacctgcaatgttgaagaaatgtgcatcagtaagcaggctataaaccaataatgtgatttgcagttttgcacattcagattgccccactaattcagacattattgctggcatgggatcatgtgtcagcgaaagcatgagcaccggtagaaatatcagagatgcgttttcaaaattgtataaaggctagcggtttcacaggcataatgaacagtgctgtacaggccatacaagtcatggcaatgatctaaccagtaccaaaggactatgatgccagtagtcttcatttactacttgctcattttctccatcttttggtgtataattgaaattcagctaatatggagtactcagtactcacagctgtgtagcttaagctatactcgttctatctggattcacctagaaaatgatgcagaatgaacacttgaaatatcttctgagggtaaaactagaccagtagattctttaatggctaagctaaaatcaacatacttgggagggtgtccagtgtaatgcacaaccaaatggtggcagcttgaacatggttaagcagaactaagagctagcagaaatgatatgtagtataaaagtttctcacctgtcctgatagatgctaaacaaattgtcagcatgcaacaggtcgtaggttctgggatacgtcgagaaagcttcacaccagtcctggtacgtgccaatgaatcctcgctcataaattgctccaagcgtgtcccggtctgaatttacgggaacgacgttcatcacccacacagggtacttcactaaagaagcagcaaatccgcccaagtttgcgttcatgtccatgacatttctgtatctcccatcggctatgggtagggtgcgcttgtagtacgccaccctcttttcccacaacttcttgtcctcctcaaatttactcgcatctatccctggaatcatacccctcttcacccttggagggaccgcgaatgccctctgtggccatctctccaaagctccacctgcgatctcaccctggttgcttacttcaggcaatggagtaacacatgcttccatctgcttgtacctgttcacatgaaggggtaaaagaaactaattcagtggcagacatctaaatgaattatcagatagtcttgttggtgcagcgattccataccaggcagcatcaggattgtcactcttgcatatatggggtgtcttatacttcttcttgatgttggcacattcaaggtggttcttaggcttttgccagatggagagatcccccttctcaaccaccttgttccagcaaaggctcctcgcgacatcctcaatattgtcttgctcttccttgaggtcttccttagtcctctcccaccccttgtagtgtgtcttccaattgatcggaggacccgagagaatccagtatcccccgggccttagaattctgtcgacttcagctaggtatattccatctaacaaaaaattcagaacatccaactcaattagtgaacaatatttggacctaaggatagcttgaaaacttggggcaagatacattgaaaccaattcaaatgtattgaagtgctcaccaaactcatgccaaggaatcaagcagcgtgaacaatgtgccatatcaaatgacctagatgggtaaggcagccgttgctttcccatcacgccgatgatggccggcacaccccgctccagcgcgaattgcacctgagcttcatgggtgtccctcggtgcaaacgacattgcaaggatgttcctcttcagcaagtaagcaccccagctagcaacctgcaaagaagatgcaaaagcatgagcacattgccacgacatcaagaaacctgaagctagatgtttcttctgatcttctccccttaccccgcaacctgtgtcgatcgccgtcctgatcttcccgtccgtcaacgagatgagcttgccaatgtcgtcaatgtaggcgtcggcgcctcgcgggaacatggtgccgccaccggggaaccggaacctctggccgtccacctggatccagttctgcacggccttctcgatgctgagctccttgtgggggatgttgttgaaccaggcgaagtccctgctctgcggccacttgaacggcgtcctgtacttgggcggtgccgggatgaggcaccggatctcctcgtccttgccggggcaatgccgctcccggtacaccagcatcgcgcgctcgaaccgccggccgcgcttcctgtcttcgcacggcgtgtactcgctgaagttgagcgggcacgccgggaacggctgcaccgccgcctcggcgcccgtgtcgtcgaggctgagctggtggtgcgcctcgaagtcgagtgactcctgcgaggccgacccgaacgacggcacggcggaggactgccccgccgccgccgggtcgcagccaaccttggtgatcgccgagctcgccgccggcttgggcactgtggtgttctgccacgcaccgaggacgtagaaggcgacgcagagcgcgctcaccacgaggatgtaggtgagccgctgcttcttggattcttgcagctgctgagctttgggggaggcaggatactctttagccatggctgctgcaagtttcaagaactcgtcagctaggagcttaatttagctgaaatctaagctttgttggatgcagaaaaaggcatgaaattgaagaacttgagctacaattgcctgatctgagctgaaaacgaaaagctgaattgatatgcaaggctctaaagttgcctaatggatgaattggagttgtattactggagtatggtacaaatttaacactatcttaaaaattccccatggcatgtactgcagcacactaattgtggcaccaaccttagtactactagtgaagatcacatggcaataaatttcggattacaaatttgaatatggagtcaaatacaacagatcattgtaaaactctgggatctaccgagcaaaattgtttaatctgactactgacaacaccaggaaacatacacctgactgtttgtcttaaatttattaagctgcagcagttgaaacaattcaagactatgaaaacagacgaacagatagcattcaagaaagcaggaggggacgcaaaataccactaataactgtagatcatgaaatgattcttaggaagaaaaaaaaaacactatgcttcactcaagaggaggaaactacacagaagcataggctcatgcttcttgctgaaggcttatgcttcaccaaaatcagtacaagcaagatttatgcttccagctgaaggcaaagaaagttgctactaggataaagggcaaagaggctaaagaagataaatattctaggcaaaaggcaaagcggaagcagcaagatggtggcagctaagcaccacaggccacagagatccagaaaatctcacagaaatggcaggggcaacccacatgaatgccacaccacccagcggtagctagcacctccattccccaatggatccacacacaccgacaccactccaatccaagaaacaatacgagcaagaaaccaagctgaaaaaactacggacctgtagtaaagaagccagctcaggaagaaagatgaagcagagacccctcctcttctcttcctcctccagaggctgagagggagaggagaggagcagcagctctgcctatttatgcgagctcttgcactagcaatggtgaattggtgagtgagtgaggcagccactgagccagtggagtgaagtggtgtgatgccaaacacggtgtcacatgtcagcagcggcttccttcctcttcccagctaacccaacccccctttcataaataaaggagaggaggatgtgcgtgtgaaagggggccatatgccgccatggtggccatactacacccgcaggggcagaaagatcacgccgacacggggattaaaatagggtggaattgggcaggaaaagaggggggtgccccactaccaacaccaaagctagggttcttggagacctctgtttcttggctcacgtggtaatggcacattggtacagtggcagtggaccaaaatgtccagatgaccaatggaaaactaaattcagaatatctccttatttctgcatgtcacttaaaaagttataaaaaaattgaaaaaaattagtaggatagatcaatatgttatatgtcacttcacaaacatgcaaattcaaattcaacttatacaagtagaaacaaaaataacaaatttgactataaatagaacgtgtaattcatggtcaaatttgttatttttgtttcgaattatataagtcgaattttaactcgcatgtttgtgaaaagatatatcatatattgatctatcttaacaatttttttaaaaaaaattaatatttttttaaacgacatgtacaaaacgagggaatgtcctctggaggaccaatatccacttccgatggtgacccagtagtggatttcttggtttcctgcgaggaagaagagccccggtctccggtccttgcaattaggcctcttgcactgagtgtggctgtggctactggctggtattttgctgacgggttatctatgttctttaataagctaaaatgatttattagaaaataaaaactaatttataggtaaactattgtatgtgtgtcattagtgacttaaaaaccaatatgaaaaaactaatcttgaaaatatcttaaaattaacttctaaattaagtttgaaaatttaaattatagctttgactttagtttaggccaaccgatggagcctgaatgttctagcgctattgttttccgaaccgtcttggacatctgagaaactcaccttcagtggttggattatttttagctcttggggagggaaacatggaccaatcatcttccatttctgtgctaagcttcggtttcaaggtgtaacagttgggacttgggagtttgtgacgctaaaaggaaaatcacttccactatgcagaaagatcaaaattcaaaagtgctttgctttggttcttgtactttattttttttgctttttcttcgacaattcacttctcaaagcattgcaccaacagtaaaaattcttttaggtattaaaaaaaactgtctaggtcatacaaaactatagcatgactattctaacaaagagaagggggaattctagcaatcgattttacgataaaaaatgagcaattgcaaccatatattaatcatttctaccagaatagggatagttcgtctactttagaagcacaatttaaaaatatgaagaaacgaccacaagatacataaaccatacatctccaggatacagaacaacaatgccacaggaatcatcaacaaaaggaatgcaagaactagagaattggaatttaccttcagaatgcagagatcctagatcctccctgtgacctcagcaattgcgctctgccgacctcacagccaaattgtgaatttctatcattaatctgggcagctttgcccggccatgatggtggttgtttgcagtagaagcaggggggtaaaaaacccaaaaaagcgcaactttttagctattccctttttttatctcctcacaccaacttcctgacgcttttaccctttggctgccttgcaaaatctgcatgcttggagtggacaggatttggtcaatggcgaaacgacaacgcacacagtggttttttttggagagagattgtcggccctccatttgcttccctgcattttcatcgtttttcagctttttcttttgaacttaaaaatgaatcttgacagtggatggaaaaaaggatgcttgtttcatgatgcagtatgatgcaggaggtgatggagtagtgtcggtgcaatgaaatgcatggaccacaagcaacataatacggaatctctatgcctttgtcacacttgttctgcatgatgatattttgcatttgatttttttttaggataaagagatatttctgcaagtgattttactaccaaatactaacagtttctagttcatgtctccgctataccaacagtttcattacagaagattaaattaaagttaaaaactaaaaaagacgtgaacattaaggaagaacttaatatcaaataataagaaaggggtgagacttcgaacccagttcgtctaacctaccacattgtggagctagccggaagacccctgggtgtttcttaattaaagttaaaaactatgccaaacacatcagtttttttacggatttgagaggatttttaagaaataattgaaaggggtcaaggaatttacgatcatccagatatggcttgaaaatattgagaagaaaagactacttcgtactatatgatgatcttgcagctggaccaaaagcatttgtggacgatacaaatttttggatcaaaaggacaacgaaacaaacaaaaaataatagtaaaacagaagatttgcacgcaaccggaagaatctcaacaaaaggaatgacatcttcctcctttctaccgaatcccgcatcgaggtacctagggtttcatcaaatccatcaactagaccctctccctccccttcgtgcgatcgccacaaagaaaaaacgcaagcgaaattgctagtgattccagccatggatccactcacctcgaggatcaaagtagagctcgaagtcaatccgcgcaaccagggaggggggagagagagagagagagagactcgcctccgatgatctcccagttcgttgcaactcgaacgcttttgaattttggagaagcagatgagaagagaaaagctcggtgccgccattaatgggctctccgtacaaaaagaaatccaaatccgaattctccaagcccattaggcccagtagtagtaagcccacgaagcgagggcttctcgcggcttcgcttgaggcggagaggcgccgccgccggccgccgcgatgtcgctgccggcgcggctgctgctcgcgcgggggaagaccacggcggcgcagcacgtggcggcgcggcacctggaccacaccttcgagaagctcgcggcggcgcacctgccgctcgtcgcggcggcgccgctggtggacgccctgcgcgcgtcgcccgccgagcctctcgcgctcccgggcctcgcccgccgcctcccgctccgcctccaccggcggggcgcgctccacttcctccgcctcttcccgcgggtgttcgacctccgcgccccgctcccgctctccctctcgctcaccgcgcccgccgccgagctcctcgccgtcgccgcatcccccgcggcggcggctcatgccctccaccgcctcctcgcgatgtccgcctcccgctccctcccactccgcgccgtcttccgcgtctggcgcgagctcgctctccccgacgacttcgaggtctccgtcgtcgccgaccaccccaacctgttccacctcgctcccaaccccgccgagcccaacacccacatcctacacctcgtcgccgatccggcgaccgaggagttcactccggcggtcgacaagacacggccggagaaacacgccttcaagctgcagttcccgccgggattcaggctgaccaaggaataccgtaagaaggtgaaggagtggcagcagctaccatacatctcaccatacgaggtatcaattcagaagggtgtgggaagcaagagggtgtctaagatggcgaggaagaagatggagaagagggcggtggggatcgcgcacgagttcctcagcctgaccgtggagaaaatggtggaggtggagaaattcagccagttcaggaaatggttcgggatcgaggtcaatgtccgggacgtgttcttggatcacccggggatattttacctctcggcgaaggggaagcggcacacggtgttcttgcgtgaggcgtatgatcgtggcaagctcattgagccgaatgatgtgtcggaggcgaggaggaagcttgttgagctcatgctcctccgtcgtcgtgggcttgggaatgccaattcaaatgctaacatggcttcacgtgcctgtgctggtgctaaagaagacacaagtgatttccaggaggaagagatttgatagttatgtccaagaagctggaggagaaagtatgctgcggatttcatggacaatctttcgtctaccataacctgttcaacaggtgcttggactaccttgagtggtgaagatgttggtgatgcataatcatgggcagtaaatttcgcgtggcatccattaaccagatgagggatatggatttttttcagggatttatgctcattgtttggcattatctgttgatgcaatgtgctggactgagtatagttctggttgatgctcaaaactgnnnnnnnnnnnnnnnnnnnnnnnntgattggtaggtcagaattgttgttgaaatgtagcggcaattacatgtccgataatgtttttttttcccagtatggcaatttgcttctgcatgtggaatagtatcaccaagtatttaccataccagaatattttagtcggaacacatccttttatctttcactagtttattttcataatgaaatgtgcttcatatagttcatctgttcttgttagctcaagatttttcatgcccctaaaccagtcacatactttactagccttgtttacagcattgggtacacgaagatggcatttggcatttttttttcttcttcttgattttctagctttataagttcctaccaaaatttctacagaagctaacatgacaaattgtcatttaacaggtctacaattacgccagagcaaaagcagtgtgatgaaagatcttggctgaagtttgaaattgaatatcccttgtttcactggagatgatgtgaaccgaagatgattcatataaactagagaatacaaaattgcctttcttgctactgattgtgaactgcggaaggccactgggatgtgattcacaataccacgggacctatgatcaaaattgcagtcatctccgactagagaatcctgtagtttttatcgacaaactaatatgcatcagttgtcattacagcagctcttcatcatatacagtttaacttttgagtgtacttttgtcgctgtgatcatgcccttgtaacagttatcccatatgtctggatgtcttccttttccagtcagtaaagatgtacatttagtttgactgaaccagggtccacaataccgacgaaaactgatcaaaatataaaccactcaatttctcagtcatgttaaaaaaataaactgaatctttgtttgacaaaatttatctggatttcatcggtatttgtcggtttatcaacgtttttccgcttgtgggcaatttttcatccgggtatcggaattgcgaaccctgtgcagaaccaattcagtatctaacattaaatctgcccaggtgaaactaacttaaatatatcacagtgattatacacattcctacttcttctaatatcctaccttaaatcctacctagctgtatacacacacaagtcaccaacatagctgcagaattacaagggattatggatgtttaggagtgaaactcttgtctgcagcaacctcctgaacaccttctcgctgccactctccatctcaccaatgcattcttccagctcctccagtttctccaatgccggcgacgccgccttcttggccgcccgagtcacgccaagccacgcccacttgtgcgatgccgctgtctgcaccatggccggcacgtcccgcgacattgccgcgcaccggaggaggatcgcctccgacgccgccgcggtcaccgcggccgcctccgccacgatgccgaccacctcgccgtcggcgtcgttcgctgtcctcgacgccgccgccggcgtgcgccgcaccgcgtgtcgcatcgcggcggcgaggcggcacagctccctctccgtccgccggtgcgctcggagcgccgtggcgaccgtcgcgccgtcgccacgccgcgcgccggcgcgcagctccgccgcgctctgcctgagcgcgagcaccgccgactcgaacgtgccgtaggcgtcggcgagcgccaggaacccgtcgagcgcgcgctcgcatgcggcgccgccgccggcgcggtggatggccgccgcggcctgcggcagcccaagaagctcgccgagcaccgccagcacgtcctccacgagcgcgagcccgtcgcacctcccgtcgccgtcaacaccggacaacctcgccgcggcggcggaccatgacctgagcgcgctgatgccgccgtcgagccgcgccacgaccgggtgcgagtgctccctcggcaagctggccgacctcgccgccgccggcctgatcgtcaattgcattccaatcatcgagctcaccgctgctgctgccactgatcaggtcgcttcttcaatcttgatcggtcgaatgaatccttcgtgttcgtgaggaagacggcgtgcggggttttatacgggaggcggggggcaggtgatggtttgcacacacttgcacgttgaaaaatagagaaatcgttggctttttcgtgtgttggctaaggtcatttggcttgggcagctcggcttgcccactttggagttggtggtgcggtgcacggcgccacggcgagctgctgtttttctctcctccggcatgagcgcaaaactgctaatctaatctgctgctagtgcttagtactatactggtgtcagcatgagctttactgggaacagctgtgactgcctaaatggcttgaaaaaaatggcacatggataggagcagagtttacgaaaccgacggcaccgcgcttaccgccgagatacggtaattggtaaggccacgatgaattcaccaaattcaaataaattttaaaaataattagattttttttatgaattttgtacgttcctcttgggtaaaccgtaaccgtgcttatcgttggggtgccgtaacaccagccccgaaggtagggaaaaacctggataggagtacaaggtgtaggtgagctggtacatcactctagcagagtcagctccacacttatatttgaatttttttgggagtgacagatggtattatactactactactactatactccatgttgttgaattattttgtattgtatgaatttaaaaaattccatctccatgtcagctgtgcgctgcgctgcactgaacttcctcccctccggtttgtcaggtccgctgttttcttcacctgccaaaacctcccaggtttcagagaagagccacaaagcctgttcctggttggagcttatcttaagctcaactactaaaggcaaggactctttagcctaatctaatcatctccaaagattaaaagaaaccacttgattttgtctagtattctagaaaaggcagataaaatatcaatctgacccaatactggcaccatagccttggtagtggttgttcagtgcacctgttcctgtgtcatctctcggtgccaacaattgcgacggcacgagagcaagaagaagacgacgacgacatcgctgaagccactaatcctgtcctgtgatgtgcacacgcccaaagatggtggcgccaatagccaataggcgcacgcacaatgcttcgacccgtcgcgtccttctccgacgagaagcaaagccactgccatgccatgatcaggctcgaacaaggtttggttggatcgatcgctgggttggatgaatgcgatgtcaggcacggcatcgcgacaaatccaccctctgttgcggttgattcgcactgccgttaagtcaggtgactttagagtgacatatgagttctcttttctatgcacccatatatcagtgattataaaagttatttgacttaaatcaaaagatctcaatccaagtcgaagtcgataagtaagaagatttcaatccaaagctgtttttttatatagaaccctgagcttctcaaaacaggtgtaactttttagcatgttttgtcagacgataagaaatcgtttcggattgactagccaattgtagattgttcgtgcgttgtaattggaaactggaatgtaagtcaaatagacaatgtggaaactgctcgtggaaccagccattgtggactcgaatagaaatggatgtgcaaaggggttaaatatcgaagaatgtatgaaaatgaagatgtggtattggcacggcaaaattcagaattttctctgtttctttatctgagaaattacaagggattatgaatgttaagaagagaaactcttgtttgcagcagccgcctgaacaccttctcgctcccgctctccagctcgccaatgcattcctccagcctctccaatgccgccgccgtcgccgtcgccggcgacaccttcttggacgccggtacgacgtgcaggtgcagcctcgccagccagtttttggatagcggcgagctggccatcgacgacgacatgtccggcgacatcgcggcgcaccccaggaagaccgcctccgacgccgccgcgatggccgcggccgcatccgccaccgcgtcgcccacgccgtcgcccgtggtggcgtccgccgccggcgtcctcgacgccgcctggcgcatcgcccccgcgaggcggcacagctccttctccgtccgcctgcgcgcgcgcagcgccgcggcgaccgcggcgccgtcgccgcgccgggcgccgcaccgcgcccccgccacgctctccctcagcgcgagcagcgccgactcgaacgtgccgtacgcgtcggcgagcacgaggaaagcgtcgtcgcgcgccgccgccgccgcctcgccaccgtggagcgccgcgacggccaccggcagctcgaggacctcgccgagcgcggcgagcacggcctccacgagcgcgagacccgagctcccctcgccgccggagcgggacgtcgccgtccacgacatgagctcccgcacaccgccgtcgagccgcgcgagttccgggtagtggcacgggtggctcgccgtgcgggcgtgcgccgccttcctcccagggctaagtgtcaagtgcatcgctgcgtagtcgtcgtcttcgtgatcagtagtaaaacgaagcgacggcgacgaggagtttatattatacgcgacgggaggcggacgcgcgggtggttgcgagttgcggctaaaaaaaatcgcgggatttcacatgacagcgtgggtgtttttttgcagttggcacacggcgccgcgcgcgctgctgtttctggcattgtcgaccgaaaactcggcgttcgactggtggtatcgcggagttgacaccaatattcagtgggaacagctcagaagctcactgcctataggctaaattatagtataatttttcgggtgaaaaagtaggtgcggcgttgacaggattgtcacgatattaatacgatgaatcgatgataaaagtaaggcacaggtacaggtgatctatcagcgtcgctcgagtcgtcggtttttgaagttgttcgtgcggccaaaaccagaaaccacagcgtgcacaaagggtggaaggctaagcgaatcattttatccgggataaataaattaatgggaaaacgaagccatctgctgcttttctggtcggatcggaggtgacccgtgcagccctgccgccgtgctgcggatgcgggtgtcatccggggaagcgattttggccggcgagtccggtcgtttttggcaaatccaagggtcggtgacacagttgggtacacgaccactctcccatccatgatccgtctctgcatctcgcagctcatcgcgacgcgaaatcaccggcatctgctcccctattggctgtttccaccggccagcgccgaacgtttttgcacacgaagaatgtgctcgtgtgaagtaacttcccacctgacgtgatcactgacgtggttggcacgtgaatggtgaggcctacgtagccatccccaacccaaaaactatcaagtagtttctatacttgccatgtcatataaacactctgtgtagaaactatgtatacaatggatgctgtctttaacttaaattctcatcaaatcacccctcttctctctccttttattcacatatcatcttgtttttattcttggtactttatgtagagatggttttttacatgaaaaatagttttttttttatctttttacctctctctttattaactttcttgccatataggatttttacttatgtgacgatgtatttaatgctatagaaactagataacatggaggattaaggatggcctaaccgcctaagggaccaagtccctctaaggtcctattcgtttccactgctagcagtggatgaaattttggattttcgtggcacgcttttcaaactgttaaacgttgtgtttcgtgcgaaaaatttctatatgaaagttgttataaaatatcagattaatccatttttcaagtttgtaataattaaaactcaattaatcacatgttattaccacatcgttttacgtgaaatacttaattttcatattctaacattacgttaaaagatcttgatcgtattactttagcctataaacaatcatgttctaattgtgaaaataaattctctaacctggattagaagccattggaagccgatatttgttttccttttattcctctgttccttcttcttattcacctgcacgggaacggtttgcgctacgaagcatcccagcattacgcaggatgaaaacacaagcagcgcacccattatgtaatcctttcgagaactgatgtaaatcatatttatcttagaatcttcagctctcccaataatacaaataccgacaatttgagaatatgtaattatataaccctgaaaatgaacaaaaagctacaatttgggaatcctagcattttcatattttcactagctagctacttcttaaaatctcgacctccccaaacaggggcatagtatcttcaagtagtacaagctcatgacaaagaggatgaacattgcaaggttgcagactagcagttgcggtactagaaaagttcaagaatctcaaatcaatttatgaaatcaaactacacacataatgttcttgactccccacgtacttacggaataattatattggcatacacaaaaaccggagctaatcagagtagatacacccatagacaagccatcagacccaacaatttttttgtccatgaaacagccagctaatgctaatagacaaggggttctgatggaagatacagctaggccacatctagaagcacttcctgtggacgatagctgggccagattcttcatactcagcccttgagatccacatctgcacaaaaaaaaggaaagaaacatatgtcaagaaccttctcgaacaatctagaaagtgtatcaagaattaactgttggatgattttgcattacctgctggaaggtgctcagagatgcaaggattgatcctccaatccagacactgtacttcctctctggcggagcgacaaccttgatcttcatgctgcttggcgcgagcgcggtgatctccttgctcatgcggtccgcgatgccagggaacatggtggatccaccactgagaacaatgttaccatacaggtcctttctgatatcaacatcgcacttcatgatggagttgtatgtcgtctcgtggatgcctggagcttccatgccgatgagagaaggctggaacatgacctctgggcatctgaagcgctccgcgccaatggtgatcacctgtccatcgggcagctcatagctcttctcaactgatgagctgctctttgcagtctcaagctcctgctcgtagtcaagagcgacgtatgcaagcttttccttgatgtcacggacaatttcccgctcggcagaggtggtgaatgagtaacccctctcagtcaggatcttcatgagggaatcagtcagatccctaccagcaagatcaagacggagaatggcatgcggaagggcataaccttcgtagattgggactgtgtgactgacaccatctccagaatccaagacaatacctattgacaaaaaatatcaagaaacaaattacgagagaacataatgacagtttttgtgtattgtaacatctgtaaaacaaggcagtaacttaaattttatttggtttgaatggttcaatttaagtttactttagacaatatattgctaattttggttgtgagcatagcatttgatttgaacatcacccggtttgttcctgctctattgagattccagagtagcaaaacagaatttacaaatgaaaatgcttattctttgttcacttaccagtagtacgtccactagcatagagggaaagcacggcttgaatagcgacatacatggctggaacgctgaatgtctcaaacataatttgtgtcatcttctccctgttggccttagggttaagtggagcctccgtaagaagaattggatgctcttctggtgctacacgaagctcattgtagaatgtgtggtgccaaattttctccatgtcatcccagttgcttacaattccatgctcaatggggtatttcaaggttaggatacccctcttggattgggcctcatcaccgacataagcatctttttgtcccatcccaaccataacgcctgtatgtcgcggacggccaacaatactcgggaaaacagcacggggagcatcatctccagcaaacccagcctatgaaaaatgaaaacagttaatacttgatgagcttctcaattgtaacaataattaccatcaggtagaaattttgttcaacaatgcgatgccaagtcatcactttttattaccttgaccattccggttccattgtcacagacaaggggctgaatgtcctctgcgtcagccatttattttaactgatctgcataacacaaaataaatcattcaaaacagtgtttacaaagactatagattaatacagaaaaatgtaacttgaactaaacattcatcctacaaaaacacgagtcttcatcaaacatgaatgacaaaatacatgtctttaagatatcacattcaaagctattaattgactaactagtattgcaaattgtgaaagagggaggattattcaaacaaaaaggaaggcgcagataggaagaagtataacactttagttgtatataggaaactcccaaaatgaatggtccatgatgcgtaaattataactagatcaagtgacttgtagttaagaaattcaaatcaatcaaccgaggctggtctgaatcaccaaccctccaaaggaatggtgctctctcctaagagcatacaatgcaatgtgtatttgaatcgatttagaccaatcttcagggagaaaaaagggacatgcttcagtggatgaaatgaatgcaacatgatctgctcatatcctggattgtctgattggttgatctgaagcattattttttttctgatcagacagccgtcatcaagatgtgaagcatcttagaatagtggtccataagcatacattttttagtacaaaatttaaactccatgatttctgaaactaggcagttttcagttaagcaacttgcttctttaattcagattttagaagccatgtcacataatgaaatcgttggtatgcttgtgtttttgtgtgaactatgaaatgttttgttgaggagaaaaaagtctcaaaagaaagtcgatcggtacagtactgaaaactgtttttttcccacgccaacaagaaagcaaccgtggaaatgaaaagaaaggaatcagctttttcacaagtccccacctacggaatgaccaatcaagacagtttcttgagtaccgcaaacaaaccggctatgagcatgcgaaagtctgtcagttgatctacaattcagagaaactatacccccaacttcacgccttaggccttgtttagttcgcgaaaagaaaattttttggtgtcacatccgacgtttaaccggatgtcggaaggggttttcggacacgaataaaaaaaagtaatttcatagctcgcctagaaactgagagacgaatttattaagcctaattaatccatcattagcacatgtgggttactgtagcacttatggctaatcatgaactaattaggctcaaaagattggtctcacgatttccatgcaaactgtgcaattagtttttttaatctatatttaatgctccattcatgtgtctaaagattccatgtgacatttttgggaaaaaattttgggaactacaagaccttagcacaacacaacataaacacgaagagatctactgcaagactactcgtcacctcagcacaaacaagatcggatacatcctcaactaaagcaatggatcggatcagcattcaccaagaacaacaaacaaccagtatacgcgcatccctgaactcctacagtccaacggatccaacatttgacaacacacaagcaaaagcaaccagccacacctacttcagcaactcagttcagtagttcacccatctaacagaactagaacacatctccgattgcaagaaacatcaagcattaaaacagaaagcaagcagggtccgggagggcctggacatggagaggcagttgctcacctaaagaagaggagagaaccgaaccggggatggcggcggcagcaagaaggaggcgaatggcgtgggagggaggagggggagggcgagatataggagaggtggtggcaatggcgatggtggtgggaaattgggggaatgagatgtaaagaggcgccggcctcactggaaagttgagagcttgaggctgtctctgcgctgcggccgtgccaacgcggaataatttgctgcactgcacacctgggccaacctagaaaatctgccttttttatgtttactcctacgtgcacatcactatgtacccaatactttcttattctattaaaaaatgatattttatcattttgcttttagaaataaatagtagtggttgatttttttttttacagggatggaatggaaccctcactgctatggaaggtggacatacacactagtagagagacgaatctaaaacgaaaatatcgaggagactgatatgttaaagtcataactaacttaagcatattgaaactatgtttgtcgatctactgtcaatcaaatttctaattcacactaccaaaacataatgttaataaaagaatgtgcaacatgcattttttttattttgttgtacacgcaattaatagttcggttagctataaccaaatgcagctagtatagctttttcagccaacaatccctcgctcatttattgttataatgcatcactatatcatgccaacatagggtacttggtagaacatgtttggctggctagagctgaggccgaagccccaacaagctctaaaaatagacatatcactaaacgtaaactcaaggaatcaaattagttgatgtaggcatggaggatccctaatagagagtagtttaagacaagaaataacttagaaaggagagctttaagaggcaacggcaacacaacagccgttaccgatgcctaaactagaatggttcttttcaacgcagctcttgattaaacacacatactaaactgatatacaatgtaaccttgtggacgcgtagcgatttctctttttctttttcccatgcgtgtgtcaaggaggagggccatcgatcaactgtttgtacaaactttgcaatctattcttcgtactaccatcgcatcttccttttttccccttgttgtcgtatgccttgagctgtcgctgctttcggttgctacctggagtatgaaggccctgtttagatgtgactaaaacttttaaatccctatcacatcggatgtttgaaaattaattataaatattaaacgtagactattaataaaacccatccataatcttggactaatttgcgagacgaatctaatgagcctaattaatccataattagcctatgtgatgctatagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccaccgaagtttggcacagctctagctctagctccatcatttctggagttggagctcaacaaaacagtttcagctccaccaaaactataagtgaagctgggtaagctctctcataaaatgaattagagttgtagagttgggtttaggcagctctataactttattatagacccaactcttaaagtgaaatttaggagttggagctgtaccaaatatgcccgaagaaaaaacgagcacatgaatcaagctacgaaagatgaggtggtggacggtggcgctggggccctgcaaaggaataggcaaaacaaaagcgattgggtggggggcaccacggcagccttttcataactttattattgcttcgttttacagctgctttacggctacgcctcccttccatccggccaacgtttttctccctccgtcttgaaacataaagaattttagataaatgttacccatatagtattacgaatctctatgatattaggtgtatttagttcttctggtgtaaagtttttaaagtatacggacacacatttaaagtattaaacatagactaataacaaaacaaattacagattctgcttgtaaactgtgagacaaatttattaagcataattaattactgtagcatcacattgtcaaatcatggcgtaattaggctcaaaagattcgtctcgcaatttacatgcaaactgcacaattggtttttttcgtccacatttaatgtttcatgcatgtgtccaaacatttgatgtgatgtttttggccaattttttttaggaatctaaacaaggcctttggctttctatccaaattcatagtattatgatgtgtcacattcatctaaattcttttatattttggggaaggagggagtagtacccagggttcacaattccgatgaaaatcggtcgaattccgtgaaattttgaggtttcgacgaggctcgaaagtagaagccgtatgagatttcgatgagtttcatctaaattcaaatttaaattgataaaaaaataaaaatcaaataaaatcttataaatagtatgatattcatagaacttattgggttataaatttttgaaaaaaaaattgatgtatcgtgtgtatttactgaaatttacgagaggaaagtaaagaataatgaactaaaaaatgaaaacaatttcagtttacctctttttctttttctagttaccggttgaaatttcaaagatttcgctcggaatttcaccaaagctggctggttttcgcaagcttatcgataaactcaatgaatttgtattcaaaatttggtttatgaaatttgttcaaaatctaccggctttccaccggatttcacgaaaaccgccattccgccagagcccgaaacggaataccatctcggaatcgtaaaccctggtagtaccaccacactttgctccttggagggcgtcaatcctctcatctttctgcatcctttacattttaatctttttttaaaaattttgttttacaaatatgttcttgcaaaaacttattttagaaacagactttttttctcgacgcttgcaatgaccctagtgtcggaatttcaacgtcttggtgccaatgatgctagcacctacacgctcgctccctgtaaaagttaagtcactgatataaagggggtcggcgaccatgacactggtgctgagaaaagggtatgtttctaaaataaatttttatagatgtgaattcgtaaaataagttttttaaaaggtgctaaacataaaaagaaaatccagtcgtccttcatcagtacaggagtacagcaatcatttttttttcctgaagtctgatttcacgctgcgatcacttgggttggttgttgacagtggctttgctcatggtgcgtcttttttatgtggcttttgctcacctcacctgattcacttgctgaagtttgtatgagctttgctcacttggtacgtttgctgtaagtctgaatggtgagatcagcaatgagattgacaccgtcgaatcaacgaatttttttatttaaatatttacataaataattttctatttgaaaaatttataaaactagtcacccattgtcgtctggagctgccaaaggacaattttgccgacttggtagacggccgttagctctcccataacggccggccatcaaggacgccaaaattgtctaggccggccccttgccgccctctagaacggtggtttcttaccgtgcggggttgcctactgcaaaagggtgacgagggtgtcttggcattcttacggtcggcctccttgccgttctttgggagggcaattttctacagtgcggggtgccgccggattaaaaggtagtaggggtggaattttttcaggcagcccacttgtcgccctttgagagggctattttctactgtctgaggggctgcatgcaataatgtcaggccgccctcgccgccttttcgcaggcggcccctgttcagtaaaaaaatcaccctcctagaggacaacaagggggccgcctgcaaattttcagcgtccttggtggccggccattatggaagggctaatgactgtctgccacgtcgacaaaatggccctttgggagtgcgatgaggtattaattttgtaaattttttaattagaaaattattatttaaatattttaataaaaaaattccgaatcaaccgtcatgcaccaccaaccagcagcccaatgcaccgaccgcccatctctaagcccatttgaccgcgatggcgtggcccatgccggccagcccaaatttcgccatttctaagcccatttgacctcagaattcggaagccttcgggccaatggccatgctaactcgattggtacatcatgtttctggtcaggaataagttcatctgtggtcccttaacttgtcaacgaatccgattattgtccctcaaccggaaaaccagatacaacgggtccctcaactatcaaaaccagtacagattaggtccctcggcggtttggatggtggttttgactgacgtgacacctacgtggctaatttgactcggtcttcatatggtgtggcagtgacatggcgcttacgtgacaattcgatttggaaaataataaaaaatataggccccacatgccagtttcatgaaaaaataatttaaaaatggtggggccgatgtgggccccacatatcattctcaccactcctcttcttcctcctctatcccaaactcccctgtattcatctctttccccctcttctctgtcctctcttctccatgcatgcatgaggagacgcggcgcgcggcggccaggcaaggaggggcggcacgcagcggctgggcgaggaggaatgcggcctgcggcggctgggcgaggggggggggggtgcagccgggcaaggagagaggcggggcgcggcggccgggaatgagggatgcggggcgcggcaaccgggcgaggaaggatgcggcgcgcgggacgcagcgccgccaccatggcgcgatggatatccgacgaaccgtgcgctcctcctcctcccccggggcatcagtttcgtcacatccttcgagacagtcgcggtgacgtctcactgcattgcctgtcgtatcgtcttctctctagcctctcttcggtccaaccagcgacgagaaatgcagagactccagtggtgctgtgaggattttcgcggcttccggtctccagcgaggtcgccctggccgcagcggtgcgtgccctccacccttagtttcgttttatacccaccacagcggtgcgccacctccctcctcgcccggccgccgcgcgccgcctctcctcacgcacgcatggagaacagatgagagaggagaggggtagagagatgaataaaggggagttgaggagagaggaggaagaagaggagtggtgagaatgatatgtggggcctacgtggaccctaccattttaaaattattttttcatgaaactgacatttgaggcccacattttttttattattttccaaatcaatttgccacataagtgccacgtcactgccacgtcatatgaagaccgagtcaaattagccacgtaggcgccatgtcagcaaaaaccgccatccaaaccgccgagggacctaatctgcgccggttttgacagttgagggacatgttgtatctggctttctggttaagggacgaaaatcggattcgttgataagttaagggacctcggatgaacttattccttctggtcatcacgatgatcgccggagaaaagctccagcgccaccgttgaggcttcttggtggaccccacatcgccgttgccggggaaggcagcggttgcgagacccataacttccttcaccacctgtcacgaactcgccacaaccactgaacgtctcgcctagtgaagattggttcaggaattagagatatgatcatcagatttagggatttgtggagaaaaaggcaagagaagcataggagtacgaaggggatttgatctctattcttccttccccaccaacacaaccgcgtttaatttgcaggtacagcaatccaagacagtagtacattgggtctgtttaggggagctttagattctgagaagcagctatttgatagtcagcttttaagaatctggaaaagctctgaaacccagcttctccagcttctggcttcttatttcatttttcagaatctgtaactacagattctcagaagctgtgaactgtttggggcagcttctagcagaagcagcttttgagaaaagctgcagctgggagaagctcccccaaacagggccattgtcccacctcgtggatcacacaaattgggtgcttcaatccactgcatctcaactatactcccatcagagcccaaattttcagaaatacaaaaaaaaaaaaactaagaaccgtagctagctattgtatttctctgtgtacataggagatagtactgaactactgatgtatgatgcgcaagatcacaaacttttacaacacccaaggatggtgccccatactatcaattacttaggatatggaggccaccacaaaatttcattgagatcaagctggctggcaacaattttggagataaagggtgccatgcagtgtttccaacatgtgcaagtgtacaagataaagagagaaatgaatagggtggcgcacgatcttgctagaatagcaatgagtactaggtctaatgctgagtggaggctatgcgccccagcacaaatcctagacttgttaaaccaagattgtaaccatttattcagtcattaataaagctctctctttaatgtaaaaaaaatacttaggatatggaggccaccacaaaactcaaaatcttggcatcacctccaattcctccatactgctgaatttctgtggaaaaaatgaagtttgtgtccggtacatcatactctctacatctatttttgatagtcatattttcaaatctgaaaaatttacttttgatagacatatttcaatccaaccatctattctcttaatgaatttctcggatttaatagtgactctctattcttcttcacaagattagctacatgggtatcgagaaatgtaaatattaatgaatcgcttgtttacgaggaataactagtagtttgtttaaatgaatgataagtagaattacttatccttggtcattgtgccaaaataaaatattactatcaaaagtagttggagttggagggagtatgttacagtgaaaacagctcatcattttcaggggataaaaaaaaagtaaagtgtattggcggtccttaaatttgtagggttgtgtcatataggtccctaaactcttaaaatacatatttaggtctcagaacttgtcaaagtgtatcatctatatctcaaattgacacatcccctctaggatcctacgtggcactgatgtggcaatgccacatggacgtgacgtgtcctttactttttttttcttcttttctttttctttttcgttttcttcttattcttttttttcctttttttctgcacaggtcacgagaagaaagggaaaaaagagaaggaaaaatgaaaataattaaatgggtcccatttatcaatcaaaataatgccatatcatatccgtgtggcatgccacatcaacgccacgtaggattctaaaggggttttggcgatttgggatctagatgacacactatgacaagttctaagacttggatatttattttgagagtttagggatctagatgacatacccctacaagtttaagaaccgcccgtacactttacttaaaaaaaactcaaacttcacttcagactaaagaaaaacccaacttactaccaataatgcatcgccattgatacaaactgcataaattcctacccccaaaggcccatccaatcattggacctggaagcaaagcatcagcaatgggatttcgctgcttctgctcgaaagctcaagctcagctcatcctactgctaccactactagtgctagcttcagcctcgtcatctgcagccaagcagcagcctcacaccgcctgcagcaacacttcaccagcgacggggcagccgccatgctccggccaccgtggtcaagtccctgcgccgccaatcttgggacttcttggtcgtaggcgagcaatcagagctccgcctccgccgcagccacatccaataacgtcgcctacctctccattcccggggcggccagtcccgccaccgccgccatcgccgtgcttgtagccgtcgactctgtcgttgcaggttcagtagaattcagaactttcaatcagcaagaaagttccatggatttactctgtttcagcgcacttcagctctcggcccctcccaggctctcaccattgtaaagtacgttctgctcgtttctgtcaagactcaagaccctttttttctgctcatttcgaacgagttagaagatcacaaggtttgtagtggatctttcgttttttttctatttttccggaagatgttttgtaattttaatctttactcctgagtacagtctgattatcaatcataatgcgtttgtccacaaatgttctattctggtcgagattcattcatgaaattactgttcaagattatggaaaaatatgtccaccgatacacagctggaagaatgaaagttggcgttttgatttttacagtgtacgaaactactgcactttgcaaacccagaagaacaaagaagttgaaagaaagagggaaaataaattacaagttctttaagaccaccaatgaaatctttgatctaacaacataattctctcctacatttaacaccaactacaactatgaaaaagctcgctacttcacaaagggccttctaggacaaaaccaagaagacggcgcccaatttgtccctccattctgaagccttcttgggtaagggatcacttccaatgcacgcacctgatcccaaatcgaacacaaatgcccaatgctgtaatccgtgatcctcatgttcattgttgccgcggcgcgccaagtagtagacatgattccccttgatcgtaggaaactccattgcagagaatgcgaaacattcgccatgccccaagaggagagcatgatcaccaagcctcgtccctctcttttccgggaatacgcaaggagcgcatcatttgtattaagaagaaataaagtttatgtaaaatgcaggctcgtcactctctcatggatctcaaaatgttacgggcagtacatcaaaatttgtccacttgccatcttggaattcacatgtcacattggattgcgaatttctcataccaccgcaaaactcaaaatctcgaccgtatctccaattcctccataccgtacgtcgaatttctagagacacgtctttgtctggtactacacgtgttacaatgattagctcggcattccagtttatttgttgataaaaagaaaactcaaatttcagttcaggcttcagaaaaaacccaactcctcaccaatgcataggctgcataaattcctgagacaatgagagcttcggcatttgtcaggaatgggatttcactgctgctttgtggctcaagctcttgtgatcttgctagtgctagtttcagactcggcaactgctggcaagcagcaagtgcagcaacctcgtcctcatgccgcctccagcaacacttcgccggcgccgccggagcggcctccgtgctccggccaccgctgtcaagtcccgccggcgccgccgcggttggggcttgtctacagcgaccgtagggcgcctccatgcgcacgccgatgtccgcctacgccgattccgaatccgaatccgaaccaccacccggcgtacgcatacctatgggctatggccacatccgctgcgtcgtccattcccgattagccttgcgccgcaaccgccgccgccgccgccgccacagctcttgtagtcgccgttgcaggtttggccgggccaaatccaggatcttcaatcagcaaggaagctagctgacggatttgctgctggttcatgcatgcacttcggttattgctaattgctaaattttgctttcagctgattttttttcagactttttggggcttttttttttgttttagaaaaaacgtgttctaagatcaccaggtgtgccgtgtgcaatccctcaaaaatgttttctttagacggacaacggtggcaactttggtgtcattgccttcttagaggaggcgttgtgtaggaagtctttttccccgtctttgacttcttctctttgtctggtcgtagacggttcttggttgtcgtcattaggttatcgtaagaggcgagtggatcttcttctctctcgtcctctccctatctccaacccctctacacgaggataactagaaacccgtcaatgatcttctaagcggagtcggtgcgcgggaggcgtttgtgaccccctttagacctagctgcgttgggtcacgtgagactagctgccaacgtgcggcgatggtgtgttgtcttttgtttttcctatttacgatcttccagtgttgtaatcatgtaatttttatatgttatatcagtacgaaacttcacactatcttgtgtgggtcgtttgaaaaaaaaatcacctcacttgtatcaacatctcaggtgattaaaattgtgcatcgatccttgtttagatgggagggactaatttcactaaaatacaagcctatatagtagtgactaaaatttatgtgagagggattaaaattagtatggacttatatttctgtgagagggattagtcctcccatccaaacaaggccttaggaatagggcacatagggataggtgacaattagcatatactccaatgtataatcacatcttaactattttctgcatccttcaactgagccttccaaacctattgaagtggcctacttgggggcaaatcctcatttcagtttgatttttacccagcctttgccttgacaaacacacatgtctcaaatagtgtgcatcacataattgtactttaatcctctcttcactgtactaatttcatatagtacataagcaccaactaaactaaaccatcgatttaaggactctctaggaatctatttaggaaaacataagattatgagaaccaacgggttggtagccagattttaagaatctgaaacaaaaaatctgacttctagttcatataactaacaacttctttgaatctgaataaaaagggcctctttgatgcgcaggatagaaaaaacacaggaattaaagtagtaggtttctcaaatcctacaggaatcagcaaacacaagaaaggcaatataagtcctttgatagtgttctgtgaaaaacaaaggaaagttcacaaagaggtcacaccgcttgctaaatgtgaagaatagaaatacaatcctatgaaaaattttctttctttcctatgaatcaaagggacatataggaaaaaatccataggaatttaaatcctatgaaaatccttcgccaatcctataaatcaaagggagccttagattctcagagaacctgcagttgtcagaaactacacgaaacagaccttaagaacaaagtacaagtcagcttgtatctgcccaaaggatggtcgaatcccatattgtggaatactccctccttcccaaattaatcatcatatcgtgaaacctaaatttttttaaattgatcatcatataaccgcatgagaatgtggcatgctaaagagtgtaattgtgcattattttttaatcgactacaattaatgtttaattgatgcgatttaaattatccctgatcttggtacataaatattataggacaattaatttgggatggagggaatacttaggatttgaactttcagtccaccacaaactcaaaatgttggccttacctccaactccaattcctccgctctgcagaatttcagaagaaaaaaaaatgtcttcatccggcacttcacatgtcaacagtgtcggtaggtgattaaaaaaaaacttagatttcacttcagaaaatccaacttatcaattatgcataaagccccatatgccatccaggcattggactcggaatcatccctctgcagccagagatgggattcagctgccgcttggtgatggctcgagctctgctcctgctcatcctagcagcgctagcttcggcctcgtcaatggctgccaagaagcaggggcgacagcctcgcggctgcggcggccacacctcgacgtcgccgacgccggagctggagctgccgccgtgctccggccaccgcggtcaagccccagcgccagtgttggggcttcttggccggaggggatcacctggagctccgcctccgccgcggtcacacccgccggtatcatacgtacgcccacagccgcgcccgtggccaccgccaccgccgcatccgcagcctccattcccgatcagcccggttgcgccgccgccgccaccaccgccgccaccgtgcttgtagtcgccgtcgttgcaggttcagtcggattcaggattttcagtcaggaaggaagctcaaatgatttgctaatctgtttcgggcacttcggaactattgtaaattctttgccttttgggggttcaagattttcttttgctcatttcaaacttgttcgttctagatcagctgatgtgtcatgtactcgtgtgcaatctctcaaaaatgttcatgtactcaggtgcaatctctgtcctcctataaatatgaaattggcacatcctgtgccggttcgttcagaaaaaaaatagtgcaatctctagaaaatgttttgctcgtctcacttggtcaccgcagtatttcgaatctgaaaagctggaattcttatttttaaattggaagctcgaattcttatactctaggatatgcaaattgcaaagaactcactggtagagtatcattcatgtgcgcgctcgaatcgcaagacaaacaaattcaggtcaaccatcgaaagtttcagtataaattcagtttgagttcagcagccgccgtgcgcctgcagtcacaaactgttcttggctacgatgaggctgttcgagctcatcgccggagttgccatcctggctgctctgtccaccaccacctcaaacgcgccatcgccggtcgccgtggcggcggggagggcggtgagggcgccgccgtcgccgaagccggcgccgcccataaggccgctcttccgggcgccaccaccacctccggcgaggtcagttcaaccaacgtgttcgtcagcgccgccaccacctccggcgaagtcagaactagctatgagttcgccgcctctcgccggcgaagtcggttcaaccaacgcctcagagctaccatgaatccgtgatctttcgtttactttgcaactcaacttttttttttcatgagaaactttgtaattttaatctttggtagtctggttatcaaatcatgttgtccgagatgtttgtcatgttgagatctttatcaacgaaattacagatccagatcacataaaaaccgtccaccaatccacagctcgaagaaaaagttggcgttatgattttgtaaaaagaatctagaacatacaagaccgaagaacagaagtttggcgttctgattttgcatgcataaaaacgaaaaaaaacatattaacagatcaaaaagaaactagggaagggtgaaagattaaacgaaatgttcttaagactactagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44421 - DNA, 2947 bp, Oryza sativa
  unsure (1)..(2947): unsure at all n locations
nnnnnnnnnnnnnnnnnnnnnnnnnnnnnnnnnnnnnnnnnnnnnnnnnnncagcaccattgttttggcgtttccgtccccttttccctgaaaaactattccgtcttcgttttcttgaggcgccatcagaactggcatcaaggtcaaaatttgcatcatagaggtcattggatgaatcttccttttctctcctagcggaagtgctacgaacagtccaacagcttttggcattgacaagttcttccaatgttagagagtgtttccctttaagatccaaccaatacaacttgaagagatattcccaattatttttatcatcgaagtccaccttagcctagaaggcacatatcaatagcaagtcatacaaaatgtctgagtatcttatcaacaaaatggagatttctaatatttgtgcaactaaagtagaagagaagtttagcttgtatgtttgtttcagcaagtcctctttatttatttttaccaagtaaatataagcctaaaatcatttagaacttcaaggtaaaagtgtattgctacttgttttaggttgcctagttcatacaagatgtgtgaggatagaactatgttggtaagattacatgaagtcatgaagattacgccaatatttcctagttacagatgcacttgagctaaaagtacagttctgcactgcaacataaaccaaatcaaagccacacatcgcaacaacctaaaggcaatagacaacggaatggataaattgacccagcaaaagccaccaactttacattacaaaagctgatagttacaagcctgcaactcacaaaacattgtgccaatatattggatcaacaaaatagagatatagcaaatttcatgtattccatgactttgggttctgcagttattacttctcaaactactcagagaaatatctatgaccttaattaatcatgattttcaatatcaaatgaacttgaaaagaaggtgcctagttgaaccaaatgttaaaaatgagcattatgctgtccaaaggactgagaaaatggatatttgcacaactctatagacatatttgcatatagatggtcatataattcaagaaacacagagggaatataaggattagcagcaggttaccttggcacgatcatctttggattctatcaacagtatagtgctatagcaggtatcacagaagcccttattccctctgacaccaaagaatttgactggcttttgtttgatgcaacctttgcagagggagtatgtacaagtatagcacatgtactgtactgccttttcacaggtgctgcataggtgccaacctgaaaaacatgacatcaagaacaggataagtcgtattgaactattggtttgttagcggaccagtcaggacatgcaaatacccaataaattttaccacggatgtactttccagatggtaaaatggcaaaaagaatgacctaatctgctcattaaattcaagtacataaaattcatagcattgcaaagaagggaaggcaatcataccaaatgcacttatatatctagtatccacaaaagatgccttttttaacagcagttatggccaccattacgtcaactataattgtacgtcaaataagatatgacactaatcctagtcctactcggcacattctaaactccatttcggttttattaattcctcgatttccgttagtatgcttttcaaactgttaaacggtgtgtttcatgcgtaaagattctatacagaagttgctttaaaaaatcaaataaacccatttttctagttattaataattaacagtactcaattaatcatatgctaatcacatttgtcattttgcgtgcggttaatcatcagtttcaaaacgcattttagaacgcgccctcggtgtgcacagcagtaatcactagatgttaagtacaaagaagcagaagtccaacaggagagcttaccacatgtccatttcgcccgagatcgaaagaatgattcgtcgcgcttgatgcaagcaggatgatagacttttgtgcaacccctacagccccaaaatggaagacatttggttcagctttttacgagcagacgaaattgaagctacggtactataagcagaaatgcaagcgccaaccgcgcacacgcactttttatcgcagaccacgagattgcccccgtcgaagcagatgaagcacaccacgtcctcgtcgtcctccctcttcttcaccggcttgggcggcggaggcggcgccgctccatccctgttcttcggcggcctccctctcttcctcttcaccaccaccggcggccccacggcaggcggctgctggtgctggtgctggtgctggtgcgcgggcgcccccatgatcgatccgaggaagtgcgagtcatcaaacccctcggcggacgcggacgcctccttcctcgcggcggcggccaccaccgccgcgccgggtggtcccacgggcggaggcggaggcgggggcggggacgcctcgccgcggagctggggagtggatggcggagccggctcgagcgggggaggaggaggaggatgcggcggcggcggaggcgggaggcggagctcgggcggccactcggcttcccccggcgagagcagctccgcccccggccccgtccccccgtccatggatggaccactcccctcaccccacccacccactcgacaacccaaaaccctaaccctaactccctctctctctctcgcgcaccgcctccacgggcaggtgggtgaggtgggggaggggaggaagcaagcacggaggggacgggagggaggcgagctcgaaatggaaaaggcgggggaggaggggagggaggcgcggtgaaacagtaacaactcgccgcggtaaaaaaaagagaggagaaaacctcactcaagtcacggcctcctcctcctccggagcgcgcgcgtggccccggcgaacgggcgaagagacggat

SEQ ID NO: 44422 - DNA, 7300 bp, Oryza sativa
ttcttttttctttttgtgtgagtgtgtctcggttgttttggtgcttcaattttccccggctccccgcgctgctcggcgattggggtggggggtttgatggcgtggttggctggctcggctggatgcagttattgggctcacggcgcgatggacgggtcgtggatataggtgtccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgaaggcaggccgccagcccgccagcctgcagtgcacagtgttttttttataaaaaaaagcaaaggaaatgtataaggaaaaaaaattaaaaatggaaataaaatgtttaaaaaaaaagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattatttttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcaaaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcattgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgtgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaactgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgtgccgtgccgcgggccgtgccgtgccggcccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccatttggccacctctagtcgtggaatactctctccgtaaaaaaaagaaaaaacttaacctatttagaggtgatatttttatacaatgaaactggacattgttcaaattcattatactagaaagggtctttttttatccagatttgttctattgtaaggctaagtttttttttatgaagagagtacgtggtggtggccgaggatccgctgcccttcttgagttttctgcgggtggctcggtgacgaggagattgatattatgtcgtcctcaaaaacaggtttcgttaaaatacctttaaaaagtggatttcgctacattactattgtaaaattgtcgttgctccttccactcatgtcattctcacactcacactatttcaggcatccagccgcctaggaagacaatggcagtgttcggtgagctcgagtaggctaggcgggatataaatcataccgttaccagtgccgtctatcctgcctagctgcactaaccctctcttttttttcttgccaagtcccaggaacatgacctcgtcgctagcgcggtgtagagcgtagctatggtatcgtgccaacgttccaacaacctcacactatccctgatcatgtgacgctagcacggtgtagagcgtagctatggtatcgtgccaacgttccaacgacctcacactatccctgatcaagtcacttcgccaggagattcacctagcatctaggaaggaaacgtctcatgaaactccttcaaccgtggaccgatcaaggagatcggcagcgcctttttttaactccggtcaaatgctaccggcgccaaatcctccgcaatcggtggatgtcaattacctgcagcagtgacaaccttaggggatattccacctcctgcattcgatgtttttggtgtgcatgtaccagattggaatgtccttggtgtcattgtcacctctgatgccggcatgccactcaccatcaccggagacgcttggagcttctctgcctcgggctgcttcctggtgagctccctcatgcctagtgtacccacatatatgcattcttccctcatatccagtgtacccatatgtatgcattcctgtagactagcatgcacggttttggtaggatatattaaatatgatgtttcttgtatatttggtaacaaaataaatggtaccatatatttatcaattttagcaaagaattgaattgtttaaaatggcatgaccgagaaacgtccatgggtctttcggctagctctataaggacagtcccaacccatagtgtccataagcagtgtctatggtgccatatcaataagacatcacaataaaaactacattctacaacccatgttttcttaaagtgatcattaataaatacatcatctctcttctctaccaatcatatttattcttcatctattatgaagacactattatctcccaatgcaaaacttcatagtgtctagtgcataggttctcgtgttgaaactgtgtcttgcatgagaccaagtttcttcctctctccactctctctcttaattaatatagtgcaacataagctaaaagtcctacatggcaatatagttaatgccatagacaccatcctaggtggagggttgagactgccctaaggtggtgggttagacgacctgagtttgaagcctcacccattctatttatttgatattatgtcattctctaatattctccactcttttaaaatggcatgaccgtctttggtattatttcagtttgataagtcatttttgacaataaagtaaacaagttctgcgagtctatggggctgtttggttcaatgcttcaacttgccacaccacaccttaggctgccacacctccttagccttgtgtttggttcattgccatagttatggcaagccacactttcttaccgttctaccccacatgtcatagactcaatcctttgcctaactttgccacacatgtggcttacaatttgtagcccacaaaaagtgtggcaagtcacacttgtctaacattgcctaaaatgagttatggcaatgttagttaagaaccaaacagcccctgcgaactcaagagctggtgataaggactagaaaatgggcagcacagcacgtgtaacatgtgcgaccaacacagtgagttgttcgtattctccaaccgcatgaagcgatttgcattgggccctgccgtgtctctgttaacgagtaaactttcactgacgctctttgttcggcattcatcatgttcttttgcaaagtcactttctctgaccatgacagcttatttgaaatattgtgttttaaatacaacaattttgattccaatactcccaagtaatattgtgactacttgatgacagtgatcggatttcatatgataaaagtttcggcgtttcggtcttatattttgaaaaaaagaattagtcccccgtttcatattataagtcattttgtttcaaacttaactaagtttatagataaaatttgactttgaccaaaatcaaaacgtcttataacctaaaatggagggagtaactacaagcccttacttacacgagagatacagacatgagactatatatatatagggcctgtttgagggaccttctagctgctgcagcttttcgcagaatcagaagctccctaaacagtacaacttttgatacagattctgagaaactgtacttgtagaatctagaaaataaattacaagccagaagctataaacataactttttcagattctcagaagctggctatcaaccatctaggtctctgaattttaatctctcccaaacacgtccatactactccatgaaagagtacaattatactctacatcgtataaattaaaacaatagtatataaggacattcccaacccaacgactaagatagtgtcatggcattaaataagttaccacctaggaaaaaaaatgatgtggcaagtgaataaatgaggaaagagaaggaaaccatgtcttatgtagacatggttttcacacaatatccaagacattatgtgagataagtagcattaaattaaagtatggaatagtggtgtttgcattagaagagtagtgtctagtaaaatttatagaaatcatgtatagtgttatgagttgggactgcttgacaaggacggaagacgaagacgccgcgagtgaggctgacgccccaccgccacgcagtgacgagagcccgtgacgcgtggcctgggctggtacgcgtgtggtggtgtctgcagctcgctcgcttgcccgtcacggcgtcacgcccccggtaaaaggcgccgacgcgccatgggacagcgatgagacgaggagccgtccagctccaggtccagccgcactggagagacaggagtccagctccatccgcagcacgacagaacacaggaggctgcaccaaaccaaaaggtactagcactagttaactgaacagtgaaaaaagagtgtctaactggccctgtttagttaaaaaaaaacttttcacatatatgaagtattaaatatgaaaaaaaaccaattacacagtttacgtgtaaattgtgagacgaatctttta

SEQ ID NO: 44423 - DNA, 1639 bp, Oryza sativa
cggcgtcatacattaaaatacggagggagtataatttactttaatatttcactaatcaaactttacatatatataatatgtttgtttcatatcaaaagtattaatatttttttaaaaaatattaaatttgaataagtttaattaaaaaattaaaacaacttaacataggaagttaacaaggaagtagttaactgaacaattcaaaaggagtgtctaaccgtatatacattgcaggagtaattcaatactccctccatttcaaaataagttatgtcacatgtccaaatttttagtattataatatgttacatttcgtattagattaacttattctggaatggatgtagtggataaatactaccacctccatcccagaatataagaatttttagggttgaacacgtttattaagaaagttggtagaatcaaataaaagaagatcgtgatgggatgaaaagtgaagatagaatggttgtgattggttggaaagataatgttgataaaaaagttattatattttatgaaaaatccaaaagcctaaaagttgttatattttggatggagtgagtacatctctattctccatttcataattcaatgacgagataaataggtaaaaaacattatattttactatagaggtagtatcgtacagttcatccggataacacgtctcttgttacaattactactattagagcaaatttaatagaatagccaactattgactccaaatcatctatagttaattttataatcaattcatgcaatagttacctgtaaacatacaccacacaattaatactggtctcacttgtcatatacacatatattttagagtctgtgctgtagctagctataaatttataaatttatagtccgctacttttctctattcttttttattttttcgaaatatgtttataggttggttatactactctgctactgtaactgctcttaaccgctgtgaagaagccgccaaaagcaggggtacgtacttgccttctgcggtccctgccacagcggcgcaatgagtctgaaatgtctccagctttaactgagccacgccatactcatctctcgatcgatcatcagtgtcacagcgtcgcagtacaattgcaaaaccccaccgcatgtgattgttcaaccaggctgctgcagggccagcttggttcgtgttcgctcgggcgacagcttttgacagtgttgctgcacttgttgatcctttctcatcaataacaattattgattcagctgaacaacagtagatcaatggatacccaaagattggtctgcattgacgatggagtaaacaggagtactctatatcaaaagttcagggtaacccatgttacctaataaatcaaaacggtttattaggaaataaaacttaatttatagttaaaacttttatatatttgttcgtagcgatttaaaagctaacgctaaaaaaattatgttaaattttttttaaaattaagtttaaaatttcaaattttggcttttgttgatatttttttcaacaaggcgtttagattgtggacgagcgcgacagaaaaaccgctatgcagggctcggccgtggcccaggcttgtcacagcatgctggggcatgtctgaggctctgagcagagagg

SEQ ID NO: 44424 - DNA, 11830 bp, Oryza sativa
tctttcagcttactctcaataatctggattataataattccaagtctggattatagttatgggctttttaaattcaaatttcaggatgctaagtggaatttcaacaaagtttaggattttttggactttcagcagaaccgttctgattttttttttttaaatttcaggatattttaggcaataacgtcttacaatcgtgtgatgtgctctttgtagaggtgtagtaatacgaatgtttcctgtctcgtgagtcgtggctcaactgttcatgcatgttaaaaaaatattagagaaaggtctataaaatacatttatatcaaatcttaagtccaaacttaatttcttttaaaaataaaacaatttttaggtgaatagtgttgtgttactatttatctaaactttgtctttttttactccataataaagttgagtttaaacttaaaatttgatgtgaatgtatttaatgcttacacctatttctaatagctttctcatgaattcacggggtttttacgggtttttaagttttcaccggatgtatccccttaaaatattttacagttagtctcatatgtccccttaaaatatatccacagagaatctaaaaatcaacacatcatccacccacaccaactcccgatgattcttgctcaaggaagactggaagagctcgagaaatattccgtgtactaccatggttaattaattatggctgtgtttagatccaaagtttggatccaaacttcagtcattttccatcatatcaacctgtcacacacaatttttcagtcacatcatctctaatttcaaccaaaatctaaactttacgctgaactaaacacagcctatataaactaaattatggctatgttaaaataggcagcagcatttcctagatgcccgcccttgcacgagagatacagacaaaagagaagcccacgcaactgaaacgacctcccgagactgcaaggccgctgacggcaagctttggttcactcgggcgacagctttgacggtgttgcacatcttaatccttctcatccattaaaatccattattaatttaggccctgttattttctccaacaaaagttgaattaacttttggatactcatggcatgcttttcaaactgcaaaacggtatgtttcgtgcgaaaactttctatatgaaagttgttctaaaatatcagattaatccaattttcaagtttataataattaaaactcaattaatcacacgttattaccacctcgttttgcgtgaaaaacttaaccttcatcttcaggacattcaaacaccaccttaattgtactagagtagatcaatggataccgtagattggtctgtgtaactgtgtttattgtagccccgactcccgagtcatcatcaccatgccctgcgttcaggatggagcaaggggtcaaatctccatgagcactatcatcagatgttctacgggagctacgaacaggagtgcatcagatgttcaagctgttgatgttttcagaaagaaattcagacggtggacggccgcgacacaacggctatgcaaggctcggccgtttgcccagattgtcactgcatactgcggcatgtctgagcagatcagcagagaaccttgcacttgcagcgcagagagatgtgcaagaaaggcaggccacaatcgctgcacagtcctatcttttccgtgttgttattactggtgtgttattgggcatcgaagagatcaagaccctgaccttgttggttcttggcattgtgatagccacaagctgatgtggctggcgatctgcttcctcactgtgctcacggctgccggggatgagcaatttgaagggtcacctgataatgcaatgtgaaaaatgtcagaatttttttttatctaaacatacctcgggaaaaaggaagatttttcctctgaatttagtgcatatcgaccttgtgtaagtcactattgaaccatactagtaccatagacatagtaatgctactagagcatgcagagagctttgtatattcgtggtcctcaaaggagaaccaccaaagttaatcacaatataatactctctctatatttaaatacatggcactgttgaaattatccgatcaaacttttaaaactttgaccatcaataactctcaaaacatttagtttgaaaacataaaaatcatatagctagaattttcttgatagttatgtacttcacaatattacaattttgttgaatgttatcgttatatttcaatagaaaaattgtggtcttacacaccaagatctgaatatgtcaggagtgtcatatatataaatatagaggtagtattgcttatgtagttattttgtaacatatgtattcatcataccaagatactctagaaaacacttccaatctaccttcaatcctgaaagggagttgggggcatcctctcagatcagtgccatgtccgcaatttctacatttgattatgtatgatggcactacaaatgttggcgagcctcagttagtgcatgctgcaagtagagtagatacacaaagagcaaggctacacctaaacatggagatagcaacaagccaacatattagtagatgagaactttgaaagctcactatatttcgacgatttctgtttcgaggcatggcgccatggatcttgagagccatttgtgaacactattttagaagctgcaccatttttcatgcaaaatcgggaaaaaaatgtgagtatcaatttagcattcaggacaacagtgagaaaatctgaaatccagcagcgataaaaatctggtatctagaaagcagcacaaccatagtatgcagtatgcttacggttagtgtacaatgaaatttacagaccgtaccaaggtggcagctggactgctgaaattgttgattccatttcgcaggcatggataggccaatgattccacaaaaaaaatgctaatatacagagaataaaagctagctagagagcaaaccagcaattcttgtgcctccgtaatacaagtttgtcatgaacacatcaggataaacaccttcaccaaagacatttctgcataggtccaaatggtacctggagatatgcaaagcaaaaggcatatgtaatggtaaaagtattagctagtgaacttgattatatataccaaagagcaaaaacgtgagcaacagatagaaatcaaaagagtccaggatatctaagatacactgcattaagagattatcgaaggtgaaaatacagtcaaatagtatgctggcaatgacttcagtagaacatattgtggtgcaaacacggagtgatcacaacgagagtaatcgaaacatgacaatttcttaaacaggtacccaacccaaggcttgactgaaaaagaataagcatacagagatggaaaaaaaaacataggacattaccctgtattgatctctgtagagcgaatgctatcgtttttgggtgccacttgaaaataggcaacctcactgcaaacttggaaccaccaaagtctagaacctaaaaataaatggcaatgcactatgggtattacattcatggcaaataacaagaaaacgatgtcatggtgtaactgcagtttggtttcgctagcaaaagagaacaaatagaaaatcatttactagtatcatcaggagtcgtattcttcaagtattcctgatcatatgaagatacagttgtcccccatcttctaatgaaaaaatcttgcacatactgagcatatgtttcctgtaaaaccagcacatgaaaattcaagaaggctggaatcaatgtacttttgcaaatgtactgccagaatacaatggttacacgaggataaataaaaaataataggtggcctatgcaaattaaatgaaaaggtacaatgtttaaagaacataattatgacatgattgttgatatgtcaagattaagttgaaaacccaggcacaattttcattaaaaaaaactggcacggcacaattggggtgggtatccaaggctctactatcccacttcatatggtgtagtaatcttaggcttgcttcttgagtgttgaaaataaacctggatgtataccagacccgtacattttactttgattgttgcatcagtgtatgtgtgattgtgtaatgtgtccgactgcatccttgatagattcagaagccgggtatttttttaactaaatgaaactttaactttctaaaaaaaagtcaaaactctggctattatcaaaagtaacagatgaattaccaccaaacttctcccggtcttcttcgcattgattagaggggagcatacagcatcaggactcccatattggaactgcaaaatggcataggttttcaacaaccaaaaatatatcttaaagttacagtgatatcataattcacatcatgcatactcctatggccgccgcatctgccaggaagaacaggaaatcaccatcatttttcaactgcaaatcaaaagtggattaaagcatgcgaaaatcctggaaacagagagattgtattcatcgtgtagaactagaggtacttttatgttacaaaagtaaaaaatgcacatcccaagtcctcaatcacaaggggttaccttctctgctccaaataaaaccttcacagagcggctgtccaaccgaagctgttcatcgacaagtctagttacctcctgaagggcagctttgcattcagggccagctgaatcccctacctacacaatggtagccatacaaaaaatttcatcagatccaaagtggattacacagaacagcagcatggatacaaggatcatgagttcatgactcaccatgatccttgtccatagcactggtgaaactgtactcctaaatcataattcctaacctgcttgtcaaagtcagtgaaattgtacacagcaagcaccacccctgagctcgcaaggcttccacatgtcaagtgagggaacttgagcctgaaccatgcactaagagcacccgagtacgataccccgaagacgaaccaaggattgtcaaaccccgatgatcgattgtacctagcattcaagatttcctacaaaagcaacaaaaccacacagagagagagagagagagagagagatcagaaaatcacgtgctaaatagtttatccccatttgaaacgcaggggaatttcacatgaatttgaccataaacagttcgatttacacgggaatagggagatttttcatgcatttcgtcgatctgaatcctgacctggtaatgctggcggaaggcgaccaggtcgaacagtgcctgcttggacgacaggaacctcaggttctccgtggtgaggctctcgaacggggagctcttgccgtagtaccggtgctccggcgtcaccacggcggcgccgaacttcttggaaaggacctacacggcggaggaaccccaacaaatcagcagaaatggcatcggcaaccgtcgatgggtttgcgatgtctcacggccaggtagtcgttggggatgccgttgcaggaggactcgccgcagatgcgcaggaacaccgggccgccgccggcgtggtagtcggcgaactcgtagtaccgctgcttgaactggcggtggtcctgcacgccgccggcgacatcagcgcgagggcgctaaacccaaagaacttttttgtttctcgcgacattacatatcagcccctgatattaaaactaatacaatccatgccctcgacgagtgaacaagccagagccactcagggatcgttttgagaaacagttttaatccagggggttttagagtaaaacaaaactaattcctccgaggaggaagacgaggaagaagacgactcacggtgggggagaagtggtcgaggcgctggtccatccaccgctcctccgtcgtcaggtgccggccggcggcgccaccgccggcggcgatcggctcggcgccgcgcgcgaggaggaggaggacgacggcgacggcgaggaggtggtggtggtggtggtggtggtggtggaggaaggcgacgcgaggacgagaccccatcgactccgtggctgagagactcttgttcgagtgttttgtttggccgagacgaggactcgactctcgaggagtactacagctattatactattatagtggacttttattattcttaggattaggaaaaaggaacaaaacgatgatttctaagagggggaaaaaatgaaaattaaacacaggatctgaacttgttgacgacaaattaagagttgagcagttacactgtacccgctccattgcgaaatgtaaaaagttttagttttatactaagtcaaattattcaaaaattaattaagtttagtttatagaggaatattaattcatccctttgtttacaaagtatttacaaaccctaaaaaggtgccacattcttgaagtgtattacatcctaaatgtaagtataaaacttttgttccctttagtttaacgatttttttttgaaaatatccattttttttaaaacaaaattgcgtttatataaactagggcgaaaaatttgtgaaaatatacctattctgcagatcggttccgcgggagcgctaccaaagcgcggcgtggagcggacgacggaggcgctcgcgcggaatggggctgtgggaccgagcttgtcgtgaacttggaaccggctcgctctcgcagcaccagtgtgccgaaccgcggcgccatcttttttgttgtactgcatggcactgtgttcgacattgttctagtacttttgacactgttcgtgggtcggttccacacaatgaggacacggtactgatgtatgaacattgtcggacagtacttgaagtgtcggaacagtgctacatagggttgaaatcgctgggcaccgcggttccgtgtttgggaaccgcgggaccgtcgtcgttccgcgttttggagctaggggactgtgatggtcccgcacgactgtaccgcgggatcgtcggtcccgcgttttgaatctgtgggaccgtcatggtcccacatttctgtcctgtaggacggatatacttttgcaaaacctttccgtacatgtatataaaccatacatgtatataaacgtaaattattaaaaaaataagtatatttgcaatttttttctaactaacatcaaagagtaatgcatgatcgaagttaaagttgtcagttaattaaaaataagagattaacatctaccatgtcaaataacgaaacaatgaaaatatatttcataacggatataatgattttcatttcatatcttaaaaattttataaactgtcaaacttacgatagttatttcagaggaaaaaaaacatcggttttatatgttaaggatagaaggggcaccattcttgtgagattattggtaccggtagcctgggactcttaattagtaccaatcacccaatcagccaaccaaaccttgtgttatatattaggataattattcaagatagcttgtcttgttagcctttcttcagaaagctccacccatggacatatcggccaggctagcttcttgtgcgattgaaaacgatgcaggcgtctctcacgttaaacattcttttgtgtaggatatagcaggtgatttatcttgtacttagctcagtagtaacattttacatatcattggcactcttctgcagagaaaagcctgagagttacctgtaaggttattgacaaattataatcgacagtgattatctggtacttatcttatattttcaccggaagactgaacgagttcatccgaacgtattaaaaaggagaatagttataaagaacggtgtaccaaagtgtacgcccaagcaccacacgctaaccacacaagcacaaatcgctaagagtggggcctagcaccaaaatggcccccactaagtgtggttgatcgccgccaggcctatgacaacaccacaaagacaagacttcgaaaatgatgccaccacagaggtcacgacatcaaggatgttgccattgtccatttaagaaagatgtgattttcacccagagaaactcgtcgagaaaagaaagaggtaccctcgacaatatcccaaggggttacaacgcccgaaggcgtaaccattaccagcctagtgaactaccaagttaggcttttgcctggaacccctacaaccttacttgtagttcgccgcccactaactcagaaaccaccacacaggcattggcagcacgtggcctccaccacaccgtatcggcgccccctccaccgaccgacttccaaacttgccactccatccaccccccccactccgccccgagcgagagctggcccaggcccccttcgtcccgccactcgccagccttcttagatttggcccaaaagaatatcttgtagtagtagcagcagtgtttgagcaattattacggccgtacgtcctgagaatgtttgatcgataacatgagaatgattggaacactcaactgtctgtcttttagtgtgattgtcctggccttcaaactaacaaatggttgttggtagctcgagcagataatcagtaagcagctacgctccatccactctatatatgccctgagatattaggtagatcaacaatgaaattgacgaaaactgaattgaatttgaagggaattacagatgtgcttggctcaaaatgcagaggctctgagcaaattatatcgggagccattggttagaaaaaatgttcacgatcactatagctcaaatggtacaatagctggagtgctggacagctagcaaaactaacctttggtccgtcttgcattttttatgaacaatgcgatcgacaatctgctctatattttgcttcacagcttccgagatgcacttgacaacgagtgataaaggatatgtggttttaaccttgagattccgtatccaatcctcaacatactcataattcttagaaaaatattcagagggacatatctcctttcaaatcttgaaaaaaaaaaacttcacagcttctgaagatggacagttcttcactaagagatatcgatggattaccatattgcatcatcactcatcagtaagaaacatcgatcttactactccattaaaaaaaagtaaattttagctacgaatctggacacgtttgtagttaggattggattttcttttggatgaagggggtacagttgaaggatctggatgattagacgagcgatggatcaggtactaatccgaaggagggagagagaggccagggtttaaaggaggttttgttctgaggaatttctctcttctttttttttcttcggagaggggcttgttcgtttcttcttcctcgcgccgcgcgctccaatccgatccgccctgcttgatcaaaaccctagcgatcgaattcccccctccccattgcgagctagtggtggccaaaatcggccatggcccctgactgcgtcttgctcgaccgctacgtcaccttcctcgacgaccccgcaccggcaagcgacgaggtcgatcgccggcggcgaacccggacgacctcagagacgggatcgccgcctacctgcgtgccatgaggccgcgcgcgcaggtggagagaatcccccgcgggtcacctacctcgccatggtgcggccgccgccgtcgtcggatgacgatcccctcgtcccgcagttcgggcggcagatcgactccggcgtcgtcgcggcggccggcggcaacctcgtcgccctctacgccggcccgtaccgccccgcctcctcgtccatggggtgctacctcgtctacgacgccgccgcccgatcgagttcgccgccgctctccacggtccccggcgtcccctactccgactcccactcgagccccggccgcgcgaccgtcatcgcgccagccgccaccggcggcggattcatggatggccacagtgtactaccaccgtcgaccgccgagatcaccatcaccacatggacactcgatctacaggatgatcattcgacgtcaacacaaaactggacgaatcgggaagcataacttcaaactaaaagtgaacaagaacaggggtctgaagtaagctgtgacatgtacaagtaccacccttgacaaatgtacatgtgagcaggctattaaaatggaatgccttggaatatacattagaatggtatgtgggtgttccttactgttagaaactagtggtccacaatttgatatggaaataacaaattttggtacacagttcttgttgcagctagctgtcttctggctttcttttattctaaagttgttcgaatttgtagtcctgaaaggaagaagttgttatacataactccactttgcactgcacttaacattgtgatagggcagactttttttttttggaagtagataaagtctaaagagtcactctgatcaattttaacaaagtatgtgtgacaaatatatctgtttctgctagattgggcttctaagcagtggaggtaagtgcaaaaaggatgaagatttgatgatctacgatgcattgtcaagtgatgtgatgaagccttaatattatggtatgatttttcatagcttctgtggagaacaaggttgaatgtgttttagtttatctagaaggttgatcttattatcaagtagtactggtggtttgatcctgaatgtgtggttgtctaataaccatgcagtaccactggtggcttgatccttaatgtgtggcctaaatccttcctatatgacttcttttaatactgttccgtgcataaattgcattttatgtgttgcctgtactccccctagtcacaaatgctttataccattgacatttttggcctcctaggtttaactttgatcattacttttctattaaaatataactataatatctataagatgtatcccttatggtcaggcttttctaagaaaaaaagatgtagtcatatctcatgttaaaaatggttggagtaggatgtacccggttatctaatatcttagtctcatgaataaacaaagtttatcttgtacataattcagtaacattttacatatcatggtaatcttctgcagaatgggggagcctgagagcaacctgtaaggttattgacaaatgacagaggtcgtcaccatagtagtgtttgagcaattgttaccgcagtcctgaggataatgcttggtaccatgagaatgcttggaacaaccaactgtccgtattatttgagtgaatcatactagtctaaatgacagctgcattgtcttgtactcatggccttttgaacatatggttggtagctcgagcaggtaatcagtaagtagctatgctccatctactgcccagcaatggctcattgtcgtgtcctgagattaggtagagcaaagatgtcattgaccaaaattgaatttgaagtgaactgcaaatgtgtttgtcacgaagtcagagtgatcgagaaaagcagaagctcagaacaactaatatggatgtattagttataactttcttttttttttttgcaatcactatagttcaatagtataatagctggacagccaaaaccaaccttgctcttgacattctgataaccataaatcaatgtgatcgacgatctgctttcttactttgttcacagcttctggagatgaacaattagacgagtcacctggtaaacacaaaatacaaacatattatgggcttggtcacaactcacaactcaaactagagacttgatatatcttaatactagacgaggcaaagacagttatcaagtctctagtttaagttaaaatctacagctaaaaaggaaagtcacattttccctgcagtactgtcctcaagagaggcttcagcaaaggctggaatgttggatgtaccttcaatatgtgaaggagcttgagggcatccagatagatcactgcaatgtccgcaattggg

SEQ ID NO: 44425 - DNA, 2558 bp, Oryza sativa
cataaaaaatgcattcacactatttaaccatgctcatatgagatacaaaaacagtgctattgaaacaaagaaatggccaggactgtacagatgctcacattcttttgatgatttctgcttagaagcatggcgccatggatcttgagagccgtttgcaaaaacaattttcgaacctgcaggcatgcagtatattgattaaaaaaaatacaagaattgattgcctgcagaataatgattataggctttggatgtcatactgcatacacagtacttcccacagaccattatgcacattcttggttatccataatatccattcaaaattcatgatatcgttataatatatggaacttgtttgtgataaaaagcggctattagcactgcagatataatcatataaggccatttaactctctagtcttctatttaccatcactcactgagcatgacctttacacacttgcattactagtgcagctcaatcacttgaggcacacaatatgatccagtaatatgaacatctagaaccttgtggttgttatttctctcttcatctcttgtctagtttttccatttagagaggggaaggggaagagtttcaaggttaagtaaaaaataatattgtagcttgctgcagactagcaccataccttaattgagatccaaacgaccatacttgaagaaacaaaacaggtaacatgattgaagctaattattcaaagaaaaaaatgatatacctgcaattcttgtgcctccatagtataaatttgtcatgaatacatcagggtaaactccttccccaaaaacatttctgcacaagtccaaatggtacctagaaagaaaagaggaacttatataaatacaatatctagaagcatagtcacatcttgaaaaagagaagattatagatagcagatctaaatcgataaggtaagatagcttccagtggaatatttatttgaggaaagtagatctagtaaccttgtgtcaatctttgcagaacggacactatcattttttggagccacttggaaatatgcaacttcactgcaaacttggtaccaccataacctatatgctaaataaaatcaataattaaatgcataggcaacataaacaattggccactgtctattcattaagtgctgcatttcaaattctcaaagcatgacatttggtaatatagaatatcagggttcgtaattaccagattcagcaggaggtggagttgtgttcttcaaatattcttgatcatatgatgcaactgatgctccaaatgttcctatgtaataatctttcacatagcgagcaaatgtttcctgcacagcagaatagagcaagcaaggtcaccaaaaggcatggtggaacaactaaataagagtcaagtttgacaaggacttatcacatgcttactaatgattacaaacatgttttttttttgtatgtgtgtatctggaattgctggcaactttatcctttcaacctatctcagatcattcttaattcctatcaccaaagggaggtattacttaccaccaaatctgtgccattcttctttgcttcaactattggggagcacaaagcatcaggattaccgtattggaactgcacatggtataagattttaatacaacaattgcatctgacagattataaagtcaaaataaatgtacatttagcataccgcaatagctgctgcatccgccagtagaaagaggaagtcaccatcatttgctaactgcaagcatccgaaagaagttggtaaataattaaatacactattagagcattcaaatgatattttataccatgcaaggaactaacataagtggtcataaggttgatggcacaagtgcacaatggcagtttaaggacgtggcggttcacttcaaacttagttctaatgaaattatagaaggtccatagacttggatactccataatatatttttgataagcagtttcttagtttggtataacaatgccagttgtctgaaaactgaacggaacccactagattattacatgatctccaaacaagtttcagaatgcaaagtcagggaaatatttaatatatttgagaagctattttttagcaccactactttacccttaaagttagcttgacctctttatacagttttctcctttcatgttttgtcatactgaaaccaggcaggtaatataaaaatcagtaagctgtcaaagcaaaagaaatatacttgcatatcacatagaggattaccgttgatgctccaaagagttgtttaactgcattgcgaccagactgaagttgtccgtcaacaagttttgttgtttcttgtagtgctgctttgcattcagggccagctgactcaccaatcttcagagatgtgaatcatgcagaaaggtagaacttttaggtgcatgccaaaatgcgataacattataacatgattaaggatctgcacctgtagttacctgtttgtcaaagtcagtatagttgtaaacagaaagaacaactcctgaactcgcaagacttccacatgtcaagtgagggaacttcaatctgaaccaag

SEQ ID NO: 44426 - DNA, 6248 bp, Oryza sativa
tgttatcaaaacaggtgaagtaaaatataaccatatgcttaaagtatagatcacacctagaatgtgtaacaaataatgtctaattgctccagttggaaactgtacaactatatacttgagcatactcacagctaagtagctgttaggaatcccgttgcacgaagattctccacagatatataagaaaattggcccttttggagctcggtagtaatcaaggaattcatagtaacgctgcttgaattgccgatggtcctgcattgaaaataaaataaaggtccatgaatgccaaaaaaaaaaagaaagaaagaaagaaagaaagaaagagaacatctaacaacgatggtagaatgcatcaacattactccatatcacatcacatttgaaacaacttgaatcactagtcaagaggggattatggacaacagtgaagcgctagtttgttatgtagcaagtctagcaggctcgtaaattttcagatacacaacatatatacaaaggggaacatcaacattataccgctgaagtaccgattgcctttttatgaggtccgaaagtctcatgaacattatgtgtacgggacatgaacatcggaatggcgttatcaaaagtgaagctcacatgaaatctatgaaacaaaacagaaatttctttagcatcctcaaactccataaattctcccagcttcaaaatcaatcgattgtgccagtgcggacgtgggcgtgctaattcagtaccaattcgcttagttctcacactggagactatactaggatatagattgactagattccgacagagccaaagaccaaactgatgcaaagtgacggcacagcacaaatccacttccccatatccccaattcccccaacccattgtcccgttgcgcacgaagagcaaaaacgaggaactgaacaagagcgcggatcaaccaattcaaccgagaaaccgaaagaggaggcggtggtgggagatcgggactcaacggtggggttgaagtggtcgagggtctggtccatccaccgctcctcctgcgtcaggtacctgcctggtgcggcggcgccgccgaggcgccccccgccaccggtgggaggcggcagccacagcccgatcggctccgccccgggagccagcagcaggagcaccgccacggcggcgactgcggcgccgacggcgctggacgccatctctctctcgcgcgcgcttccgcttccgctgcggcggcggagaggagacgatgcgtttccgacgcgagcaagcaaagcgaagcaacctcccttggcgagaagtcagaagtggaagaggattttttttttttttttgagaactgaagaggtaacgtgcaaagtgtattgctaccgctacgggatgtgtacgagattttatccgggcgtagggtagggtgtgacgaggaggatacggtatacggcctaggaaatacggggtacggggccgtggaataagtccaatttgcctccctcatctcttgcgtttgtgtgaatagcataccttaactggaaaaacgggtataactcctccttcatctctaaaaccagagcaaatcacctcctcccttggtggtttttccgacgtggcattgttgacctggttgacaagctgactcagcgtggtgggacccacatgtcagtgtgtagcgctctctctcccccccgtcctttcccttcaccccggtgtggctcatcgacgtgggtcgggccaaggcggcagggcagcgcgttgcgacggagagaggtagccgtgcggcggcggtgatgcgggagagcgcacggcagcgggcggcgcggtggtcggctacgggcggtcgtgcgcagtgggccaaccttgcgcgggcacggcggatggcggcggctggcgaggctgggcacggggcagcgcggcgacctggcgcggcgcggacggcgatgcggccagggaggcgtgacggttggctggatcggcgccagtgcggccggcgaccgacgtcctctccgcgtcctctcccgcgccgccgcgaccccgtcgctgcctgcgcatcccccgccgatgccgagactgcctccacctcgcgttcctgtgacgcgctggaggccgagcgcgccgtcgcggagctcctccgagagcacggggcctccccggctgatgcggcttccatcgccgcgcgcgccccggggtacgccgccatgctcgccgacggcgtccgcgagctcgacgagctcgggctctgggagtcgtggagctccggggttggggcgggccgcgaggtggagatggccgggctcgggttcgggaggaaggtgtactacatggggaaggcgaagagtaggcacggccgcggcgtggtgccgctgctcgagagcgtcggggtgcggctctcctccgcgaagctcatcgagccgtatgtttcggcggctggtctcccggtgctgatcgatagggtgagatctaccacttcattttgagctcaatttgcttcatttttttagtgcatttgatgaccatctctgcccggtacaaactgcatagtatgagtggtgaaattcgctcatcatttcttctcttctttgtttcttgttgctccggcaattcgctcgtcatggcgcgaccgtgtggcggcggcgcatccaggccgagcggctagcgtcatgggcagtcggtgctgcggtgcatcagcgtgtggagcggatgcatgaccagtttccatggcgccgatgccgccgcttttcttttcttttctttccttttgcttttcttctttgtttcttgtcctctccggccgggcgttgtggcggagcgacggcgccgcctagatgcggacgcgaggtcgccactgggtgcgcaggctcggggttcgtcgccggtatgcaggtgcaagctcgctgctagggtggccacgacgcgaccactccccgccgccgatgcccagctcctctccgctagtctactccccgttcgtcgctagcgagcgcagctgccgccaacgagggccaccgccggccgcgcccctaccccgccaaagtgaagagaaaggccgagggagagagagagagataagggagagagagagagagcgcacgctccacactgacattgacatgtgggtcccaccatgctgagtcagcttgtcaacgggtcaacaacgccacgtcggacgaaaccgccagcaaaaccaccgagggaggtgatttgctctggttttcagagatgaaggagatgttatacccggttttccggttgagggatgttattcacgcaagcgcaagaatgagggaggaaaaatggacttattccacggggccgtagagcgagcccgtgtggttgcctattgggccctgggcctcgtttggtttctggatggaccgggagtccattgttctttgagagagagagagaagagaggatgttccattgggattgagattctcagcagtcgactgcaccgtgcctttgtcactgatatatagacccaacgacacatcgggtccacatgtcagtgataaaggcacggtgcagttacttccattgttgtagtggtatcgctagatttcagccccactacctctaaaattgtagtgaaatatgatgtgcaatgttacttcttttagttgcaattttgttgtatactagaaaaaatgcccgtgctttgccacgggtaaaaatatttttggatcgttatatattttactctttggttttggacaaaaaagctcatttcattccttgtcaagtggagttgtaagtccggctcgcatagctgactgtccttttcaacctccgaaagctaatgtcatgtccgtacatgccaaaaccgatccttccatcaaatccggtcgaatctttctcgatctttcaaaattggtttgagggtttttgatacactcgatctcctctttccgtttttattaaaatcggagcgataaaactcgggataaaaatggtgattttaaaatagagattaaattcagtgaattaaaacagagttaaaagagaaaatcataggaaaatgatgagggagcagtggggaattaatttttggcaatcaattggtggacgaaacgcatgggaagacagatcgacctagcggcgacgctagtgttcagccggacgataaaaaggcatggcatataaaagaacaaatccttatcgcgtgcgagaaaatacaactaaaaaacagcaacaaacatatgaaaaaaaacccggtaaaaaggcctgaaaaaaaggtaaaaaaacagcatgggaaaaaagtgaaaaaaggcgaagagaaaaaaagcagatggaaaaaaaaagacagacggaaaaaattgtgaaaaaaagaaaaagagtggaaaggacataaagaaagaaaaaatatacggataaaaaaagaaaaaagaatcggacagaaagaaggaaaagaaacggacggagaaaaaaaaaggaaaacggacaggaaaaaaaagaaaaaaagggcgaaaaataaaaaaagacggacggattttttttgacggaaccttgcttattttttaattaggtatagatatagttttactttgtttttatctaagtttggattttttttccatgtaattttataacttttatgaatagcatgtttatttattgtaattctgtatgttcaaatataatgctcaaccttttacatataaggagaaaaataggaagggtaactagaatcattggattgttatctaaggaatgaaaaagagactggaattttcataaatttcagtcaactgaaatccagacactcccttgctggaaacatgtttattccactgtttgttctattcaaatttacaaagtaagcttgttctcacagaattttcacagaaaaaaaattgttacttatcacaatgatcacgatatatatcaaaccactgtcgatctgtcattactcagtggcacgaccaatgcacggagcgggtgctgcatggtggtgatgaacccgtagtccgccgtgagatccacctcctcctcccatgggactcggcgccactcgaaggccgtgaccagattcgcgagaaagtactccaggtgcaggatggcatatcccatcccggggcacgtccttcgcccggcgctgaacggcatcattttcaccttagttgttgcctcctgcttgctgccgatggccaacctcaccccttcttccccgccctccatgaacctctctggcgagaactcttccgacgatgtccatatctgatagtggagttgagagacactagttagtgtatataagacgtatctatctatatatctaaagatggctgttgtacgctgcagctgattagtggattcaccggccatcaactttttgacacgtgtccattttctcagctgtgacatacgtcatctgtatatgagtcggtttttaagttcgtttttagaaatacatatctatatttgagtcgggctttaagtatgttctcttttgaaaatacagaagaagttgtataaaaaatctatttagaaaaacttacatgctaacttgagatgatcgaactcctaattgtaacttatgattttatgaaaaaaattatatatccaagtgaatttctacagtgaattccatcttatctaaaccgtataacaataataatgaaataaccttcacccgttgcaatgtacgggtattttttctagctaatataaaagttaaaaaattagataattgatatgtatagtatttcaggttttttttttcctgagtttatcactgtgcgtttgtgagttttccgtgtgatggaaaaaaataattatgtgacacgttgatgacgctactgtgcatacggaaaaaaaattctgtgcggcagcgccgcaccaagcttctcgtgcataccatgttgtcttctcccgatttcttctatggcgaagctgaccacgttaccccgcgcgacgtgcgcgccgccgagcatcacgtcgcgcaccatgtgccgctgcacggacgagaccggaggatgccgccgcaggcactccatcaccacggccctcaggtacgcgcacggctcgccgccggcggccgcctcgacctcgccgcacagccgcgtctggatgtccggccgccgcactaggttcgccagcgcccactccagctgggcgaccaccgtccccgtcgccgcgcccaggtactccgacacgaggcccaccatctcgccgtcggagagcttccgccgacgccgcccgtcgtccgccgggacctcgaggtacaggagagtgtccacgtacgtcgccggcgggggctgcaggaa

SEQ ID NO: 44427 - DNA, 13683 bp, Oryza sativa
gtccacgccgtcgccgaagcacgtggccacattgagcgcgaacagcgcggcgtacaggcagtcgcggacgggcaccaccacgcttgcccctccgccggcggagcgcgccgcggaggccgagacgtcctcgacgagcgcccgggcgcggcgcgcgcgaggccatgcaccgggtggaacgcctccgaggtgaggttgcggcggagcgcgacccagagcgggccgtgcggcacggtgttgatgttgtgggcgcggccgccggagacgatggaggtggcgccgccgccggcggggcggtcggagaacgcgtcggcgcggcggacgagcgcgtcgaccgcgacggcgccgtccctgacgacggtcgtcggcacgtcgcccaggcggacgccgaggaggcggagcacggcttcccggctgatcgccgccgtcttccacggccacggccgcctgacgatggaaagcaccgctgcaatcatcaagctcgccatggaaacagcgaatagtgaggcggcgtgaggtagcaagctgcccatctccatggtcgtcgtgctcgtcagctctgcatgcatccaatccagtgtgtgattattagctttattagtaaaagaaaaaaaaagaccgagacgttgctttcttttaaggctacttggccccggtcaatcgccagctaatttaatcatcgccctcttgcatagattcgttgaaatctatcctatcagcatgagctataaattgtgatttgggagtattttgtattgttaatcatgcatatggcttcttttcttctgagatttagtcactgcaacaacttgcattcgtcggttgttcttccagtaacctgtcaaaagcttgtactttcatattataaatgtctagtttttttttcaaatttctttaactttgataaaagcgtaacaacattttaaacaccaaacaaatatattattaaaatatatcaatgttagatttaataaaactaattttgttgatgctgtagatgaatgttattactttttttctctatatggatgaccgaacttaagaaaatttgactaaaaaaatttaaaatattttataatatgaaacagaggcaacagtacaatagaaaaataaccctgttctcatgccacctatagttattgtcgtttctctaaaatacagagtaattgacttgttgtttatcttcttcttttcctttcacaatagcgaaaattttgttggtccggcctagtttaatgcactcaacaggttcatttatttggacaagtggaatggacaattgattatttatcgtaatccatttaatattcaatcatatagatagatgactagaacaagttgggttatcgtcacgttgaaggctttaataccgatataatctagaataagttttctcatgagtttgtttgtaaaatgagttttacaaaagaatcaaagatacagcaactacagctcaatcctctcctattcagtcccatataaacgcggggataaattcaatagagaaatcgagacaacgagataattaagaagatgggattaaaacatgtaggtctaatcgaacaaactgggcctataactattttacatctgggcactacacataacacaagctccctttgttgtttctatgggtaattaattaacaagatatggacttctatccttagcatgaagcgcatcatgagtttaacaaataggttgcaaactcatgatgtcatctgctttcattacccgttttgccatctaattagtccgatcaatgatcaaatgcatgtggcttccaaaatcagacgatgcattgacagcttgggtatatcacgctctctttaaaaggaaagtaaaatgcacgcaaacgtatcatgttatctctatattgagagcgctctcggtttagtttttatactaaacaatatcatatatcctcctcgtgtatattttaacatatttattcatttgcatctgtaattgtcagaaaaaatctaacctaaatttattcggaagacgattaaataattgcaatgatattctatactctcctttgtgcataaaacattagttcgcacttttactttgcttgttttttcgagattcaactccctcctatgatagcctccctgaacaaaggctcgtatgaaaacggtagaaaaactatattaaccgttttgtacttaatattttccccgaaaacagaaccgaaaattgtagagccggaaaatttctcaccggagaggttcgtggtgggcatggatggagttggaaccgctcctcactgacttaatgaaaactagtaaaaccgatagaaacaaagctagtcccggttcgcaactgtttttagtccagttcagcaactgggacgcacaatctgggactaaagatggggattcgaactcaagatctctcacctgagaccttacgcgcgttaccatcccacctattacacacatataacatataagttagatagagatgctttctttttaaactaactctgaagacatttttagtccgagttggtaacaccaatcgggactaaaaatatctctagtctagattggtgccaccaactgaaactaaatatcaatttttagtccgagttggtgttaccaaccgggactaaatatctttagtccactaaagatcgttgggggcctgacatggcctgacagctatgaactgtggttaaaaatgatttttagcgtcggttcctatttgaatcgggataaatatgatttttaccatccgagtaaagattagttctttggtagtgaaaacaacaacttatgttcaacaccgtacggaaagtggtttcgatcggttttgtgaccatgcaacacttgctccgtgcatctgttgtgtcacaaacgatgaaggcggtggactggtggcgtcatgatttagtgtgtaagatctttttttttaaaaaaaaagggataagattcccatctttttggctctatagaagttataatcaatcattacaaagtctaacaataaaacattagtttgtattgtccctggcgtggatcgaggcagctccctcgacggcgcggatcgaggtcgactcccacacgtcgacatttattcttcttaggatgccggcggcgacccagaagcggctcggagtggtggcccgatggcagcggtgggatgtaaggttgcggcagcctttggtgaagacgacgacagcggcgacggctgcaccctcccctccgtaagatctggcgtgaggggaggcgccgacccagtggcggctcggcagcagcggcggcgtgcggaggcggtatgattcggacgccgcgggctctgggcgacctcctcacggcgcacagcggtcgcggcgggatcgaggcggcttcgtccccggcaaccacctctctcattctttgatccctggcgcgtgtcctcggcaccttcgttggcaccgccagtggggatcgaggcggctccctccccggccacagccatcagcgcggatcgaggtcggctccctccccaaccgtcgtcatttcttcttcttcggatgccaggcggcagcgcgcgtcccaggccaccgctgccatggatcgaggcggctccctcccctacagttgcggatcaagtgtggctccgtccctatccactgccgtgtcctcttcttcggtcaccggctaacgtccgtggccgcgtcagtgcggatttggacggatccctcttttctttattcttgtggttattttttctaaaaagccccttcattttttatgtttacagcgctacccctagaagcggaattttctcttctttgtgttgtatttctatgaaagacgaggggttttcggtaagaaacatgataggtatcaaacggtccgagaacatatgcgattttccgtgcaaacacgaggagcttttcgcaaagttgctaaccacgtgtcaaattctccgaggagctaaaaaaattccgaaaaagaagaaaaatcgtagccttacggctttaaatgattgatgatacgtcccaacacttcaattgtgcccccaccaaaaataaaggagctcagacacatggtgaactccagtaggcaactggcaatgtctgcaatcctagtggatgtaaaaggaagacgtttcaaataaacatggacgacgagttagcgaatttgtacacatatatatcttctactatataccaattaaataaggcgaagcttttgtctttgttttcatttaaaaagcaccttgtttttcctttaacgagcaatttgaattgaattcctatagattatatgtgttctctattcagtatttcagctggatatcattagcagggacccataatctcgagtatctgttttttatcttttcatgactcattgatcgtgtgcttgttggtagcagaggctagagactcattcatcgaatttttgtttatagtttaaatttcttgaaaactgaaattccccgagagatcaacttttgaaccagctcgaaatcacggaatgtctagatcggaaaccctgcttgcacattgtatttctccgatagccgatctaatagttctcagaaaaaaaaatgatagcctgtccagctgggccttaattaattccatccgtccacgtaaggaataagttcactggaggtccctcaacttaacagtgagatttttcgaggtcccttaaccacaaaatcagaaatgtgtacccctagtaggtcccatagcagtatttttgtccggttttgctgacgtgtcatcctagttagaaataaaaaattaaaaaaattacgtggggcccacatgtcaacgcacattttttcctcctcttttcttctccttctcttctcttttctctcttctctcttcaccggcagcgggcagcgatgggcgagcgcgggatgcgggcggcgggcggagagccggcggagtgggtggcgaagctggagccaagtgtgcttctagcgacgccgccacggtagacgaaacaactaatcggccatcgctgctccgcctgtctgctacgcccatcgaccgctcgccatgcaccgtgctcgcccgcccccgccgacgggagcgaggcggccggccacgccggcgtggaaggggcaaaggagggccgagagaggggtggaggcgacggcggtggcgctgccgggttccttcccctgtcgctggtcgctgaccggtcgggggacgacatcgacaccgcgttcaacccccaatggcattgtacgattctactgtttgctatatagctcaacggttataaagcttgaaggatgaattgaagcttcgcttttcttgagctatggtgtttctttgggttttcttcttcgcagggaggtgaccaggcgctgtacaacgggttcggggccgccggaatgcatggcgccgccgtcatgcaaccgccgacgttcgggcaggtacgcggccaagaaccagtactcccgtgggttcaacttcttccccaattcattctgcttctttaccagcgttggaaacaactacctgccaccgccgccgcgctcacctacccccgccgctcctgcctgctttgcctgccgccgcccccgcgctcacccgctgttgccccgcccgtctcggcctgtcgaagaagagagaagagaagaaaataaaggacaaaaagagaagaaaggggaagaaaaaagtgatgtggggccacattattttctctcactgacatgttggccccacatatttattttattatttttgctgattagaatgccacgtcatcaaaaccagccatctagatttctggtttaggggtgaagatttctgattttatggttaagagatctcaaaaaatctcactgttaagttggggggactccggtgaacttattcctctacgtaaatacgtaggatacttgggcttagaatctcggtatgttcgtgaggatgggccagaactttttggcccataaacaccttagagagccacacccaggtgagatccaaaccgggggaagacagacatcgatcgcacggtgcggtgctaaacgcgtgcggccaaatcaaaaaggagggcgcgagccgcgaggcgagcgaggacgagtccccatccacaccgccgcaggcccgcagcacgtgccgccaagccgcgtacgtgcgcgcaggcgcgagcaccgcaacggacaagatcgccaaccaaccgacgagacgagacgcgggcgcgcgcggcgccaccacgctagcggcaacgcatccacgcagcgcggcgcgtacgcacggcagcagcagcagcaaggctgccggtgtttcggctgtgggcttggtgggtagcgcgcggccgcgctcgcgctcgccttcccgcagcaacaaatccaccacgagacgcacgtacgccgcagcattctcgcggcctcgcgtggtttgtcgcgcggttagctcggtcgccttcgcttgcttgggagaccagaagtagagccgtaacagcgctgctggttttgcgcgcctaactctcatcggtgacattgcgaaccgaattcggagcggtttttgcttggtcgggggcattggacaaccagagcgtgacaccaatgcgagtcagcacggtacatatttttctgtatcataggcctgacgatgacgaggcggcttgtttttggtcaagggtatataggcaggtaggggttcagttgcctaacccggcctttgattttggtttggtacatgaagattcaagggttagaacttaggctgcgttctttttatgaagttgagaacttctcttctccacccataaaacgggatgattcattagcacgtgattaattaaaatattagctaaaaaacttttaaaatagattaatatgattttttaaaacaactttcaaataaattttattttataaaagaacacctcatttagcagtttaggaagcgtgaacgcgaaaaagaggacgtgaaagttgggaaagtaggggaagaatacaacctatgtggattgggaactaaacccccatgcaaaaaaaaaacatgaggcatattagcgcatgattaattaagtaacagctaaaaaaacttaaaaataaattaatctgatttttaaaacaacttttctataatttttttttaaaaaaaacatcatttagtaatttaagaagcgtgtgcatgaacaaggaaatggaggttggaaagcaccacaaacgatctcaaccttagagcaggtttaatagcttagccaattattagcttcaaatcatctgtagttaatctaatacatcatttatacaatagtcatctataaatatatatactacatcattaatacatagttccacatctcatatacacaatatttttcgtactgcggatgactacaaatatgtaatccgcttttcttctctctcctctcttatctactacacgtgctcataacccacttgttgtctgctgttgtacttgctttgagaagagcatccaatctactactccttccgtcctataatagaagggattttagaggatatgatatctcctagactagaaatctagacagaagtctgctcagatttgtagtaatatgatatgtcaaatctattcgtaatcccttatattttaaatttaaaaaaaagaaaaaaaaaacatcaactctaataatgtgatggtagcacagtaaaaaaaaaccagaaacagtaccggtcttctccttgaacgaatccctatcaggggtcccaggcaccgctagctagctgggcatgacagcatttctagtacagtttaaggcgttgcctgaccacgtatcgatcgatggatatatattcgctccgtcatctaaaaagcagaaacaacatgtccgcgattcctctctccctctcccaggctagtaccaatatctatacaccatgtcagttgctactagttcagatttcagaaccctcgatgtacacacatactactctactgccgcgccgcgaaattcccaggagaactcgcacacacatactcctactcctacgcaggtcatccagactgcaagaaacgaacgagaggcatcagtcatcagctgctgcgcctgcgttacttgcagcgacctgcacaacgagcagcagccagggtcggtaccaccaccacgacatgggtagaaacaattgggacgacattggtagaagggtaaattgtaaccatactattataattttgtaaaatttaagatatgacatcctgacccacatgtcattgactcatgtggatcctacatgtcattgagataccgatgacatatctcaaactttgaaaaattataatggcatggttccaaacttggtagaaacaccacggtttcacaatttccgaaccggggtaaaaaaaacccactcaatttttcggtaagtttagaaataccaaagtgaattttaatttgtttatagaatttgtttgggttttatcgtgtttttttttcagcatatcaaccgattacgcaaaatccgatgataccgcctgtgagcggattttgatccgctatctgttgtatcgtgaaccctgttggaaacatttggaggtgttctgctcctctcgccccgacgacgtgtcaaagctgttgctcctgcctctcctgccacacacgcagacgcaggcagtgcaggcccgagactgagaggctgtttggttgctaccctgagcaacatgcctgagtatttttcatgcctgaggataggctgagcttgcttacaaaagttacctgaccaggtatggcttaaatttaagatagtgtttggttaaagccctgagaacatgctatctgaaaaagtgctctcttttttctagtagctctcacgcatagagcttagctccaactgatggcaccagattttagtggaggaggaagcagacggccaccggatctgcaaggtggagcagccccttagtcgctgccgccgcagccatggatggatcgatggggattgttttctcctcctaaccctacggtggtacagtgaggaggagaagtggtagaagagaggtgattctactcaggcatgttgggggaaatgccatggcttgctcaggcaacctttttgctacgcctgactcaggcaagtttcgtcaagcaagattcctcaggctaaaattcttagggtagcaaccaaacacgtctcagacagattataggcttgggctcaggccaggctggtttgctcaggtagcaaccaaagaggctctgcctgcctgcctgtgcctcgctctctcttctttcgcagtgcataaaaagcaatcaaaaacagggtagatgctggccatcaggccatatccctccgtcccaaaaaaaaaatataaaccctgattttcgtgcccaacatttgaccgtccgtcttatttgaaaaaattatgaagaaaattaaaaagacaagtcacacataaaatattaatcatgttttatcatctaacaacaatgaaaatacgaattataaaaaaatttcatataagacggatagtcaaagttggacatggaaactcagggtttgcctatttttaggaaggagggagtatattacttgtactgctgcattctctgctcagagcctcagtaacaaacagattacagatcactatactaagggcatgtttaattggtgaaataaaaatttttggatgtcacatcggacgttttaccggatatcggaaaggtttttcggacacgaataaaaaaactaatttcataactcgcctggaaaccatgagacgaatcttttaagcctaattactgtcattagcacatgtgggttactgtaacccacatgtgctaatcataggtaattaggctcaaaagattcgtctcgcgatttacatgtaaactgtgcaattagtttttattttaatatatatttaatgctccatatatgtgtccaaagattcgatgtgatgtttttgggaaaagtttttgcgaactagtaaggtggtgtttggatctagaaacttaactttagtccatgtatttagacactaatttagagtattaaatatagactacttacaatactaattatataaatgaaagctaattcacgagacaaaatttttaagcctaattaatccataattagataatgtttactggagcatcacataggctaatcatggattaattaggctcaatagattcgtctcgcgaattagtccaagattatgaatgggttttattaatagtctacgtttaatatttataattagtgtccaaatatccgatgtgataaaaacttaaaagtttcagtcccatttaaacagggtctaaacagggcctaaacagatagtactgtagcattaggcattggtccttgattactgcatgctgttgctactgcttctctccggtccagtctttcgcttgctgataagttctgaagagatgccgacatgagtggttgaggtttaacggtttcaagcttatactccatatgagtaacaagtatattctagtactgtaacaaaagaagttgtttagtactttgtattatagtactttgttgaatatccaatgtcgtagtacgtgtgttctggagctgcctggtcctgcaatgctgtagcttacttccaagtcgagcaggacaagcagattcctgggatgatggtgccggttgggctgctccggggaagacacaagaaattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctggcctggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatccttatatgcccataatctcaacagaaattgccccattgatcgtgaccaaaactaattataaattgtaatggtttattagtgataaaaagataattgatgtattaaacttatatatatatatatatatatatatatatatatatatatatatatatatatataagctcttagtagcttaaaagctaatgttttttttaaaaaaagactacgttgaaaatactcaaaaattaacttcaaactaaaatttagacagaggttgataaggttgtagagtaaactacgaggccccaatgtctcctaccggtaacgaatgaattactgctgaaatcgcgactatttcgtgccatgaaacagtcgagaaaattaaaaaaaaaaaggcagagacacgtgcagctagacgtattaagctgtggcaattgatacgtgcaaacgagtaggtgaaccaaaccggccaattcggcgtattggacaggctgatggccataaaagtggatgcatcgtgccatcacacaccaccagaaatattcaagacgtttcgtgttaattaggagtaattagtactccagtgtactcctacatacacataataaattgaagacattgagagcttttgcaatcttgcatagattaatctgtcgatcacgtacgtacgtgtatatatatgcgcattaagtcatcgatcgaaatggacgtgtacgtacacgagctgctagctccatggatcgtacgtagacttctgtctctctggatatatacatatggatatatgatggatcgtcaaacacacaatgacacaaagctaaggagaatttatcaattattcctgcgtgcatgagtcacgctggccgtaaaacgtacacttcaaaataaatgcggcaatattatatagaattaatactacttcataaaataatcccagttaattaactaagtccatgaatgcggcaattgtgtctaatatggagtaattctatccaattcagcactgttgatccgttctgaataaggttaagaacactgatgaaatcagagtgagaatttctctcaaaaaaaaatcagagtgagaatcatctggctgtagcaacatcaaaagcaataattaatgttcctaggctgcaggtgatcacgtgcctaaccatctaggttatctcgttaaccgaacatattaacttactcattggaacctaccattctgatcctacgaccaatcaagattaccaacatcactatactgtctatgactgcatctaacccaatactccctccatttcaaaatatactacaggcttgtgaccaaagtagagagatcagatgaaccacaaatcgaaccacaaacctctcagagcttccattaagtctgtgttcgggaggaggggttgggaacccctccttcccggaacacaaaacgaagatcgttttattgcatgattaattaagtattaactattttttttaaaaaatggattaatatgatttttaaaaaacaactttcatataggaagtttatgcataaattataccgtttagcaattttaaaagcgtgtgcgcagaaaataagagagatgggttagaaaaatgagggaagaacacagcctaaatctagtagcagagctagctcccggggagattagacggtcactcgggcatcgccgttatcatcttcactacagactaccataacacccggtaaaataagtcgatcacccaaaaaaaatactattagttagagcaatcaaattccaaacaattttagctaatcgctagcgatttgccgcccgatcgagtagcaacgagagctgaaacctgaaaagacggtaactgcactgcggctgatcaggaaggagtccggttttgactctgtcgaggattcgaggctgcgcatctgcgctggattttttttttctgacattggtcttgttggatcctccgagctactccctccatttcataatataaagcagaactacttttttttaagatgttccataatataaagcacacatgcatgtaggtaattaactaagatccattctctattaaattattacttttttaaatccttcactctcatgttctctaattctattggatacatgcattatatttattaggatgatctaaactacaagatgataataattatttcttggtttt

SEQ ID NO: 44428 - DNA, 6466 bp, Oryza sativa
tcctaaatagcaagattcagaagggctatttaatagccctccggatccaaacagggccattgtgcggtgtcacttcgtgttcctagctactccaccttaccacactacattgtaggttttgttggggaccaagaaaacacgtactccctccgtccaaaaaaaaagacaaaccctggtttctgtgtccaacgtttgaccgtccgacttatttaaaaaaattatgaaaaaaattaaaaagataagtcacgcataaaatattaattatgttttatcatctaacaataatgaaaatacgaattataaaaaaatttcatataagacagaccgtcaaagttgtacacgaaaactcagggtttgtttttttttttttgacggagggagtacacaaaatattccgtagctctatcagagttgagctgatcgacagaaaccacacacggaactcgatcgactccaagaaacgtctccattcattcggtagctttagatttaggtcccccaatcttaatcgttgttaatactccgtgttacgtaaggaatcggagtatataacatggcttaattggaccatcaatcggttcttgcaaaacactaagtacttgaaaaggatgaaaacgcatggacgggatgatttgtcgagcgccacacataggtgatcttaactgttgatttgcgatttctactatcagtaaatatatatatatatatatatatatatatatatatatatatatatatatattactagttattatgatggtagtataaatagatataattcattaaattagaaaatataaatgatctagattatgtctgctactgaagaaaatattgtagaacaccttttaatttgtcgggttttttctgaacgaattaatttgacagttgagtcttaaacaaaagaaaaagggaaaaaaaactcaagtagtaggtgaaatttaggaggttaacctcacaatttttgaatatgaattgattgagctacggatgataaaccgtagaatatgaatggaatagcttaaaaataatttatgagtaaaaggtttacatttttattattcgcgatttaaaatacaacgattgaaaatcaatgaaagaacctcaaattcaacctttaaaattaaatttgaaaaaaaaataaaatttggttacaacagtaatccaacaaacaaggagataatgaagcttgccccctgactctggcctgtctcaaactctaaacatccaagtcaagcctggtttagttccaaacttacaactttttcatcacattaaaatttttctacacatataaacttccaatttttccatcacatcgtttcaattttaaccaaacatctaattttagtgtgagctaaacacacccaagttgcatgagtctcctctacaatggccgagtttagttccaaattttttcttcaaacttttaacttttccatcacatcaaaacttttctacacacaaacttctaactttttcagtcacatcgttccaatttcaattaaacttttaattttggcatgaactaaagttgggaactaaaccacaagcgtcagtgaggatctttttccagccaagccatggccatatcaaccccgcatgcaggcagccatgcatgccatgcacgcatcggcatcactgtccaaacggcagctgcactctgcaaaccgttcctctcgagctcgaagaagtttggagtttctcccctggaaggtactccctccgttttataatagatgatgtttttaactttttattcgtaacgtttgaccattcgttttatttaaaaaattagtgtaaatataaaaaaagataagtcatatgtaaagtacttttgataataaaacaaatgataaataaaataaataataatttcaaaactttttgaataagacgaatgatcaagcattgacaaaaaaaaactcaaaaagacaagtaatataggacggagttagttgcagcatctcgctctcactctcgtagtagtcagtctcgtcacgaggcacgagctagtatacctggaatcccaaaatccagcgccccaatctcccctccctgaactgtcatgtcacctcaattctagcggaatctccccgtgctgtagcatggcaacgcccgctgctatattgctatccgaagatctggcgatttttggccggcaattcgacaagttttttagatcgctggccaatatagtgcaaggatcttggcgaggccattggcactgggcagggggggcccgtggatgcatgtggcgttttccatcggttttaggtcggtttggtactttggttgtgtgtttgtttgatttgtcttatagtttggtttggtactttgatttgatagttgcacgaccctattgattcacttatgtttatacatgtaagaaaaaatttaaattttaaagcttaattttaaagttgattttgtagtatcattaatcatggtttattttatagcatttattttttatcgctaagaataagtatataaaagttttgagtaaatttcacaaaactacatatatattgaccaaaatatcacaaaactacagatttaaaatgatgcatcacaaaactacatatttaacacaaaatttatcacaatactataaatttaaggtggaatatcgtaaaactacagatttaattacaaagttatcacaaaactacaggtttagcatcaatttaattgcaaaacatggttttttaaactcaatcataacattagtgctaaggatttaaacttgtcagggttacgggtaaggtataccctctacccttcgatatacgtcacacatcgataaggtatacatacgcgtatacggacgttttcggcatacgttaaggaaattcatcatggagttcacagatggaaggagtcctactcggacaaaaccgggtcatcattgtatcgtgccgggtctgatgtctccgagtcctacttggagaccagttgacctgcgatataaaagggacccccgggaggacctaaggcatcgaatctcatagccaggacaaccaccatagcctatgaagccggggcctataggattcaagtcgccgggtgatctagtcgaatcaactcgactacgatctcgtcggtatcatcgagttccgcttttccctttgtaatctgtggtttccatcatataatcccataacaactggattatggctattacctatcaaggggcctgaaccagtataatctttgttttctgcctgcttgatgtcgtattacgtagatcctcgtaccagcgtaccccaataccctctatatccggtctacgggtatcccccgtccatcaaactccaaaacatatagttttctgataattttattattaaacctgtagttttgtgatacatagtcttaaacctgtagatttgtgataattttattgttaaatttgtagttttatgatacatcaccttaaatctatagttttatgataatttgatcaaaatacctgtagttttgtgaaatttactcaaaagttttttttggctaataagctgtacaaatatgataagcgaaacaatggggccatggtttgtgtagataaaattgagttacaacaagtaacccggaaatgaattgaacaacccaaatcaatattttataggtaaaacttctattttttttactagcggtttaaaagataatataaaaatagactatatggaataattttaaaatcaacttaaaattaagcatcaaactttaaatgttagctacacggctgataagataaaaagctaatgataagaggccttcctgggtttaggataaaggctggcgtagacacagacagtaagcacatgttgtttattcggagaagaaggattctgatctgctcgtgggattgaatcctgatcagggttattttgatctctgacagaagcttttgtgattgcgagttgtatattctgtgcgagttttatattggtcacgaatatatccagcatctgggatcatttcttaattggaattatcttttcttagctaaagagtgttttagacaaagtgagatgcatcatgctgcagtagtagtaagctaggtcaaacaaacaagtattggttggtcaaccaagtacacagaagcaaatttcttccttgcgtttcatcttcccaagagcaccaaattctcaattttgcacagcaattctactctaccattgtttgaaattttcttccatgttatgaaaaagaaatgatcacggcgattgggtcaatagctcaatcagcccagaaagaaaataagaagaagaagaagaaaatttccgttgttctctgacattattcaagccaagatatccgaaatggtcagtttaatcaatctttttttttactatccagtgatgaaagcatagaaaggtggtaataacatactccctccgtcccaaaaaaaagacaaaccctgatttccgtgtccaacgtttggccgtccgtcttatttgaaaaaaaattaaaagacaagtcacgcataaagtattaatcatgttttatcatataacaataataaaaatataaattataaaaaaaattcatataagacggacagtcaaagttggacacggaaacccagagtctgttttttttttctttgacggagggagtaaacttgcaagtgacgctagaacaaggaccaccacctgacctgtctgcaagaaaaacagagcacttggagcaagcaagcatcaattgtacacagtccatttcaagaataaattaatcaaatattgcaaaaataagaatggatgcagccattaaattttggtattagataataataatggaagacaatgcatggatagatagagagatatacacgacatgaatccatatgtatccaaaataaaaagaaatcacccataaattagtgctcatttattggacaacatatcctatgcacacaggtcctcacgtgtacacacgtgcacaccaactaaaaaatgttaccaaaaaatctagaaaaaatcatacacatactttcaattgtattacacctagggttaaatcttaacgtcaaattcattatattttagccgtaacaaaaaaacaaaaaatctgacagtgcaattttgtcagaattttatcttttttgttattctctatgtagaatgaatttgaagatgcgactttgcacgtagatgtaatactattgaaagtacatgtatgaatttttctaaaattttttgtgataatttttagttggtgtacactgtgtgtacatgcgaagacttgtgtgcataggatacgctcccccatttattgatgcatatcttggagatatgcaagattggaagggcgtatatttagagcactacatttaagagtgccttcaaatactagaatacatttaaacgtagtcgtatctgtttgtatttttgtgttgaatacatgagagaaaaaaaaatcccgtatttcgaggggggaaaattgggtcacatggctttccgcgtgggggatgctactgttacttcagtgagggaagggaggggacacggacctagagcgcctatacgcgtagggtaatgacaggtggggcccacggagggtggggcccacatggcagtgtcaggtgtgccactgaccacatcctccctacgccatggatgatggattgcactatgatatgatgatcactcgcataaatccagttgaatcgcaccaccaaagagagcaagatgatcaatttgatcgacggatgtatcatttgatttttcacgcggttgaaatttcacctcctctatcaaaaatgatatggtttaatgatggctcgtgaattgttttacaatgtttcagtggtagttagtcttctttttctagataaaaatgaacgacgtaacggtttaaacggtaatgacgatggtgtacgctcgttatcttctagggcatcgcttgtataacggaatttgtcgtttgacgtgcatgagttagatacacaactagtataacggaaagttggattattcgtgctcgtaaaacctaaaaaggtagaatatgagtaacggtatcaacgatcatattgatattgaaaattatataaatgagacatatacacctttgttgggaatcaaaagaaatcctactcacattaaaaaaaccacgtgctttttaaattatagccgtctcccttacaagagttgcaatgcaaattacttgaaccgtttaatgcttagcatcccattctcatcaaaagtaaagacacaaaactccaattcctcgcaccccgttcaacacatatccaatggtctcacgtccatgatttcaaataacaaatgtcaccgaccgatcactactagaagacacacgagaacatgtgtcgctagccacaacaataaagagagttagagaggggaaatccctaaaagccccccattaaactcttggaagcattcttccaaactcgtcagccgtatctctctgtgtacatctgtacaacggctaaattcaa

SEQ ID NO: 44429 - DNA, 719 bp, Oryza sativa
ggggacgccgaggaggaggggggcgagccggcgaggtcgtcggtggcggggagcccgtgggcggggagcccgctccccgagggcatcgcaccgtcgcctgcgccgtcggcgaccacgccgaggcggttcttcaggcggccgttcccgccgccgtcgccggcgaagcacatcaaggcgtccctcgcgcgccgcctcgggcagcggtcgccggccacggcccaggcgcagcaggccgcgaagccgcccgccgaggtcccgatcccggagcacgggggcgggggcggcgccgccgccggggaggtggagcgggagctcgacaagagcttcggctatgaccgccacttcgccgccaagtacgagctggggaaggaggtgggtcgcggccacttcggccacacctgcctcgcgcgtgcccgcaagggcgacatgagaggccaactcctcgctgtcaaggtcatctccaaagccaaggtctgaccattcgtgatctcactctcctctctctctctctctctcaaaaaaaaaaaaaagaagtgcacaatccatcgaatttctttagacttagctcgtacatagagtcgccactttgctatgatccatcgatgagttttatgatggatcaggattggtggtttggtttggcagcaagtatttagccacctggtaattccatcagcagacattgcaacagcgatttaatcatttgcttgttaggataa

SEQ ID NO: 44430 - DNA, 1188 bp, Oryza sativa
gcatatttttcacccaccaacttccacaactggacaaataacaatctgaacccattcgacaatgatttttttatcacattgtagtggcattcgcttgtgtaaactgtaaactcctgttatgattgttttgcttatatgggtcctatttagttaggtccgcataaaaaaaaacttacttaataggagattaggagtttgtgccagtaaactaccatctgaatcaaaaaaaaaatcactggaatagggttggggttttatttctagttttcatagttcggggtgagatataatcatttttttttggttcagcgtgaaaaggtggacttcaagaagaatttgagagcaactttacaaagatcaaaacaatcaactatgtaaggatggaaagtcaacaatatcttaaggaaagaaaagaaacgtactccatgattatgtagacattaagggcatcctcacatgcatcataaaatttgacaagattcgaatgcccagataaagccttcagaattttcacctctctacgcacatcctcaattgatattgctgttgtcatctgataaaaaggaacacaaaattgagatcatgttccaaaggtaaatgtgaatatgtaataggacaacccatagaacttctattttatttggccaagtgcaaacaaaatttgtgctaactgattgatcatcctattagatacttgttcaagcattaaaattaggtacttgtgtaaaaagaaaccattgccgacatgctgatacatactatatatattacagaaaggaatgcaattacatgagatgcaaatagaacaaaatacgaaagaattgaactacattaaacaataaatatgattggggctcagtaatttatggaagtagtcttctgcagtgaataaaattgttgtgaaatggaatagtcaataacaatgcaagtaataatgctcgatcaaaatgtgtttacatgcacaagaaacatcaatgctctcgtgcacatatacgtgtacgtacatttgttatgacaatgtatactagattttggcggcaatttgttgggctgacataaagaaacaggaaataaagattgaacagtgtctaattcagtaatacatgtgatttcaaggacaatcatcttattatcaagattactcaactaaggaaccaaaatatagaagatacttattcaccacacaaa

SEQ ID NO: 44431 - DNA, 1668 bp, Oryza sativa
gtctgtagactacccctcgggtggagcgtataagtcatactcctaggtctttagtaagcttcctagaagattcacccaaaatcttcatagactgcaaccaacagtcaagctcacaaaggtgagttccttcaagaatgctctgcaggacaacatctttgctaattaaagccaacagaactcattaaggcatagccaacctgccttgcagctcacaagagtatatgcatcttcacttggatagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagtcggcaccggtttttcaacaacaggcagatccattaatagatcacgcagccattctgcctcaacagtagcagtatctagtgccgttagttctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagtcccaattccacagtacctttcagatagcgcattactcgctcaagcgcacgccagtgatcatctcccggattagaagtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagagtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagt

SEQ ID NO: 44432 - DNA, 2038 bp, Oryza sativa
aggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggaagttttgcaataatgcacccggccacaaatttgtcgggtaagacacacttaaggagttcgagtaccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtagccacagagtgaccctgatctgccatctcttaaaatgcacaccggtgaatttatccggcctcagtgcatcggcaaaaccagccatagtaaaatcacagtgcctataataaggtttttggattgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggtgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaaggcaaaaggaggctgcatctgcgcaagggtgaggagccaatttttcggaccattcgacgcgtacgtcgtgcacgcgcgccgcctgccctgccaggccaggccaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgta

SEQ ID NO: 44433 - DNA, 725 bp, Oryza sativa
cctattaagaacacagacttagcgagacagtaacttatagtaaacccctaaccttactaaattcctatgaaaaaacgcaattgcgtgtgcataataagcctgctggtgcttccccgcaaagagttaaaactagtcctgttcattcaagtacagacgtgcaggtagtgcctgttttcagttcgaccactcttcttcgtatgctctaaaatgaaaacaaacaacccataaggcaagaacttctgttcatgaatttatgctaaattcagttgcctgttgatcccaggcaaagatctcatatctcctgcaatgtacagctgagcagtataacaaccagacagcgagtaagatatctcatccccttgatctgtttgtgttttgttttttttttcctaagtacctttcgtacctgaaagcatttgttaattgtcctgagaacaataaagtggcgccgtaccattgtccggcaaaagtaaaacacactacgacatttgcggccttctgcccccatctgcattggattagtcaagcaatagcagtttagaatcgagtaaagaacacagcaaacaaaaagtaaattttaagacatcattatcatgatcattgtcaacatcatcatcagatgtttacctgcggctgcttctttggagaaacagtatgcacctaggtagcaccagtgcaaatagtgcatgcaaaatactcaaatatagatggcatggaagaaagtt

SEQ ID NO: 44434 - DNA, 947 bp, Oryza sativa
ttttaaatgctgtttactgcaaaacttaacccctatattattatccccttgtactcccttgcattaattatgcatctccggtgtggcttgctgagtactgtggttgtactcattcttgctctatctctctccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacgctagtatcaccatcctttggagtcaaagtccacctgaggatgcggttgcggtagatatgaaaaggcttgagtccctctgtggtcccaagtcacattttacaagtcacatttttcgtccatttgagtttattttttgtatggttggttcttgtgtgctcctaagcgtgaaaaaaaaacaaaagaaaaaaaattgcaggggggcgccagccacattggcgcgctctccctgccaccttagcgccgacccgccacggtggcaggagaatggcgccagcctctctggctccatcccgttggatgacggcgctagtgactcctgcgccccaaaaaggatcattttttggataagttttttcagggatctatttgcgaaataagttattcaaaaggatcaaattgtgaaaaatccagcagcccatcgctgttttcagtccgagggagcggagccgcgacgactagcggctccggcgagcctactcctccttcctccgatgagtcctctcctcctccctccggtaacaggttagctcttttctcca

SEQ ID NO: 44435 - DNA, 704 bp, Oryza sativa
cgcgatggttgggttccggcggtccttgcggagacagcaggtcgtggaggtagcgccacttgtggtcctccatggcgcggagcgcggcggcgccgtggtagtaggggccgatggacaccaagcgcggctcgtaggaggtccggctgctctcgcgaagaaaggcggggacgcggaagatggtgaacgtctgattcgttctcgattggactcctcttagaacactcaaccttgcctccaccatatcttccaaccgcgccatgcttgcaactcactgggagaaatacaacagctttctcctaaaatataaagtcactggtacttagcttgatgttaatacttatttcgttagttgagatttatagcactaggtgatatctaattaaatactatgttgctagtacattttaggatggacaaaagtttgtttagtttcataatcagaaatgaagttaatctatctattaacttatcaaaggaatagaaaaagaaccctccacgttcgctctcatagcctagaaattctcacattaatcggagaaaaagaaaaaatagagtccatatagaaatacaatttaaaaatagtttaaattcggaattagaaaataagaaatattaaaaaagagactgaggccatataggaatacaatataaagctaattaaaattcagaataaaaaaaggaaaacatagtctatacatgaatac

SEQ ID NO: 44436 - DNA, 1241 bp, Oryza sativa
caattcaaagcttagaaggatgtaatttacttcctccgtttcacaatgtaaattattttagcatttcttacatttatattgatattaatgaatcattttagcatcactatgaatatggaaaatgttagaatgacttacactgtgaaacggagggagtaggtgatttcaaaagtaagaattgtcaaaaaaaaaaaagaattgtcatatgaatgaaatctagcaaataattaattataaataaggcactcccccgtttcatattataagtcacatgaactttttttctagtcaaagttgaaaaaaatttacaaaaaatagcaacatttttaacctaaaataaacatattatcaaaatatatttgaaagttagttttaataaaactaatttggtgtttttctaagctttatcaaattttaagaagcttgacttaaaaagtcagagcatggagggaatagaaacgattgaatctgtaaggactgattttaaattttttagcagttatttcaggtgatttttttttttttgcaagcggttgtagaccgagctattttttttttaactacgcaccttgtgcctcgcagcagtagaacccctctgtttccaaccaatcaaaccgttccccagccggctcttgaacggtccacttcgcaaagccaggagaagagccacggccacccccacgctcgctcccaaaattctctaatcgaccgatttctcctctccacacgaacaggtactcatcaggcttacctagctctgacaacttcatgccgaaatccttccttcttctccgtcgacggcaaaagaggcacctcggcatgaaacacccgacaagtacggtaaaagaagaagggtctggctagctatctctggctctgttaatatgctgggcagttcgcttcaatggcagccttccttttgtagtgacgagtagctagctaggtcgctgcataactgtataagcaatagcggcatgcaggatgcgcacgcacggaacttgagagagaaagttaattagaggcaagtggtgatgctcaccttaaatgtcaacgaatcaacgcgttggtgatcgtgcattttctgctcgatcgactagaaaacgtacgaacaaaaatgtcaacgacgacttggatgaccaaatgcgtgccgtcgcgctgggtttcagatttttcagtgttttcgtatcaccactatttcgctagatttgccaacccatggcggcggcggcgtcgttggaagc

SEQ ID NO: 44437 - DNA, 12224 bp, Oryza sativa
cctgttactcgaacattggcacgactcgtccgcctcggtcgcacctgatgccgaaccgggttcgcttcctctgaagttgttggactgggtacagtggaagtagctgcaagtgtaacatccccccctccttgcgaaccggcttgcccccaagccggggcagcaggaaactgattgcgaagcgccgcagcatcctcccatgtagcttcagcagaagtttggccagaccagcacactttcacttgttcaattgtcgctgctccccgtctgaccgcgcggcgtaggtactggactgtcttgctccagagtaggtagcggtcggataggttccccagcagaaggttgagcggccttgcgtagttgcgatatatgcaccaccggatgaatggtacagtcctccggaagcttcaagcgatatgccacatcaccgattttgtccaacacctgaaaggggccaaaatagcgaaaagctaacttgtgattagtgcggacagccagcgaagtctgggcatagggctgcgccttcaagaacacccaatcaccaatgcagaacactctatcagagcgatgtttatcaacttgatctttcattcgttgctgggcatggaggagatgctgacacaacaaactcgtcaccatagcacgttccttgcgccattcttccaaatcagcaacagcgcaggtcactccgtccaacacaccaaaatgacgaggaggatgaccatataataccttaaatggggaagaacccaaggcggaatggtaggcggtattgtaccaaaattcaggaagcgccaaccagcgagaccaacggctgggacaagcatgtacgaagcagcgcaaaaaggtctccaaacattgatttacccgctccgtttgcccatcagtttgagggtggtaggtagaactcatctgaagttgtgtcggccagacaaaagagctcaattccacagtgcactcgtgaaaatacgatcacggtcagaaatgatagccagaggaagtccatgaagcttgtacacattgttcagatagagcaaggccacatcaaaggcagtgaatggatgtgccaaacccagaaaatgggcatatcgactgaatttatccacgacaatcaaattacagtcgaatcccgaagatttgagcagtccttcgatgaaatccaaagacactgtctcccaagcctgatctggcgtgggcaaaggttgaagaagccctgggtaacgcaccctttcagatttagcttgtttacaaacggcgcaatcggtcacaaaagtctgcactgcccgcttgagacctatccaggcaaacagccgtttcacttgactgtatgtgacctgaatgcccgagtgccccccaattgcactagcatgcaaggctgtcagaatgcgatgctataaagctggattagagcccacccagatacgccctttgtagcgaagtactccttgctgcaaagtgtaatggggataccgatctggagatagcagcacttgtgtcagcaattgctcggtagcagggtcagtcttgtatccttcctgcacctcatttaaccaaaggggtaccacaactgatagagcacaaatttgcataggatcagtctgcggacagcgagataactcatcggctgccttattgtccaagcccttcttgtattgtagcttatactgaagtcccaaaagtttggtcatggctttctgttgccatggagtggccagacgctgatcgcctagatgtattagactgcgctgatcagttctgataatgaactctccaaattgcaaataagaacgccaatgatcgacagccaacaaaatagccaagcattctttttcatatgtggacaaacctcaattcttgggacccaaagccttactcaaatatgctaagggataacctgcttgcataagaacagctcccactccacgatctgaagcatcagtctcaatttcaaaagttttggagaaatcgggcaatgccagaacaggagccgatgtcaatgcctttttcaaagtatcaaaggccagctggtgcttggctgtccagaggaacacagcatgtttcttaagcaagtcggtgagagggcgactgagaacaacaaagtggcgcacaaacttccggtagtaccctgccagtccaagaaaacctcgaacctccttcacattgcttggaatagcccactgctgaacagcctgaacattcttaggatctgtagagacgcccgccccactgacaacatgtcccaaataagtaagacttggctgggcaaacgtgcatttggagcatttgaccttcaattgatgtttctgtagaagctgaaaaaacttgtttaagcaatgacacatggtcctccagattactgctataaacaagaatatcatcaatgaagataagaactcctttgcatagcaaggggggtaaaatagtgttcatcaatccttggaaggtggctggggctccggtcaagtcataagacatcacacggaattcatagtggccattgtgagttttaaatgttgtcttatgctcgtcttcgggtctcatacggatttgatgatagcctgcccgcaaatccaagctagagaacagacttgagccagccaattcatcaagaagttcatcaataatgggcaaaggatagcgattcttgactgtaatagtgttaagatgtcggtaatcgatgcagaatcaccaagtaaggtccttcttcagcaccaataagacaggagacgaaaaggggctagaactgggctgaatgacaccctgttttcagcatctcggccacttgtttctcgatctcgtctttttgggcaggattgtatcggtaagggcgcaaattcaccggctgtgctcctggtgtcaaaggaatagcatgatcaaattcacgagctggaggcaaaccagaaggctcatcaaacacagaagcaaaatcctgcaatacttgagcaatgactgatggaacaaccggtcatagagtctcctgttcaataaggcagagttccactgtttgtaataccgagtgatggtgcaataaccccttcacctgagaggccgacattccagcacaatgagagacgtctgagcgaacaccccgaagacacaccctctgctgattatactgaaactgcaaggttttttccctccaatcgacttgcatagggccgtgagattccagccaatccattcccaagatggcgtcataagttccaagaggcagaatcttcaagttggaatgaaaagagattccctgaacccaccaaatgcagtcgaccaattcctgagtgcgttgcaaaagaccaccatcggccactcgtaccttgacagcaacaaacccttgatggcgtcctgacagttgggccgccatatcctcagagatgaaactatgagtactaccagaatccacgagcatgagtacctcatgttgctgcacccatccttgcaaccgcaatgttcccgttgtttccaaacccagcacagcttcccttgagatctgacaaagctcactgtcagcagattgcacaggttcagatgactcagcttcaggttcaatatccgagtccatgatgtgatcatccagcatctcccaaagctcttcaagcacatgcaattgcactgtcggcccacacttatgatcccgactccacttttctccacacgtatggcacagccccttcgctcggcggtaagcacgaagagctgccaatttttcatccactgccggcgtttgcagttcctccatctgccggcgatcatcaacacggggacccggccccgctcctggtcgcggatgaacaggaacactaggtttcgcaccaggacgcccattgctagagaaatccacctggcgtgcctccctccagttggtctccaacacctcctgtaaacaggccaaatcgacagcagtgtccaagtcaacaggacgatggagtaccacggcagatcgaatgtctgctcgcagcccatccaaaaattgagtaacaaaaaactctgaattccatgaagaatgatgagcatggagattatgcatgagttcactgaatttctctgcataggtgctaaccgaccctacttgacgcaaacgattaaactgacggaccaagctctgaaactcttcacgaccaaattttagacaaacagcttccgagaactcctcccaattctctaattcctcatgaaccttagaagactgtaaccaagtaattgcacttcctatgaactgcaaagctgtgactcctacacagaactcggcactaatctgtcagggttgcgggttgggtataccctctacccttcgacatacatcacagatggaaggagtcttactcggacagaactaggtcgtcattgtatcgtgccgggtccgatgtctacgagtcctacttggagaccagccgacttgcgatataaaagggatcccccgggaggacctaaggcatcgaatcttaccgccaacacatccaccacagcctacgaagtcggaccctacaggagccaagtcgtcgggtgatctagtcgaatcaactcgactacgatctcgtcggtatcgtcgagttccgctattccctttgtaatatgtggattagggctattacctatcaaggggcctaaacaagcataatatttgttttctgcctgcttgatgtcgtattacgtagatcgtcgtaccagcgtaccccaataccctctatatccagtctacgggtatcccccgtcgacagtggcgcgccaggtagggggacttggtgctcaagattctactactatgacatccagcttcgtcgacaacagcgtcaacaccaacctcaaccaaggagttcctacttcaacaatgctggtgtggactcaagtcggcaaaatcgtcttcccggtttacaccacggtgccgatcttagctggtccatcaatggccggaaacgagaacgcagtggctactacccagggcgattccatgttgaaggatcctcccgccgaagcggagatcggaacatcgacgacatccgagcctgagaaggatcctagtgcggccaagccttgtcgttccgacaagaatcacgagccgacgaggatgacttccgaggtgacaaggtcctgatgtcctatccacaaaaccagaaaacacaccttgcaagcctgctgggtttttctcaacgtccacgctgaaattagtgcctacaaagagcgtggaattcagcgtacttctccaactcatgatgtctattgtcctattcacaagacaaagaatcacgacctctcaagctgcaaggtcttcctccgcgccatgaagacgccacctcctaaggtccagcagtcacgcgtcgccttcagggatgaggacaaggaacaaggagcgacattgatttcagatcgatttgttggggtaatcgacatcgatccccacgaaccatcagtcttgcacctgctcgaagactatgactcatcgtcaacgagtacgccgcgcgaggtattggctatcgacgagaccggcacgtcagtgcgcgctaatgcggaagcggagaatcaagtgaccacaccggctcagcacatcagggccgtcaacgcaatactgagggaaaccccctacgatcccgttctgaacgacgatctcgcacgatggacagaacggttacgggaatcagtgaccaacctcagcaacgcgttcgaagaggccgctgctgcagcgcacccggaacagccaccaactggtgatgctaatggtgaaaaccctgaacagtgggaatcgcctcatcgagccaccccttcacctcgcggcaccggcgatctccgcgatcacctgaatgaccgccaagaggcgcgacgcacacgagacaacgagaatcgttcccgacatcgcgtctcttcacggggtcacgataacgaagaacgaggaggccgttcgagtgaagaccgagaccgtgataaccgccacaaccgccacgatcacgacgatcgcgaacgacgggtgctgggcgatactggtcgaggacgtcaccctaatgacgacaatgatggagatcggcgccgagacaacaacgggagacgacgacaggattctcgagaacccggccgacgtcctcgtaatcgtacgccggaaccaagcgacacatcgtcatcgtcgtcatcctcctcatcctcatcatcagataggcatccacgaaggacgtacgatcgccgacaacccactgcccccagcgctgggtgtagagctttcggtcgttcacttcgggatgtccgatggcctgaaagattccgaccagcagcaatagagaaatacgatgggagtaccgacccagaaaaattccttcaggtttactccacggtactctacgctgccggagcagacgacaacgcattggcaaattacttgccaaccgcattgaaaggctctgcgcgttcatagctgatgcatcttccccctactcgatttcttcgtgggcggacctgtggcaacagttcgtcgccaacttccaagaaacttacaagcgccacgcaatcaaagacgacctacatgcgttaacacagaacccggttgaatccttgagggattatgttcggcgctttaatgagtgcaggaatacaatccccgagatcaccgacgcttctgtaatccgcgccttcaagtccggtgtcagagatcgctatactacccaggagctggcaacgaggcgtatcacgactactcagagattattcgaaattgtcgatccatgcgctcacgcggacgatgcactgagacgcaagaacaacaaaccgaagaccggaggggagaagaaaccagtcaaggacgcacctgagtcaagcaagaagaaaaatggcaagagtgggaaaaggaaagctcaagcggatgttctcgcaacagaatacgcggaccctcccaagcgcccagacccacaaggcagcgacacgaagaaaatatggtgccctatacacaagtcagacagacactctctagaagattgcctcgtcttcaaaaaatcactcgcaaaacacatggcattggaaaaaggcaagcgagtacgtgtggtcgagaaggacgctgaggcggttacttaggaatcggactcagcatacccagactccgatctccatgtctcgcacatcttcgttggttccacggcatactactcaaaacgagaatacaagaaggtggaacgtgaagtctgttcgacgtggcagggggctgcgcccaagatgaagtggtctgagcagaagatagaattctcagaagaggaccaccccaagactgttgtcatcctagagcaatatccaatcatggtcgaactgtcacgaccggaaataacccaacgggcattccttacgtgcgtgcattattccttgtcccaggaggcaaggtacaccaaaagttgatacaattcagagtttaacaagcggaagcgtaaatagttaatttattacatgggcggcgaaggcccagcacacacaaagacaaacgggaaacagcggaagactagggcgacaaccacaggcgcttgacggcaggcacgagctagacaccaaagccttcatcttccaggggctcctcttctgggtttgggaaaaattgagcaagactgagtacaaccaccgtactcaacaagacacacccacaagtgcaggataaatgcaagggagtacaagggggttataatataaagggttagggtttgcagtaaacagcattacaagacacttagttgctcaaagctattttgtaaacacaattccagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaataattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtgcatctccatccgtgtacttttgtttataaccagactgagccacaaactaagccttacccactagacatgtggaagtacggtagtgctttgcaacagaggcccgaagaccggtccttatatggccgaggtgctactaacaaaaccatgcatcccgagcccagcctaaaaccattttgaggattttgaatagagggggaggtgtgaatccaattccacaataatcaaaccattccatagtgtccaggtgatatgaatatcccaaagtctagagttgtaaaaccacctaatgttgcctaatcaaccagcgaagcatctacctaaaatcatactagtggtaccatgagtagagtgtccactagttgaggttttgtttattctatggtgaacaaggaaataataacaataacaataataaggtcataacaaaggtaaatagacatggctagataaaatagtgataacgcgggaatttaaataaagcgataatgcaataatttaaatcaacataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgacttcaaatggccaagttatggtcatttgaagtttatatgctctttaaacgaatatttgcgaatttcttcatttaaattttaattttaaaagggtttattgcgtcagccgacgggagggggctcgcggaccgggtccacaggagtggggcccacgcggcagcctcacagtccacggtggaccgggtgcacccgggctcacaccagccggcgccgtgggtcccacgcgtcagccgcacccaagggcgcgggcggctgactgccgggccccacgcggcagcctcacggtccacggtagaccgggtgcacccgggctcacaccggccggcgccgtgggtcccacgcgtcagccgcacccaagggcgcgggcggctgactgccgggccccacgcggcagccactcggcgcgcccgagggcggccaagccggcgtagccggcgggaggcggcgcccgcgcccctatggtcgccggcggcggccataggcacggcggagcggcggccgagagaggggaagggaagggggaaaagaagcggcggtccacggctcaccctaggtcgacggcgacgacgaaaaaggtggccggagcggaggaaggcggcggtgcggctcgggtcgacggggtcgacggcgttccggcggtcggcgagcgaaacggaggggtggacgaggtcggcgaggatgcggcgaagccgaaggaggcggcgccgaggtgggaggtggtccggggcgacgacggcggccgaccggagctcggcggcgacggcggagagagagagcgacggcgcgagctcgattccggcgaggaggaagggcggcgagaggcggaaacggacggaggaggtgcggggagggtttaaatagagccgggtcgagagagggtggccggggaagggaggaaaccggcgcgagaggtccggctgccatcaatggcgccggcgagatttgcgggggcaaatccgtccgtttgaacgcgagagagagagggaaaaaatggggggaaagggagagggaatcacggggaataattcccccctattgatagcacgcggggacgatgggatgcggtggattcgcaggcggcgccgcgcctacggcgcaggcgaggcgccggcaccggcggggcgaacggcacgacgggtcggccccacccgtcagcgaggatggcgggtgggcccgcccgtcagcggcgcgcgcgcggggagaggccggatgggccgcggggagaggagagggagggggaggaagatgggccgagccggcccaagagggagagggagggaaaggggactttttagagtttttctttttataaactcattttaattttgtttatttcttaataattattatttgtgctctgaagattccactgaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgcgacacgaacccactattcggaatatcaaggtcgcacgagttctgatcgacagcggtagctcaatcaaccttctcttcgccagcaccttggacggtatggggatcccacaaagcgagttgacacccaccgatcaacccttcgatggaatcactcctcagtcatcgttcaaaccattgggcaaaattacgttgcctgtgactttcggccaagcaaataacttccgaacggagaagatcacctttgatgtcgctgaattcgatacagcatacaatgccatcattgggtgaactgcactcgcgaagttcatgaccgcatctcactacgcgtatcaagtgctcaagatgccgggaccgaagggaacaatcactattcaagggaatgctaagctggcagtgcaatgcgacaaacggagccttgacatggtcgagcacacgcccagcccacccgacacagctgagccacccaagaaagtgagcagaacaaacaaaacgccgaaaccggatggcgcaattaagatcgtccactctccagtgccaaccccgacaagaccgtcaagatcggggcatcactaggcgagaaataggaactcgcgctcatcaccttcctccgcgacaatgctgacgtgttcgcttggcagccatccaacatgccgggggtacccagggaggtgattgagcacaaactcttgatgcgacccgatgccaagccagtaaagcaaaaactgcggagatttgcaccagatcgaaaacaagccatacaagaagaactggtttcatcagagaggtactccatccagagtggctagccaacccagtcatggtgtggaaggccaacgggaaatggagaatgtgtgtcgatttcaccgatctcaacaaggcgtcccaaggatcacttccctcttcctcaaatagaccaactggtggactcaacagccggttgtgagttgttgagctttctcgatgcttactccggctaccaccaaatcagcatggcgaaagaggacgaggagaagacagcattcatcacgccgttcggggtattctgctacgttaagatgccgttcggacaaataaccgcaggaaacactttccagcgcacggtccaaggtgcacttagcgaccaactcgaaaacaatgtcgaggcctatgtcgatgacattgttgtcaagaccaagacaagcgactcattcattgacgatctgcgggaaacgttcgacaacctccgacgatatcgcctcatgctcaatccagagaagtacacgttcggagtaccatcgggcaagctgctcggtttcctcgtctctggcagaggaatagaagcaaatcccgagaagatcaaggcaatcgagaacatgaagtcacctacaagactcaaggaagtacagaagttaaccggatgcatggcgacacttagcaggttcattgctaggatgggagatagaggacaacctttcttcgttctgctaaagaagcaagacaaatttgtatggacacaggaagccgaagaggcattcattgtactcaagcgctacctatcaaatccccctgtacttgttaccccccaacctaatgaagaattatttctctatattgccgccacgccatatttcgttagcactgtcattgttgtcgagagagagaaggtgcaacgaccagtctactacgtcagtgaagctctccacgacgcaaag

SEQ ID NO: 44438 - DNA, 6293 bp, Oryza sativa
  unsure (1)..(6293): unsure at all n locations
agttgtatcctccttccctctcggtgaagtagtgagaaacaaagatgttatcggccgcattgtgaaatgggtagtcgagctaagccaatttgannnnnnnnnnnnnnnnnnnnnnnnnnncaagaccaggtacttgccgacatcgtagccgattggactatacctgataacaggtcagacaaccaaatcgacaccgaaacgtggataatggcgttcgacggcgcactcaacagccaaggagcggggccaggattcatcttgacatcaccttcgggagatcaattcaagcatgcaattcacctcaacttcaaggcaaccaataacacagccgagtacgaaggactactcgccgggataagagctacagctgcactcagagttaggcgactgattgtgaaaggggattccgaactagtcgcgaaccaggtgcataaagattacaagtaatctagccccgagttatccaagtatctcgcaaaagtcaggaagccggaaaaaaggttcgatgggatcgaggtccgacatgtataccgcaaagacaacatcgaaccggatgatctagcacggcgtgcgtccagacgagagccacttgaacctggcacctttctggacgtcctgaccaggccatcagtgaaagaggcaagcggcgaagatagcccgatcgcccccaacatcagctcgggggctatagaggtagagcgcgccgttgccgatatcgagaccacagacgactggcgcaccccactcattaaattcataggcagcgaagagttgcccgaggacgacgcagaagccgagaaaatatcccgtaaagcaaaagtctattgtatgatcggcaacgatctatacaagaaggcaccaaacggggtactcctaaaatgcgtctcgtccgacgacggcagacacctcctcctcgacatacatgaagggatctatgggtcacatgccgccggtcggagattagtcggaaaagcttttcgacaagagttcttctggccaaccgcccttaaagatgcatgcgacatggttcagcggtgtgaagcctgtcaattccacagtaaacacataaggctaccagcgcaagcactccagactatccctctcacttggccgttctcgtgctgggggctagatatactcgggccattcccacgaggacagggcggctacaggttcctattcatggcaatcgacaaattcactaagtggattgaagtgacacccacgggggaaatcaaggctgacaacgccatcaaattcatcaaagggatattctacagattcggattgccccaccgtatcataacggacaacggctcccagttcatcagtgccaatttccaggattactacatcaggctgggagtcaagatctgcttcgcctcggtttctcacccttagagcaatggacaagtcaagagggcaaacgacatagtacaataaggaatcaagaccagcgtctacgacaggctcatatcacatgacaagaagtgggtcgaagaacttccatcagtactatgggccgtgcgtaccacaccgacaacgtccaacaaggagacaccattcttcctcgtgtacggctcagaggccatgctccccaccgagctacgacatcaaagtacacgagtacaggagtattccgatgaggatcaggagaagcagcgaaacaacgatgtgaatctactcgaggaacatcgcgaacgagttgccgttcgagcagccagctaccaacaggcccttcaccgttaccacgagaagcgcacccgagcacgcacgctttcgatcggcgactacgtcctccgacgggttcaaagccaagcagggcgaaacaagctctcacccaaatgggaaggaccgtacacgatcacacaagttctgcggccatgcgcattcaaaattgcagacggcgacggtcgcgagttggcaaattcctggaacattgatcaattacttaaattctatgtataagtcaatagtatccatacttgtaagacatcttacagcttcaataaagcgtattttcaggtccagaccacaatcaaagtgttccttcccgatgatcccttacccagatgacatctagcgttgaaacctatcctcatgtccctttacgccgtcttgacaaggcctccgaggaacctaagggaacttcggctggggacgcccagagccgataaggccttgtcggatcctgtagagacgaaagaccatgtaagatctggtcgtgtaagagttctcgccgtgcgtattaaccaagccgtgtaattggaaataaactttccaacttcacggttgggggctaggatcagtgcttgttcaatcgaggcaggtcaaaggtccaagagccttatcttccgagaagaattctctgataacaaggctgggggctaggaagagtgtataactcaaacgactgattgaagtcgcgaagtgagaagacactcatacacgctacatccagagtaagaaagcttagttagatagatttcttttctatttcacaagtactttttacaattccataaaaatccaaaattatattacacattttccctaatatatttgtcacaggacacagagactaccaggaaggccaacgccagtccatggactggaagaccttctccgccagcggcgccatcgacttcgccaggccatctatctccgtaggagttctccgagaacgacaaaacccttcgcggaggaactcgaggtgcagcagcggacgatgatcttgaatgcaagccaacacatgccccccggcatatcggcttgatcgacgacactcctgcttcaaggcctcgtcgatacgttgaccgatgccttcgagctgggcgcaggccccattcagccacgagatgtatccggccgtcgattcctcgggatccccacggggtactcggagctctctacagactcttgacatggacgtgcatcaactcttcagatacgagttgaaccacacctcacgacctcggagtgtctctacggcctggtccttcttcacttccaacatagtcctctcgagttccgcgacctcaaacttcgtcctccaatactgaatgcgacgatcctggttagcaagcgcactctcgatgtctgctcagcatggaaacgattaagtcaagctgctcttctctcccgagaatatagcaaatcaagtcaatccagacggaagggtaaaggaaatgataacaaagacaaccaacctaagggagtcgttgccatgctcgtttccacaggcgaactttgatctacatggccccccggcacatgtggctcgaacgcaagtgccggaacgatcactggcaactcaggctgtccgcgctgctggacatcctcgacaccaacatatctacaaacaacaacaaagtactcaagatcacaatgctaaagaaagctaaggtgatgaccacacacacaaaggcagttggaaccaatgagagttttacaaagcatgactaaagagtacaagagagctaagatcctactcttcaaaaagtgggaggacggactcccccagatcaccaacctcctccatcacatccttgcgcgcatcgctagctgccccctgatccaagatcttccgtagatcgagttcagggtgcgccagcctcacacacgcaaggacatggcatgccccggtatagatcccgttggacgtctcctctccgatcctggccgcgtgcttggagggaatcgcctccatcgctgtcgccagttccgcaagcgaagacgtcagcgagaactcgtcgggattcgccgagatggtggccttgacgccgcactccccggcgagctggtgcagaccggtgtaggtgacccgccgtgagccacggatctccgacaagtggttctcaaactccgacatacaatactcgagcccttgccgttgtcgctcattgccagccaccagctcccgcatcttctggaggtcctcgcgaacctccaccaaatcgcgcgccagccggtcggtgcgctcattcgccgacgatgccgccgccgccctcgccttcacgatctcgcggctaatgccgcaagcaccagcctcgaggaggcgccccatctcgacctggagctcctcccaggtgaggatggcagccgacggaccccgaccagccgcgagatcgctggctgggccgctaggtgtcgcctcgcggctcctgggcatgaccacgacgtccgtcgaggccacaacaggagacacgctggaggtccctccagacccgtcttgcaccgccttcgcccgcgccgccctacgaaaagctgcaactgagacaggctgcaacagtttgacaaagtgacgaaacctcaaagtcatccacttacttctcgccaagtgtcacaagccgctgccgtcgcggaggcgggggagacgcgtccgaggcctggagtataacggatatgatgtgaggtggaagttttccggactacatgatgaaagaacaggagaacttaccgagggggtgggtgtcttccgatgatgtccgaccacagaggagaatttcctcccctttttcggaacgttgccgccactcgttttggcagcagcggcaacaacgtcagacgcctccttggcgactttctccttcagcgacgccgccacctggtggtccacgagcggcccgatgatatcagtcagagggagagcctacgcttcatgaagttataatgcgatcccggaagaaaaatgcagaagggccgctgggtacacttacattgatggcagcttcacgttcggctacccctttctcacaaagggggacggggacgttgctcgccgttgtcgggccactgattatcaattggccgacgcggcgctccacggtcgcgctgtccaagcctataaatcgagatcagaatccaataagtcgggaggaacacgcacataatggagtcaatttaactacaaagaaaaataccccgaggagaaacccaggtcacgtcctccggcccagaataatcaaaggctggatgggctcgagcctagagtggctggatccgcctaccaatgaagtcggcagcgacttcataccccgacaatccccttcttcgtcatcgagaggctctacgaagccgtcgccggcgtgcagggcaccaggcagtccctcctcaaccttctcgccgtcatgtatatcggcgacgaggagccaatcaagtggccttccggcgactgggacgtccaccaccttctccatctgtactacgagtgcttcgttcccaactgatcaacgccgccgccgcggggccgtcggagcgcgcgttccggccgacgggcggcgaccaccacccgggcaccccgggcgataccgtgcgccaccgagatgagacacgtggggctaaagttcgtcgcaaggcggagtcggccagccccagccgacgccggggagacgacgacgtacgacgtggtgttcgacgaccgcgggggcgtgatggagatccccgccatcctgatcgacgacgcgagacggccgctgctggcgaacctgatcgcgttcgagcagagccagggcggcgaggtggccaggctcctgagcagctacgtggcgctgatgagccagctcatcatgacggcgcgcgatgtcgagctgctccggcggcgcggcgtggtggagaacctgttggacaacgacgaggaggcggcgcggttcttcaaccgcctgggcgacatcgacccggtggactacgacacgcaggcgttcgcggggctgtacgaggacgtgacgcgctactgcgggacgtggcgcaacaggcacatggcggggctccgccgcaactattttgccagcacgtgatcggccatctccgtcgtcgtcgccgccttcgtcgtcgtgctcgctgctacgcagacctacttcaccgtgtttccatccaacaagtgatgcagaatcccggccgggacctgcatttccgttcgatacttcgatcctgttaattttcactcaacattacggaatccttccgtgtatcgagctggtgtgtgtgggagaatctggataactctctgtccatattcgttgtactaggaggggttgtctttttctttgggatagagggagtataaaggtatatcagactatcaatgtaggtttttaattcggcaaattttgctacatgacactgcttatgtgtgtttttagccctatgacactgcccaaactcactttcgtggaaaaacactccataaacgtggtaatttgtcagtggacaccgcgccaattaaaataataattttcagttgaagagaagagagaatttgcgtgaaatgtcaaaaatacccttgacccacatgt

SEQ ID NO: 44439 - DNA, 4634 bp, Oryza sativa
cgtcggtatcgtggtggccttcttcctggcctccaccttgccatcatcgaacaacttgccctcgacgatggcctcctccaccttggcacggagctcagccaacgccttcctctcgccgtccttgagattatccaggaagttgctctcctccctgaacgacacgttcttggacacaacggtagccagcgtcaccgcctcatccaccgacgccttcgccctcacctcctttgtctctggcgccaccacctccgctgcggcggctgtcgcaccctcagacaacgacagtggtgcgacggcggcagagcccgggcggtggcgaaggtcgggctgtagcggtgcgccggcggcggatcttgcagatgggctggacgatgacgaagacgacgggagcgtggcgttatcctctagagagaagatagagagagaagataagagagataagaaagctgacatgtgggcccaaacgcatttttgacatttcacacgatttctctctcctcttcgaccggaaattattattttaatcggcacgatgttcactggcaaattaccacgtttatggatcgttttccctcaaaagtgagtttgggcagtgttctagggctaaaaccacacataagcagtgtcctgtagcaaaatttgccttttaattttagcgtcgtgtgaaagtcgggaagtggttatatgtgccagtttttaagaaaccaacatctataagacagttcctgtcattggaagatatcacataagctacaaatatttcaaagcatgaattgcaaaacagaaaagatttacacgttccaataaaaaataatttgtagtcatcagaaaattcaatgaacagcgttgtctgcgactgggggagcgcaggttgtataatgccatagaaaattgcacattgacacagcttccctctaagaaaaaaaggtaataaatccatggtgccgcttttcattcactgttcattattgtcaacaggaaacatcccaagcaagaagctaggctctccggccttgtttagttccaaactttttctttaaatttttaacttttctattacatcaaaacttttctacacacataaacttctaactttttcgtcacatcgtttcaatttcaaccaaacttttaattttgacatgaactaaacacacccttcgtcatatagttgctgaagttctattcacccagttcattttccgtgtgcaataataattgtggtcatagaagtatgaacaattactaccagaaccgtattcacgaagctaattacaaggggccaacaatgggtgccaaacaggacctgaagcacgaacctaggctcttcctggtggtgccagagttaatttggttctcgatgtttgtcgtaactctgtttgtgttaacaacacgcgttgcttgtgtagctggactacggcttgtaggtacattggcccctggtcttgcaataggagggacaaaaatcatgcctccacggtatttgtgtccttgttttagcctcatgctagatatagcccccgtcgtcgttgtccaaccaatggaatgctgttccttcggacgaaacggctgttcaaggtgataggtataatactagttagttgtgtaaataaaaaggggcttttacaaatttaccactagtttttcaattttgcaaggatgccactcgaatgacagttcttgtgataatcttgcaataatgattcaaagcagtggtaaatttgcaattgccccaaataaaaatgcgcaaccccctgtgggacagcgggagtgtttcgatgataggaaaactgtatgaacaaactggaccaacttgagtgaattgtactagtattacgggaggttcaggtcctgtcgatatgagtcaacccaattgggcatttaggcttgaaaatatcaaccgggacatgaactcataaataatattaatcggatgaatattatttatcagttgatgtggcacatatatataaacgatagacaccaagaatgaaaacagtacctccaaacctctgtgcattgcagcagtgtctattacaagcgaagcctcggggaatgcctgccctgacatttcctgtgctttcacatttccagggtcgtattccaatacctgttttgattgtaagattttagttgctcattgatgtgtgtaggaggctagcgtttactaacagtagcgaactatgcaaaagaacaaccaatgaatcaatgccatttgcaccatgtaaacatttggaaaaggtgtagcactatgaagcaaacacaactcatgctctatttctcttgttaagaaaagcacctcacggtagcgatggtatgcttgttcgaagcgttgaagctgagttgcgcattctgcagctttgaaggcaaaggaaatcaacatttgtttaatttctccatctatgtcctcctcgtcgaaagcacgagagtatgatctgtctggccttcaaacaagttaaacagatttttcagattcagtctgtacatttgtcggatgcatataatacatacttgggacaaaacaggctatacttttttcctagaaaaaaaacactatgacctcctttttgcaccattaaattatctattaacttattgaaggaatagaaaaaagagcatccacatttgctctcacagtctagaaattcccacattaatcgaagaaaaagaaaaatatagagtccatatagaaatacaatttaaaaatagtttaaattcggaattagaaaataaggaatattggaagaggagactagagttcatatatgaatacaatttagaaataatagaaattcgaaattaaagataaggaatattgaaagataagtttagagtccatatagaaaaacatataaaatttagatctaattgaaattcggaattgaaaaataaaaaaataaaagtagaatttagaatccatatagaaatacaacttagaaaaaactaaaattcaaagtttaaaaataacaaatattataaaaataatctagagcccagataaaataaaacttagaagaagctaaaattcgaaattgaaaaaagtaagaaatattagaaaaagagtctaaagtccatatatgaatacaatttggaaataactgaaattcgaattttttttaaaaaaaagaaatattgaaagatgagttagagtccatataaaaaatacaatttataaataagagaaattaggaattaaaaataagaaatattggaaaaggaatctagagattatatagaaatacaatttagaaataactgaaattcgagattttaaaataaggaatatggaaagaaggatttagagtccatattagaataaatttgtaaataacatgacttcggaaaatataagaaatattagaagatgagtttatagtctatataggaatacaatttataattaagtaaagttagaattctaaaataattaataaatatcacgtatataaaatacaatatgaatattacacatcagttagtttggtcaagttagtacaaaattaaaaattatgttatcattttaatatattttaataacaaaatataaaaatatatatgctattatttaaaaagatataacgatactagccacgcaatatacgcgggccaccatgctagtttagtaccttgtaatatctcctataagctctcaaatatttgcttgagccgaatagtttgtcaccctccttttccttctcaactgcagcctcaacgctctctgcttgactcatgagccagggatgcttgtcctaaatttaattcagatccagtatgtcaagtagagtttccaaaatatagtttcaaattgttcacatcatggcaactaattcaagctgcatacacacatttacaacagagacaagctcaatttcataggtgacggaagaaccaggagggacaaccacgtgttgatcctgcaaacactggggtggaatggtgaacaaggagacctctccctcccacattgtcagaacagcttcctctaggccatcactaacctgctctgcaatttcaaaagaatagctgaaatttatgagaaacaaacaagttttattttgtaaagatgtagaaaatacaaccttcgtcaaccacaaactcaaatggctcatctccttggtgacccctctgatcaaaaacagccccatcatgcagtttaccaatcagccgaactgccaatgcaagtgaacattaggcatgttgatatccaagcaggaggtaatgagctatatatgttcagaattccatattaggagctaacttgaaggtacctccaaccactgcttgattctcggtgtgctgtccttccaagtttcctctgcgaagggtttttttaaggattgtcccgttctgtccaatgtgtctcactgttttccatgacatcaattgaaggtacacataaagagttgcatcaggtggcacagcagcttcatcccctatggacggtctaccccgttcaccaaaaccatctagggatcaagagaaagagagcaccaattaacatatattaactagaagattaactacaagaaatacctgcaagagaagggtttcttccaatcgaaacatgagggaggttcacaattctggaaaaacttgcacacaatcaaaagttggatccaaagaaattgtgcatggaa

SEQ ID NO: 44440 - DNA, 3764 bp, Oryza sativa
ttggtctgatgtttggctagagtcttgtcccctaaaatcagattcccactcatctaccaaatctctaaccaacaatacatcctagttagtgaggtagcagaatgggaagagttggaacaaattatgactggtattaatctgatagaggaaacagatactatcctttggcctgtggttcaatctaattgcttctctactaaatatttatacagaatactcatattccatggggagaaaaacttgagagatgcagacatttggggagctcccatacccctgaaggtgaaacacttcatctggcttgcatgtagggatagaatacaatccacaacccaactggtgaagaaaaactgggaagggtctgatctgtgtattttctgtaatgatctagaagatgctgatcatatcattttcagatgccctgttgcaaagttcctttggtgtgtgattagagatgctctgacctggaatgcagcccctaattcttttgatcatttcttttctgagatagtaggccgacctagctccaaacggagcagagggctgataatgctgctgggggctgctgcctgggtgttgtggttgaatagaaatgatatgattttcaggaagcagattttatccactcctctaactgttgcttttagtgtgatgttttatctaagacagtggtctaactgatgaaggaaaatgaagaagcagaagctgagttgatggcaggcaagatcttagaagctgtgcaacttctatctcctcaaggacctcaacacaggagtacaggactggcgtgggatgaaaaaagcaagtagtcatagatattgccttttgctcactggttttcttctcctgtttggctctttagatactgtgtaaggccattttttggctagaatgcttcttgtaaaagctggttctcccagctgttgaactgatgccgtaatcattatctagctttctataaaagctgggccttctggcctcttatcccaaaagaaaaatgacacacagaaagacaagcttgtaaatattcctgacatgtgcatgcataatcggaaggaagatttgagatgccgattggtgatttagttgccactatctgctttgattattgaatttattacgaggtataaggtgcatgagaagaattggtgtttattttactcaactagaaggttacatccaaggaggggagcttacattctagtttaacaatgagaacaacttcctctccttctgtcatagtctccacagcacgtgcaaaggcaggacaaaagaagcctagattttacaattatattagaccggcatagtaaaatggtacttctacaattaagtgcattcaatcatggtaaagggaacttattcttaccttctgcaaggttgaactcaacaccttcagacatggacactgacatcccatcctccaggcaagcattgtagttcactacaaaaaaaaaatgtaaaagtattagctcaataaacacacaagcactgttgagctattgcagaaataaatgaaaaaaatattggtacaattaatttctcaaattcaaaactaaagaaaacagagagatgaagggaggaactaatgtactatttcataccaagcacttcatccaaatcacaaggtttatcattccccactccacgcttcatagtctttttcaatatgccttcattgtcgaggatgtcagttatggtgataagagagatgagctcaacatcaaactgtagtgcttggttaggaggaaggttcgctgggatatcagcaggacaccgagacttggtgcctgctaattctggagggatggtgaatacagctttctcccctgcttgcattgagctaacagccatactgaagccttgcattacattctctataagcagtatttagttttatttcatcgaagtgtaactcatttttgagaaaagtatggttacagtggtacaaacacccaatgagccaggttttttaaacacacacacacatgaaagatgagccatgtaatcttgttatctacattctagtagaatctttaatggcttgaaacaaaaatgtcagaccccaaatcactaaagtcactttttcattaaaagattcagtccttaacacttgatagaaatcccactgcatcatataggtctgttgaagtttacgcaatgcagaaatcaacaacgccatatatataaacacttaatagatgagtggatgatctggaagatcagtaaaactacatacatgagaacttcatgatgcattaagaaaatgataaataagttaggtgaaacgatttgaatattgcacaaaataaaggggaacaattatgcttggtccacgtgctactaatgcattttctgtattacctttttgggagtaactgtttgagtaaactactgaaaatcatttggtttagtggtgatgggtgtagaaaccctgggatccatggttaatggcatgatcacaaggtttccaaccattacaatatctaagaagatttaacaacagaggttggttaaacagtaagtaccataaacattggagagttcttaactcatatcacttggtaacctccctgtaaattttctttggttctgatcaagtggtgtgcattatggatttattgactcggtaagaactaaaaagtaatttcagggtattgactattgagtatggtacagttataccttgtcctaatataaaagtcagaggcacgccatcttctatggtggatgtaaacaaagtaccatcaagtctttttcctgtaaagtggactggaagcaaccaaacatactcatgattcatcaaaggagcagtagaaaggaagatcaatagcatgactgtgtactggaaaataaaccaggggcttatacagtacaaaccatcaacagagttatctgcagggataactgctacaaacaatacgaataacattggtgaaatcttccccgactaggattaactagctatatctcgttcaacatcagcgagcttagaattgcacattttcaaaatttctattgtactgcttcggaaatgagaaccatcctacaggattagagtggaaatctggaatgctgaaattttccatacctatgccggatttcaaccatttcctaggagccggtcaggtgtcaggacggagattatgagacgcattggagaggtttcgcagcaaccgagagacgtactaagcgagtttagggtttgaccttggaggcacgagtatgcgtcgccggctcgctccccgcccgggattcgacctccacggccggatctactccgctgcctccttcgattcgctctctgcattgcctccgcaaagtccggacgccgctgagagccgcctgcgcctgctgcaggactgtcactgatgatcggtgccgccgccgtggttgcaaggggcagagattgtcggaaaaaaattctctgcggcagcagtgccgcaccacgcctcctgtacaacaccgcgtacacacctgacgcgtgtcccatcacattagtgcagccaagcgttttccttgagccaagccgatgtcttcctcagctcgcgcgttggaacggacaccaagccgcagttagcgactgcacatggagttgagccgttgtttcattagaagacagaacagatagtaaatctgccgctaaccaagaacagatgaataatatatactccctccgtccctacatatttaacgccgttaacttttttaaatatatttgaccgttcgtcttattaaaaaacttttgagaaacatgcaaaact

SEQ ID NO: 44441 - DNA, 23094 bp, Oryza sativa
  unsure (1)..(23094): unsure at all n locations
nnnnnnnnnnnnnnnnnnnnnnnnnnnnnnnnnnnnnnacatgcaaaactatatgtatacataaaagtatatttaacaatgaatcaaatgatatgaaaggaattaataattatttattttttttaataagaagaacggtcaaacatgtttaaaaacgtcaatggcatcaaacatttagggacggaggaagtagattgtaaaacgcaaccgtatggctacaaccagggttagaaattccggaatgaattttagtcatttcagacccttgatacaatattatttcggccgaatttttttaatttttttattcttttgtgaatttggtaatattttgtttaaatttaaccaatatttgatcaaaattttgaaaatttcggactgaaattttggtatatcaacgacgtctgatagaatcggccaaaccgaaaaattaaacccggtctacaacaccatgttcataagtcacaacaaacaccatgttattgaagcatataaatccgtttatattttgcagaagcaaaaagataaccaaaactcttgaggagtagtacaagctaattagcaatgtcggccatatccccaaaccatcaagtttcaagactttaagaagggtcgcaatgcaataggttcctatctaaagttgtgaactggacaaattaaaccataaatctctccagcaatcagctttatgtactcctgaacagcggctcccaaatcccaatcggctttagtatttcggcacagcggctcggctctaaagaaacggctgcttggctacagcgggagatggacacgcgtcaggtgtctacgcagtgttgcacaggaggcgtggtgcggcactgccgcagagaatttttttccgacattgtcgtgcggtcatgcccccgacatccaccattaaaatgaatccaacgtcctgaatttttctgtgtcactctcgtccctctttatccccctcattttctatatcaatactaataccaatactctcaccgtttggtattataagtcttttaattttcttaagtcaaatttttttaagcttgatcaaatttttagaaaaatacataacatttttaatagaaaaataaacatattatcaaatatattcaacgttagacttaattaaactaatctagtgttgtagatgttgctaatttttttctatgaatttagtcaaacttaaataactttaactaaaaaaaatttcaaacgacttataatataaaatggagggaggacttcaatattattatgcgttcgactaagtaagaaagagagaaaatttccattgttcttgttttcttaaaagaactaggtgattccccgcgctttgctgcgggaattactaagtaatttcttatatatatatatatatatatatatatatatatatatatatatatttcaacaatcgagcatagggtaagtatgatgttaattattaacaacaaataaaactgatttgtcaatccatatttgaagagaaacaaatttaatagactttgtagaggattatagataatatttatgttgttgaccaagatttgtatcacaataagcggaagagaaggaaaaaagaaataaaaagctaggatttattagtagtaagcatgaaacaaactaaataatatctttgctttgatatggaatatatgaatgaatatacgttgagtattataaaaaatgatggatatatttgttgaaatattatggaaatgatgagagaggttgattggatctatttgcattttgatttgtaggattaaataaattatgtatgatgcatgtttgcatgagctatttgataagtagttattgctagtggatgatgaggtagcatgtttgcatgttgagttttagacttaagtaggatttaacttcatagaaagcatagatagaaaagttgctttaaaaagcatattagtccatttttaatttaaaataactaataattaattaattaatacactaatggcttactgcgttttgcgtatcactcttcttcttcacttttctcttctacttaaacacactctaaaagctgcttagtaagctacacgttcatgacacaacaatacaaagcttagaagcatgggcggatctagcatgagtgttcctatggaaaagaggagagatgggaggggaaagaaggaataagagtagagggagccaaaagatgaagaaaaagatgagcacttctagtttgatgctacgttcctccctgtttagaagcatgtagttttaggtgatttcaaaattaaaaatttttagatgaatgaaatgtagcaaataattaataatgtctatgtttccaaacttctgatgttggttagttcaatgtcaaatagagaaaaaacagagggagaaataaggtagaaacaaatgaatctatatataaggacggaacgtaattttaagcggttgtagaccgagctgatttttgcagttgtgtacctttttactcttttcaactatacgcaccttgtgcctcgcagcagtagaaccccttcatttccagccaatcaaaccgttccccaggcgcctcttgaacggtccacttcgcaaagccaggagagccacgaccacgaccacggccatgctcgctcccaaaactctctaatcgactggtatctcctctccacacgaacaagtcctcgtcaggcttgcctaggtctgacaacttcatggcgccgaagtccttctttcttctccgtcgacggcaacggagactcctctccatcggcaggaaattaacgtggcacgctagctgctaacaccctaaaggctaagtaagggaagaaaaattaaggggccgggtatctgcgctgttatatcgatcggctattaaacagagggactgtttagttcacaccaaacttcctcccaactcccaacttcacgccatggtaacgctgttttgttgcacgaaacttgcgatgaaattgcgggcaagtgaatgatatgataatgatatccacccaaacatcaacgcgttggtggtcgtgcttttctgctcgatcgaccacataacgtatgaaaacaaccatatatgtcaaacgacgatgacgcgacttcgatgaccacatgcatttcggtttttgcaagtttgcagatgcacgtcgatctggggaaactattttgccacgcacgtctggggaaactattttttgcgacttcgactccctgcacgtctgcgcgctttctttaattcgtgccaccactatttcgctagatttgccaacccgtggcggtggcgtcgttggaagcttcggtggaggcaacgttggacgccatcagcggagatcaatggcgggcgcggctgcagccgttcaccatcttccgcgtccccgcctacgtccgcgacggcaaccgcaccgcgtacgagccgcgcctggtatccatcggcccctaccaccacggcggcgccgcgctccgcgccatggaggaccacaagtggcgctacctccacgacctgctatcccgccgcgctggcgacggcgccgctgccgtggtcaccgcgtccgccttggtcgcggaaatgcggaccctcgagccccgggcgcgcgcgtgctacagcgagcgccccgtgggcatggactcctccgacgacttcgtccggatgctcctcctcgacggcttcttcatcctcgagttcttcttcaagtggcacaccaaggaggccgactcgctctgcgacgtcggctggggcctcacgctcgtcgccgccgacctgctcttgatggagaaccagatcccgttcttcgtcctcgagaggctctacgaagccgtcgccggcatgcagcccgacaaggagtccctcttcaacctcctcatcgagtacatcagcgacgaggagcccatcaggcggccgtccggtgactgggacgtccaccacctcctccacctgtactacgagtgcttcgttcccaagcggccacggccgcggctgcccgagtcggcccggaaggcaccggcggcgccgacgcggacgattctgcgtgccagcgaactgcgggaggcgggtgtcaccctcgtgcggcggagcgcggcgcgggacaggttcgacgtgacgttcgaccgccgcaggggcgtcatggagatcccggccatagagagatcgacgacatgaagcgaccgctcctcgtcaacctcatggcgttcgagcagacgcaggcgggcgaggagccgcgcctcctcaccagctacgtggcgctgatgggccagctcatcgtgacggcgcgcgacgtcgagctgctccgccggcgcggcgtcctggagagcctgctggccgacgacgaggaggcggcccggttcttcagccgcctcggcgagggcgccgccatggacttcagccgccaggctttcgccgggctgtacgaggacgtgcgcgggtactgtggctcgtggtggcaccgcaacagggcggcgctccggcgtgactacttcggcagcccgtggtcggccatctccgtcgtagtcgcggcgatcgtcgtcttcctcgccgccacgcagacttacttcaccgtgtttcccgccaaataacgagagcgtaatcttcaagtgtaatgacttcgtaatccaatccttcactacttgggatagactattgatcagtcgactaaaaaaaaaatacaaatcgttagtccatcttgtgcaaaatccgatccccagccgaaaggccaggaatgatgcagaaacagagcaaacatctatcttccttagcctgtggacctatgatccatgttaacggattttggatctgcattttttggaccggtctgtatgtgttccttttgaaagtttcttttgggctattatttattgatttgggctaagtttgttctgtacatttttgggctgttcgtgcgggcctctgccttctgtagagccatggccacatccaaatgaaaggggattttagattaaacaagcaccatgcacggatgaaccaattttcgaaaagggattagctatacatttatgtaaatattagtacaatcatcatgcaattatattgtaacttataagtaactatagtgtaacttgcacgtaactttcaaaattctcttggtgacatactaattctgtgaaaatggaggtaatagtaccgaatttcctcacatgtgcatgggctatgattttttttctacctcccttgcataaattaaatcaaaccgtacggttcaaaattgcattatagttacatggtagtacatacaaattacaatgtaattatattacgattgtactatattttcatttgtcaaattttagaaaaaaaaattattgacaaatatatagcaaaatcgtttggaaaattgtaaaaaccatatcataagtgacttaaagtttggcattcctccccataaatcactctgttatgtgacaggtataaaattttaaggtggggatctaaacaacccctaagagtccatgcgattttgtatggatatgatgaatatccagatatattaattagcgcttgacaaagtccatatataaagtccattgttgtccctcgtgtttttgcccagggagccaggcgggtgtcaaactgtcaatgattcaatggtcattgctcgtgtattgacatataatggcagctggtcatgtatattatattcacgtatagactgctaatggcaggagagtctacatatataccgatgtcggctgccatggctgcacgcagccgagctcaaattaacgtgtctgaccgtacttggaggcggtcaaaaacctgccgctggctgcttatactccacgttattccggctaccggcactccagtcgttagcacttctttaatatcgaagctgacttaaatcatggtgtatactccctcttgtttgatactagcacttattgttttgaacaagagcactactatacgtgagagcatgatctccaaaaactaactttaaccattattttttattataatatgtataaaagtattaataaatatatgaatttattaaaatactttttaaaactaatcaatacatgcatgtagtcactatatttaaaagacaaatgttttaaaaatgattcataatgaaagattcaaaagtttgagctcaactttatctaaaacgacaagtattatcaatccggagggagtataagcgatctatagaagtcaccgtattagatttatgtttagatggagcaagaaaatataagagaagaaaaaacggactatacatttataagtcaactacaacattaattttaataaattatatgagagagaggtagtattaatggattagtatatatctataactaactaactattgcatgtcagaactattagattagtgatacataaatgatggggacatatccattgaaaaccatcgtgagaacccataaaaaccgggactatatgttttgtaaattcacgaaaacatttatatgtatgaaataattctcaccaaatttgaagttcaaactcaattttaattatttgggagttaaaaaagtatttcgggtgaatagtaaccataactattcacttctctgtcaattgaagtttgagtttagacttaacatctagtgcgaatatatcttatgcctatacttatctctagaattttttttactgaatttagagagcttatatgtatattttttatgggtttacacttatttgacgttttcactagttttcacttgagatttgatgtgaatattaaaaagaaaaaagacaagtgatatgtcagtatttagtgagtcctagtagttagggcctgtttagttcacaaattttttttcctaaaaacatcacctcgaatgtttaaacatatgcatggagtattaaatatggacaaaaagaaaaactaattgcacagtccgactataaatcgcgagacgaatcttttgagcctaattagtccatgattagctataagtgctatagtaacccacatgttctaatgatggattaattaggcttaaaagattcgtctcgtggtttccaggcgatttataaagttagttttcttattcgtgtccgaaaaccccttccgacatccggtcaaatgtccgatatgacacccaaaaatttttttatccccaactaaacatgcccttagctataccattgaccttcctcatggctctcacacatgcacacatattaattgccatcagatgacaaatcacgcgctaagatttattgagccccaaaatgggtaataataacaagaagggacaaattttacgatggtcttaagttaattctactcctacttataagtggaattaatttgtatcttttattttgctcttattcagcaaatcatttttatctatactagttatcatctcaactacgggtagtatgatatttcttttattagaactcataagccatgcataatgttatcgatatatgtaatatatagtactaatagagagcctataaaaatactccctccatccaacaatataacaaatatgagcatgttcatattcataatagagagcaataatgtttttttagttataaatgtccaagttttgtgattaaattgatattaaacctttagttttgtgataactttgtttctaaatctgtagttttgtgatattttatcttaaatatatagttctatgataaaattagtgttaaatctatatttttgtgatacatcatgttaaatctataattttctaataatttaactaaaatatatgtagttttgtgaaatttacttaaaataaaaatgtttggcatggtgactagcagcccacacactgccactgcataggttacgagttcgagtactcagcctttttacatgcatgcgattttttttctctgacttgtgcctacacgaatcttgaggatatgggacagtcacgaatttataagtttgggtgtgggggttagagggggagggggagaaaactgtcgaaagacttttaagagttctatatgagaagggagtagctatatttatgggggttatattttttattaacaaatagttaaattatttttacactataattatattcacttatacattgtaattacacagtacttacttatgtaactttgatatatttacattgtaattttcaaatcttacatgtaaattttaaattttacattgtaatttttctcatctctagatctaaaccataatcacattgggcaaaacgcatagtcgagtcacatctgcacgggcaaaacaagctagcactaatctcaagcagatcaaacaccctagaaatcttttttttttgttggaacttaacaccctagaaatctgactgcaatccagaagaaaatgcgtcgacacaattttagcagttccggtataattaagttgtcctcggcggattgacaggtggaaaaggctgacttcaagtttttgaaaagaaaaatcgtatgcagtttgaattttgccaggaaatggtcggaagaaataataaaaactagtgttggttccacgcctctaccactctataaatacacgagctgatcacggacacagcagaaaacatcaccaagcacctggcaatcactcaacaaacaacaaatccaagtgtacgtacgtacgtacaccgtgcacggtgcacattagagcgcttaattaattagcttcaccgatggagaagagcagcgagctatggttgctatgggcggttttctccgcctctctcgtcttcctctacctcaccatccgacgacgctccggtgccggcgccggcggcaaaccacccttgccgccggggccaacgcctctcccgctcatcggcaacctgctcgacctccgcggcggcgtcatccacgacaagctcgccgccctcgcgcgcgtctacgggccggtcatgatgatcaagctgggcctcaacgacgccgtgatcatctcctccagggacgccgcgagggaggcgttcacgcggtacgaccgccacctcgcggcgcgcgccatcccggacacgttccgcgccaacggcttccacgagcggtccgcggtgttcctcccgagctccgacgagcggtggaaggcgctgcgcggcatccagggcacgcacatcttcaccccgcgcggcctcgccgcggtgcgccccgtccgcgagcggaaggtgcgcgacatcatcgcctacttccgcgaccacgccggcgaggagctcgtcatccgccaggccatccacaccggcgtgctcaacctcgtgtccagctccttcttctccatggacatcgccggcatgggctccgagaccgcgcgcgagctccgggagcacgtcgacgagatcatgacggtgttcgcgcagcccaacgtctccgactacttcccgttcctccgccgcctcgacctccagggcctgcgccgctcgaccaagcggcgcttcgatcggatcttctccatcctggacgacatcgtcgagcgccgcctggtggatcgcggcgaacgaggaggagaaggcggagccagctcgaacagcagcaagagcaagcaccagtacgacggcggcgacttcctcgacgcgctcctcgagctcatggtcaccggcaagatggagcgggacgacgtgacggcgatgctgttcgaggcgttcgtggccggcggcgacacggtggccttcaccctggagtgggtgatggccgacctgctccgcaacccgcccgtgatggccaagctccgcgcggagctcgacgacgtcctcggcggcaaggaccaatccgccatcgaggagcacgacgcggggaggctcccctacctgcaggcggtgctcaaggagtcgatgcggctgcactcggtggggcccctgctgcaccacttcgcggcggaggacggcgtggtggtgggcgggtacgcggtgccccggggcgccaccgtgctgttcaacacgcgcgccatcatgcgcgacccggcggcgtgggagaggcccgaggagttcgcgccggagaggttcctggcgagggaggggaaggcgccggtggacttccgcgggaaggaggccgacttcatcccgttcgggtccgggcggaggctgtgccccgggattccgctggcggagcgcgtcatgccctacatactggcgctgatgctgcgcgagttcgagtggcggctccccgacggcgtgtcgccggaggagctggacgtcagcgagaagttcatgtccgtcaacgtgctcgccgtccctctcaaggccgtgcctgtcaaggtgatcaactgagactagggctagttgagctagttgtgttgctcgatctgttatgtgtattggattatatagtttgtgcgtgtgccacgtatagtagctacagtattattcctagttggtttcgtgtaataagctacttaaatcaggactctcacagtcctagatatttgttattccattattcatatagtcaccacagccccataggccataatatacgtctagcatgcatctatgatatgattattttttcgagggcctatctgttgatcctacgatagatttatagtttcaaatcttataaaattacctgttgattattcattcgaaagacattttggttgtcttttcctctgatactccaacttgtaaacatcatatagccggtcagttaatctttttgcaacagtgcggagtttttctttttttcctttttcgagcaaaatggaaaactgtcacacgtacgccaatctcaattctcagactctgacatgcaatcaccgagcaaagcccaatatataatacgttgggaatatacatacggaccatatagtatatatgttgattgttgagcatgagagaccctctatctcgtcccatacgtctctgaccgccgtacccagccgtcgcttgcacgcgtccacgtactttgtcaacaaatcgaggagtatggctgaaaatctagcccggtttgacgccatgaagagatccatacatggaaaagtaggttggcatacgtacgtacgtacgaccgatggatggatcagcaatgctgtgaagagaaaaacggccaaaaagctatttgcacgtgcagtacccgccttttaacagaaaaactactggtcgatatcgatgcgagctctctaaaaaaaaatgggctcccgagaaaagtttcaattgacgttttcaagtcagcgcaagaacatcgacgacgacgacagtgcggctttgatttgcggggttcacacacgagtaattgcagccttgctttctcgaaaaaaataattgtttagttccttcaaactttcaacttttccgtcacattaaatatttggacacatcacacatgtatggagcgttaaatatggacggaaaaaaatcaattgcacagtttgcatgtaaattgcgagacgaatcttttgagcctaattacgccatgatttgacaatgtggtgctacagcaaatatttgctaatgacgaattaattaggcttaataaattcgtctcgcagtttactggcggaatctgtaatttgttttcttattagtctacgtttaatctctactacttaaaaaattcgtagtggtggtcttgattcctgacatagcagacgcatctgacagacacacgtaatctcaaccatccgattgccatatccaacggcgtcaatcttctccccatcacgcgctcgctcctctcttgaatcgatctcctccccacgcccactcctcctcctcccacgccgcgtccttcgccctcctccctgggcgacgctcgccccgccgccgcatcgcctcctcaccagccacgcccgccggcctcctccgcgatcgccgccgccctctccaacgcgcctccacctcgcatcggatcgatcatccaccttcgccctcctccctgcgtcgcctcctcgcctcctcaccttcacacctcgccaccgcatcgcctcctcagcagccccgtgccccgcgccccgcgtcccgcgccgccctcgaccgccgacgctgcgacccgcgccgtctcctcgctgccgtcgccgcgccccgagtcccgcgtcccgcgctgccctctaccgccgatgcgggagcaggaggtcacgccgcgtcaacaccgccgaggagccgcttcctcgccgccgtcgcgacgacccgcgccgccctcgactgccgccacctccgcagatcgccatcgcacgcctccgcctctcaaggtcacacgctcatcgccgcccgacaccccgccgattggggaccgaacgctgaccctgcatcgacgccacaacagtcgacagaggggagatgttgaagacctcactccaacgacggctgcgcgcggcgacactaccaggcactgagggagagaatgcggtgcgaggtgcggcggggttgttcgtccttgcccagatcaatgccgccgccgatccctcactcgcccctcgcccaagtcggcgccaagggcggggttcgccaatctgcttcccagccgcctcgcccgctccatgggagaggtgacacctgtgcccgcctccagcgctccatgcccccggataccatccgagcacgatccctccttagcttctgccggagaagggacgcatgcgccgaccttcagcactctacgcgccctgtggataattggttcgttctctttacgttgcaatccattcatttgtcaagaatcatcattgtgagtgccgagggttattacagattgcaggatcactaatgctcttttttgcccataaggtgttcaacgaaatgctgcttagccaatgtattaccagaaattgatttctctgtaagtgagaatgtcatattgtcatgtcccctatgttgttatttatactaatgattgcaggattctctctgttgttatttatgctatgaagtgctgggaagttgagagtgttgctaccaagcaaaaagattcaattgatctgttggagcaaactaatttggatctcgcagtctcaaaactaatctggttcttgattgtttcagagtggatgaaaataaaaaatggaatgatgcagtgaagattatgtaagcaatgttcgtgatatatcgatcctgaaattctcatagatggccattgcacaaatacaaaaatttgcaggttattaattagtgaactacatctctgtaaatctgcataacatatgttaaagctagcccaagaattaatatgttgtaaatctgctctacagttgacactgcttacattttctactattaataaccctcagctgtgatagatctgatacctgcttaaaaatttgagctgagttttcatacctagcagtaggactaacattttatgttgtattgttcagctcaagatgaacaaccacaccaaccccaagatcaccaactaagcctatcctgcttcatgattgttgctgcaaactccaacatgcttgctgctggtgcaatctgagccggctggtggcagatgggagcctgccctatgttgttagcagctttcttcactccaagtcatgcttgctgcctgtggtcttggtagtttcttttttgtgttgtcaatttaattattatgatttcccatgtgctcggctattggtgttcttgtttttatctgttttgtttcagggtgtcattactatggagtagatcatttttttcttattttttttaatgccttgtaaaataaccaactagcagggatgttcataaatttctcccttttgtttggtttttttcagacatatatatataatgaaggcatatatacacaaaaggaggagctgtttgagggtctaaaggacaatagctcaattgactgggaagctgttgtcatatgctgagagcaatctgctaaatgttaaagaggtgcatctaacttttgtacccagtgaactgcaaatctgcaccttcatttttgattaatagtttctttggattcagatcaaaatagctcaacatgggaatttttctagcagaggatgggcaattcttggaaaatactatatatttcttgtcgttgaatatgatcatgtcccattattttggcacttgctgccttgattctgttgcctgtcccagcccttcagctagctctctatcacacatgaatgcgtgacccttgatggttgtatgcagttgggatattttggtgagttcatcccccttccccaccccacctctctctctctctcaaaaccatcatttatcttcactattgacttacaatttcacttctagctgatgatgatcaatcaaagctagctcatatgtattagtgagtttatgaaaaaaaggatcagatattcaataacagagtcagctccttccgaacgatggcaaaatggtacctttataattttacttctcaacacgcacacatttttttatgacgagtttgaacttttgttctccttgtcagattttatctgaagcaagtatcatatacttctgtattagaatatggacgcaatcatatatctcctaaggtttagtgcatactctcatatttggaagtgaataccaaacgtgtatgaaatagtgcattcgatttaatctattctctcttgggcatttattcgcaaatgcaaagatttttgtaatttgatcgtagcatagattatggcaaccttggctttgtggtttgccatgtcatgtactgatatatgaatgtgatgctttaattaacgttgaaaagccatgaattatgtattcgaacgaattgattggatgtgtcctgaaatcggttcagactttcgttctttgggtactggcgtgagacggggaaaaagacgctgaagacatcaagcataacatggagttgataaaacatcgtcgactgaatcatgatttgtagtttttttggattgccagatttttttcagtgttcaacaaattttcactcaataattatttaatatcttttcacttaatataatttgaaattgatatatagcatttcccgttgcaacgcacgggcaccttactatacttcaaatatgtatccgtatacttaattttttttgaaatggaactaaacacggcctgtattcgttgctgctagcaaaaacgacgttcccaataatttgggcagagcttttgcaatagtactactctctccctccgtttaaaaagagcgtcttttttagcctgatttgtcccataaaagctgttttttatgattgtggttgagaattaatcctcagcatgaaaaacaaaacgacgaattaccgtatgatcgattaagtataagctaaaatatttaaaaattaattaatatggttttctaaaacaatttttctatatatttttttaaaaaaacacaccgtttagcaatttcaaaaacatgaatacggaaaacgaataagttgaagttggaaacattgactatcaaatacaaacttgagcagaagactattaaaatccgaatcttaatctgaaaaaagggcctagaacagatcaagatctatttaggattcagattttacctcgatttttgttaacacgcttttcagactactagacagtatgttccgtgcgaaaattttctatacaaaagttgttttaaaatatcaaatatattcctttgtcaagtttataataattaaaacttaattaatcatatactaatcgttttctcgttatatgcacatcaactttattttcatcttttcaaacaccaaatgtgtttagacaagtatgattaattgattattaattattaaaagcttgaaaaatccaggagtatggctgaaaatctgtccaggaatattattaatgtgttttatgtgggcacacccgacataaattttccttgtccgtattgacggctgttaattactaaattctcaccgtcaatacctgtataaaactataaatacaagacaccaacagtgtggtagggtttatttctaacaattttcacgagtgtttgtgtatatatgaagagatccatacatggaaaagtaggttggcctacgtacatacgaccgatggatgatcagcaatgttgtgaaaaaaaaaaacggccaaaaagctagtatttgcacgtgcagtagtacccgccttttaacagaaacactacgtactggtcaatgttgagctctaaaaaaatgggctcccgagaaaattaaaggtgtactttcaattgacgttttcaagtcagcgcaagaatatcaacgacgacgagacacagcggctttgatttgggggttgatcacacacgagtaatttggacagagcgtttgcaatataatactccctccgtttaaaagaaccatgctatatgtccgacgcaaatcatccgaccaacgtacgattgggacggcaaccacaaaactacgcgacagcgtgagtcagattttatggatcggtcctacaccatacgcgcctgccaccacatcatatatatgcaagcccatattttttttattttttttagagaagggtataccggaaatatgcagccatttaaattagaaacttagcctatcgaataggaaacttagccctcaaataacccaatctgaaattccctcctatgaagatttgaactcaggaccttgggatgctactcaggtcattgcaaccattagtctacaatgccctttaactttagagaagggtattttttacccggcctccatatccgaccgaatatatgcagctatttaaattagaaacttagcctatcgaacagggtgcaagcccatatataagtgactgttggatgcaacttgcaagcccaaactattgaagacaacgtgaacatgacacttctgccggagttgaggtctatcgtaatccaatgtctgctaacttgatctcaacatttttctcatgttgttttcaccgctgcaagtgcaaggcactatggtttcaagttgaattttcatggcctaacaagatgcatgaaacaaaatataaatacagtgaaatccaaaaccacaagcatagtgtctattcgtcaaataaaaataaacatgcaaacgtgttgatctgtctagttcgtcgattgaaatcgcaagacacatataaccaacgtctgacccctctttccaagcaacataagctgctacttgggcttttggaaaggcccaacaagttggaaaatcacatcggagcccaaagagatcacgtcacatacgccggtaacaacacggacgtcgcataagccgtggtcgtacaaagagtcggacggcggggttgtgtgtatagcattttcggcaggcgatgaatatgcaaataattaataccatcggccaccgtgttggacgaggccggtgtgaccttcgtcaagcagaatgtagcgcttgccaagttcagcgagtgttttaatcatgaccaagcggaccgcaccgccgtgtccgcggacgataccgcgcgccaccgagctcctcgaggccgggggtcaccttcgttctgggcgaggcggcggcgccggagtacaggttcggcgtgacgttcgaccgccggagaggagtgatggagatcccggccatggagatcgacgacatgaagcggccgctcctcgtcaacctcatcgcgttcgatcgagcagacgcggtgcggcgaggtgccgggcctcctcaccagctacgtggcgctgatgggcagcctcatcgtgacggcgcgcgacttcacgctgctccgccggcaccgcatcctggagagcctgctggccgacgacgaggaggcggcccggttcttcgcccgcctcggcgactgcggcgccatcaactacaaggagcaggctttcgcggggctgtacgaggacgaaaaatttcaatggcaaaataccaaaatttagatagaaactcagtgaaaattttgaaacagcatagctcggccctactctggcggtgctgtaccgcgactacttcgccagcctgtggtcggtcatctccctcgtggtcgccgctctcgtcgtcgcccttaccgctgcacaaacttacttcaccgtgttcccggccaaaaaaatgactgtaatctttatagacatcatagcaggccaattccaaaattttgtgcatgcgtttccaggccgcaaataaaacgagcttgcacaaggctgaatgtttcttatctgtccagtattaaaaaatatttgctttgagctatctttcattatcgatatttcgttttgaatcagcttttaaccaatgtttttactttcacccatcatttttttttctgtttgctttcatccacctcatgcatctgcaatggtaaaaaagacaagcaaaacaggggaaacacgaggaacgatgcagccaggcataaggccaagtacagcaaaatcccctgctattgaacaacagtgctatactagtagtacaaaacttagagtaaacactataactataaagacatactcctccatttcgttttagtttataagttgttttcgactttggtcaaagtcaaactattttaagttgattaagttcgtagaaaaaatagttacatttttatcctaagacaaatatattataaaaatatatttaattatagatgtaataaaactaatttggtgttataaatattattatatttatttacaaacttagttaaatataaagtagttttactttggtcaaaattaaaacgactcataatctaatacagatgggctatcaacatataacgtggcctaatcagttcaatctaaaacagagctaggttaccaccgtcaaggcaccagtaatggcagcaaagtgagcaagaagggaaaacatcaaggcaaagaatcactaactggttcttataatccaactgtgagcggcacgttcgtccccaccgtcctcgccgcctgcactggggtgggagcgggttggatagaaacgtccccactccccgcattctccctccatccccggccccgctcaataagtcaggtgaaaaacatcacccgcccagctctcgcagtggattcggtaggtgagtggggccctgcaccacccagatggacagcaactttggggcgtctagctagaggtggcgcgtcgcaacgaggtgatagttgggggcagcgataaggcggcatcggccggcggcaacgacgaaacggcaacgtcagctaggggtagcacgctaccaggaggcgacgtcggccgggggcggtggaccgtgaggaggcggcggcggctgagggtgacacactgcgacgggatggtgctgtccaggtgtggcggcgaagaggcgacgctggccggggaaaattgcgaagaggcagctccggctcagggcggtgacagctagggacgtcgtgtgaagaggcaggttggctgggggcagtgtgttaggagggtgacagatgtgggagttagaggggagagaatgacggtaggtaaggatttaggaaaatttaaggttttgtttatagtccttcactaaatgggctaaataggtctttgaatgtaatatcttttgacttgtaactcatatctctgaggacttgcgggtcatctgcggtaaactaccatccccatctccgcccctgcaattttgagggccccgtacccactctcttgcggggaagaattttcttcatccctaaccccgtagggacgacgggtcctcgctggatctccagaaagagaaaattgccacccctaagtccgtcctgctaaggcgtcaacctcgcgcaaaccacgatcggcattgatcaaccctacttgttgcgcccgcatgcacccgcaggccgtcctcacggcccgcttcgtgtccatgcacacctcccagctcgaaccatgtgcctggatggggaaaggctagtcggagcatgcgcgccagcggtgcgcattttttcggacgaaagtagttagactaaccaattagtcttagtatttgatagataagattttctcaacttattataaagtagttagaccaactagtactggaggtacacgttaaattttggtataaagaagcttatatgcctataaaagtttaaagaggataaccatattacttctcaatgttgtggaagaaggaatatggttatcggacggaaatggtaccgttcaccaattaattagaatatggacaattaatcggaattatacggaaatttaacgatcgtgaatatatgtacaaattttacaagagtatatacttttcgaagatttagatgtgtacaactatataaatcaaatatcttcattttgttttttaattaaacagataagtaaaacattaactcttctaacaccgatttatacatcacatggtggtagaattggttgcattaaataagtaaaacataaaaatatatgtaacaaaaaaaattaagtaaagaaaattactctaaatcatcatcaaattcaatgtacagacgattattctggtgatttaacgaaaaacaaccaactaatcgctaaaacggagttttaacgttcgtgaatgataaatgtacaccgtatcatgttaatgaaacggttttactaccgttaacgtatatgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagccccctctaggggcatgatgacacaacctgatcgtcagatcaatacacactcggcggattcaaatccccaaacaggagtagggtattacctctcattgagagggcctgaatctgtctaaatcctttgtctccgcatccatccacttttaggtctcgtgcgctacccccttttattattgccgaattcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgccttcgtcgccgccgactggtgtcatcgcctatacggttggtcggtcacaccaccgttcatgggcgtccatgtcttcaccgaccggctggcctccgtcgccgccgagtggtgcctccgcctacacagctggcctattatgccgccgctgttgggcgtctacgacttcaccgccggcctgcctccgtcgccgccgactggtgtccccgcctatacggtcggttggtcacaccaccgttgatgggcatcgtcatctattatgccgccgctgttgggcgtctacgacttcaccaccggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgccgttgttggatgtctacatcctcaccgttggctcaccttcgctgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttcccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatgtttataaatattttaaaatacttgattttttctcgagtattatatttatatcagatactactcatcctatatgtttgttctgcaggatccagatccagatatgcataaaagggattcatggctttaggcttatcacttacgctccaggaatggatcagtcagaacatcaccgactggcttgccttcgctgctgccgactgatgtttccgcctgcacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgactggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgactggcttgccttcgccgctgccgactggtgtttccgcctgcacggctggcctttatgccgccattgttgggcgtctacgtcttcaccgaccggcttgccttcgccgccgccgactggtgcttccgcctgcacggctggcctattatgccgcc

SEQ ID NO: 44442 - DNA, 6278 bp, Oryza sativa
tcaccgaccggcttgccttcgccgccgccgactggtgtttccgcctgcacggctggcctttatgccgccattgttgggcgtctacgtcttcaccgaccggcttgccttcgccgccgccgactggtgcttccgcctgcacggctggcctattatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccagccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcatggctggcctttatgccgccgttgttgggcgtctacgtcttcaccgactggcttgccttcgccgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctatttaaagcccatttaaaagaaattaaataaatttaattcaatttatggacaattttaatatgtagatctttattttacacaacttttgcaacttgaaccacattaaactgagttaagatgaattagatatgaatttttaaagattaaatcggattaaaacctttaaactgattttaattgaattatgacgcaataatgaattatttttgaaaaggaaaagaaggattattgcgtccgcggctagggtttcggtggaccgggcgcacgggcggcggttcacgcgaacggacggccgagatcgaaccgatccaagatggacggccgagatcgatcgggtccacggcggctcacggcagacggggacgatgacgtcagcgatgacgtcaccaccggcggcggcggctcggcggctcgggctcgcatgctcgccggcgaacgacggcgcggcgacgcgaacggagagcaccaggacgtagaggacgacgcggcgaactcaccggtgaccaaaacggcggcggaagaccaacggacggcggcggcgacgaggaggaagcggcgaagctcttcgggtcgacgacggcgacggcgctccgacggtcttcggcggcggcgaagcggtggacggggacggcgacgacttggcgaacccgatggtggcgacggcgaccgacgacgacgactgcaacggcggcgcggcgcggctgaaccgacggcaacgacggcggcgactagggctacgcggaggcggcgctagacgcgacggcaggctaaggcaaaggaggcgacgggtagaggggagctcgggggtccttaaataggtgcaaggaggcggcggcgaaggcccacggcgaccggcgacgagaaggaaacttcgggttggagggagaaaagaggaatccgattcaaactcgaatccaccggtttccaaagaaaattagccgatgtttccaaaagagaaaaggaagaggagatcgagaggatcatttgccctcaaacaattcggccggagaaggaaagacgcggccgaatttggaaggaacggcggcggcttgcgctagggtttcggccggcggcggcggcgcgaagacgaaggatctgacaagcgggccccacctgtcagcgacagcgagagagaggagagagcggcagcgacctgggccggactgggccgagggaaagagagagagagggttttgggccggctttcggcccaaagccaaagaagacttttaaaacctttttcaatttaaattatttcttaaatgtaattccatttactaaaaatacttccttagctcaaataaatcccagaaaaatctaggaattatagaattaagcaaagtatttaatgaaattttatctggcccctttttatattgagatttagcaaattaaaattagatcttctcttttaagcttttaaaatcatttctaataattccttttaaacaacaatttataatttaaggatttttaaacaagaaaagctcttaacaattataattagatcattaatgatcaaataattactgaactgttctttgtattatttaagaattgagctctgaaaaatccgagaaaatttcagagagttgacttaaccatggagaatttaacaaaaattaaatccatccatgctttagatttaagaaattttatttcccacattttacttcacttgtaaattaaagaacatttaatataaattctattaataatttattaaataatttataaatcctgaaacgaaaatcaggatgtgacaaactaccccccttacaaagaatctcgtcccgagattcggaacggctagaaagaaaaagggataggtaaactgcagtctatcttattccataactccgataattattataaggctttgaagaaaactactgctgccttgaaactggtggctgagttgtaacacttgaagacacaactcttgaagacgcaactggcactgcattggctcctgtgacaacaatgttgttgacctgaccttgcagctgctgatgcttcggcttcggacactctcttgcaaagtggcctggcttgtaacagttgaaacatacctgctgctcccttccactactgttattcacttgagactgatcctgctgaactggcaccagctgattagcctgctcgatgttaagttcatcattagtctctaatttgatctcaccaccgatgttcaacggttgcgactgtccttgaccagcggaaaaaggttcaccaatttggagtggcttgatacactgcctctggctactaccttgtgcctcctggaatacagtcattctccttttacggttatccatcctgttcttcttgtcttcaagtcgaattgctttgtcaaccaactcctgaaaatcctcatagtcatgagagatcaacataactgatagctcatcctttaagccttccaaaaacttctcctgcctttcctcgtcagtacgcacatcttctggagcatagcgagctagacgattgaactcatgaagatattccatcacggtacgatccttttgcttaagtgcccggaactcacgcttcttcaaagcaacaacacctgcaggtatgtgtgtcttcttgaatgcttccgtgaactccgcccaagtgattggttgtccttctgctctgttcatccggaaatgatcccaccattctgatgcaggtccttgcaactgatgtgaagcgaaaacaactttctcctgatccgtgcactggagcagttccaacttcttctcaatagcgtgcagccaatcgcctgcttccactgggttggtagtgctagaaaaggtaggtggcctcacacgaagaaaatcagttaacttgttctgcggcggtggagcattgtagttcccttggttgagctggttctgcatctgctgtatcatcatgttcattaactgagtctgttgagccagaacttgagcaagagttgggttcccttcattattattgtttccacttccattagcacgagtgttcaccatctattgcagataggaggagataggaggagaggggttacactaaagacaagaccttaaccaggttaacactgatctgatgtgtgtagaccattatattgttcaagttgattaagcaagcaacctagtatagttacacactcatcaatgaactactccaatgatgggaatgcaaccatacctacacacaagcaagcaacaagcgttctaccctactaactattcttcaaagacactttggcggcataggttctaaggtaggatccaaacttcattccatcttgaccacttggcacttcggttcttcctcgatccacttgactgacctccataagtagacctcattaacatcttctagtttcaacaactagttttagaactactcaagttgaaagcaggaggggagaggatgataaaatgatttatagagaattctagagaaggaagaaaggaaaattttcacacatcatgttttcggaaaattagtccttaaggtttgaccatttggcttatcctacagtcgagatggctctgataccaacttgtcacgcccggaaattcactagtaatttccgaacttatttgtgcataaaatcctcgtccaggaatcagccgaggtacacaaattgacaatttaatatacagattcatcaaattaactaaaacgataaatacttacttatgaggcacttagtcctcaccaagaagaaaattgcagcggaaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaaggataccaaaggatggcataatatcggctcatttgcaaaagcagcatttagcaaaatatttaagagaagtaaaacagtggagtaattaatcagaaattttaaccaacactgaacagcacacccatgctgcacaggcccaaccattctgaacaaccatacccggctgaacagatctaactccaaaccaggagctaagcaaattattaccagttataacatctataattatggtgagaggtgtgggactaatcacgaaaaacattgctcaactcgcccataaccgcgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcacccccttataaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaattgtgtgctaatgtttctaagcagggctaagcaatcacatctaatatctagctgaaccaatatataaagctcaactagtcaaattataatgacccaaggtatcaaggattaaagtaatcaatgcaaacaggccataacaaaggaataggttcacaccacccagtgacattcgaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaaactatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctatttaaagcccatttaaaaagaattaaataaatttaattcaatttatggacaattttaatatgtagatctttattttacacaacttttgcaacttgaaccacattaaactgag

SEQ ID NO: 44443 - DNA, 13373 bp, Oryza sativa
cggctttcggcccaaagccaaagaagacttttaaaacctttttcaatttaaattatttcttaaatgtaattccatttactaaaaatacttccttagctcaaataaatcccagaaaaatctaggaattatagaattaagcaaagtatttaatgaaattttatctggcccctttttatattgagatttagcaaattaaaattagatcttctcttttaagcttttaaaatcatttctaataattccttttaaacaacaatttataatttaaggatttttaaacaagaaaagctcttaacaattataattagatcattaatgatcaaataattactgaactgttctttgtattatttaagaattgagctctgaaaaatccgagaaaatttcagagagttgacttaaccatggagaatttaacaaaaattaaatccatccatgctttagatttaagaaattttatttcccacattttacttcacttgtaaattaaagaacatttaatataaattctattaataatttattaaataatttataaatcctgaaacgaaaatcaggatgtgacataaacataggccattttaggcgtgcacaaatcaaactccaaccaccttgatcggtaagtgagcaagcttctcgtccttgccttaccaggaacccggtttgtccgaccccgccccggcgttcccaactattggcatgcgaggtttccctgaaccgtctagttacttagccagggtgtcccattccaccttgtggttgcactttggttatgttcgatgagtttcccataggaatcggtccttatatgcgaatacgggacagtgccacataggcacaacccccgcatcgcgacttttcacaattcattttattttcaaacacaccgacaccacatgtcgggttttgaaggcttcacaaacccatttcccaagttttcgacaagcaacggtgtatgtgggatatttgggatacgcgctcagagagcacgaataccaaggtaccacaagggtggagcgacaaggaatcagggtagtacaacctacagaaattagtgcgactactgggtaggtccgtcggtttagcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataaccacaactatacgcaaacaatcgaaaacctaaacaaaggaccaaaagaaagatcctatttagactaattagtagtgccattaaatagatctcaattttacgggattactggaggttgagcggagtcaatcggatgagcggttgggaagatatggattttctaaggtttaaggattttctaatcaaaggagaaaggatttaataatttattaaacccctttctggaaagagaattgaaggagggatgtaaactagacttgtttcggtggcattggcgcggcccaagggtcgaaggaggctcggccaagccattgggccgacgcgggcgcaagcaggcggcccattagggcgcgcgggagggagagggggcggtccggtggaccgagcccaccacgcggggtcccgggtggggcccatatgtcggcgagacggtgcacggtggaagcggcgcacgcggggcgggcgctagggttttgggtgcaccggatggatcgaggcgcggcgggcccacgtgcagccgcatggcacaccgtggtccgcgcgcacggagggggaaacggaagggaggggccgaccgggtctgttgactcggtcgtgccgaggtggcgccgacgtggcggcagccacgcgggtcggcggaaggacgaagacgaggccggccgggatggacggcggacggcggcggcgttcgcaggagcaaggcgcgacctcaatggaaaaaggaagcacaccgggggaaggggagagacgagacgaagcgagccgacggctcggattcgccggaggatggccggaatccggcggattgtggcggcggcaatcgctggcgagcaaaggggggaatcacgacgagacgatgagggttcgattcaaagggggtggagcatctccggggttcaaggaatccgtttccggtgtcggatggggcggagaatcactgaggagggctggcgacgagcagcggccttcgggagcggacgacaatggcggcgaggctgtgccgggcggcgacggcgctagggaatggtttggggaggtcctagggagctcaaggacggtggtggcgcgaggtattggcgagagggcccacggcggctcacaggcgggcgcggcggcggcgaagcagagcaacggcggggcggcatgtttaaggggacgagcgagcaaccgaatggctcggggcttatccaagatgatgcagatggcgagaatttgggcgaggagctcaccggcgtgcgggaacggtatcggcggcgatttggggatggaaaggggtggaaggccgatggcggcacgcgaccgagcggcggcgcacggcggatgacgccgaggcgagtgcgccggggaagaagagagggagaggtggcgcccggagctcctcgtcacgcgttcacgctcgcaccggctcctccggtgctcggcgacggacgacgacgacgagagcgggacaagcggcaacaaggcggcgatggtggttcggtggtaatggcgctacagcggtggagactgaagcggggaaattgagaggagggtctcggctttataggcgaggaggagaggtcggtttggaggagggaaaccgacattggcagtcaaggggtgcaagggcgacgagctggcggtcgtcgacgcgtgcagccaaggcggcggcaggtgatgacgccggcggtgtcgggcaaaaggaaaaagaaggaggaaaggggcttggtcccttgccaaaacgagaaaaggaggagggagagtgaggaggaggaggagagggagggcagctgcttctcccactcttggacgggtgcggcgtggagtggcgggggccatggatgacgtcgacgatgacggcggcggtcggtttggcatggagcgggggcaaggcggcagcgcgtggcgtcggcggcgcaagggctgatggcggcggcgaccggccggtcggccacctcgcgagcgcgcgggggaatgggcgaaggcggtggaggttttgggcggcgacggcgggaagcggtgtcggcgcgagagagagaaagagagagagagagaaacagcgagagcgagagagagacagagagagcgagcgacggctctctctctctctcggctcacatgcgtgcaacgcacgtgcgagggggggggagatgatgggctgggaggggagatgggccgggggaggagaatcggcccatccaaaatcacagggaggtaaggtagacttttacagagaaaactgatttggatagaattggggagatttagggtttggattcgaattcaaatttgatattcgaactcgagggtttagggatgtatcaaggggaattcaaggagaagtcatgggaaagatttaaaaggaatacttgggtatttgttctcgggaacatagggtggggtcaaggaaaggattcgaggcgggatttgaataattctggattcgtagaagtatttggcgaggattcaaaggaagggattgactttcggatttaggtttcggaaacttgaattggaagaggagatttgaggcggaggattttgatttcgatgagagggaacaacgggattaaattgagatccttggcacaacttagactcgcacacaaagaacgaaaattttcgcaattaggattttgccgaattagtttttaacgcctcacgaaaagcggagcgttacagctccgggagcatggcgtcctgaagagcctgctggccgacgacgacgaagcggcccggttcttcagccgcatcggcgaaggctgcgccatcgactacgaccgccaggctttcgccgacctgtacgaggacttgcgccagtactgcaactcgcacttctactaccgctgcaggctggcgctattcgacctccggcggaactacttggggagtccgtggaagaccatctccctcgtggccgccgcctcatcctcttcctcaccgctacgcaaacttacttcaccgtgtttcctgccaaaaattgacagccatgagatgatgtttaagtgacgcaccaatttccccaaatcgatcgggccttcactttgtccatgcttttccagccagaaaagaaaacaatgcaaaagtaatatgatgcacgagactgctagctcctcatttcgttttatctccaggataaaataaaaacccatttcacataggagtatgaaactatcacgtacatactcaaatgttcgcacttttctttcttttttcttttttacatgaccaaaacattcacaataactggggtgaaaacgatcggaaacggtaggaaccggtagtatgtctttgaaaacgatgctcgatcagccggcaattaaccatatttatcatttaaactactcagtatcgatattaatatgatgcagaaagaaattagaaaaaacaaaatttaaaaatagcaaaaaagggtacggtcagaaacggtaccccttaaacggaaatggcgcccgatcgatcggaattttttccgtgaccgttttcacccctaacaataaccacaggagatggttattcctgtcttccaaacccaaaaaggaacaagactgaaaaatgcaaaacaatacacagttgtcttacatgctcggtcctcggatggccaagtagtccctcagcgcataaacttgaaatacaggattactagaccaacacaagtagtgctatgatgaaagctatgatccacttgttcctgtccatcctcctcagtcctcaccatggcccccatgatccttctacgtactcttcccgatgttgtcatccacgttatccaactgcaatgtcaagaaagacatgaatggcaaggtaaaaacaaggaggatacactcaggcctaaggccatgtacagtaatcaaacatgatttatttattttttttaatttggcgctttcattctggctccaggaagacaaggaaacatggtttaactgctgaacaacataatgctactgtgatctactccctccgtttcacaatgtaagtcattctagcattttccacattcatattgatgttaataaatctagacatatatatctatctagattcattatcatcaatacgaatatggaaaatgttagaatgacttacattgtgaaacgaaggaagtatatcatattgccgacttgctggttatataccatagcttatctaagttgctataagaaagaccttccaaaccgttgcctcacttctttaattctaccacagaagttatccccgttgaggcaccagtaatggctgtaatgtaagcgaggaatggaatagcccaactccccaaggcaaagcataagtgactatgtatacaaggacttgatgatttaactgcgaactgataattttctatctaccaaatcaaatagaaacatcaaatgaaaataaattgcaaaaataagtggaaggtgtccatgacgccatgaattggtacgtcagtaaaatacaggaaaagcatataaccgcaaggagcctatatataggagcaggtaagcatcaagcacgtacaatatctaatttatataggtgcagaaaaggcttataatacataaagagttcataaaaactcttgtacatgtatacatatttacctgtcaattaagactatatataatgaaaactatcatatccaatacagaacagatttatgtaggcatgatttcctttaataaattgcatacaaactgtatatcatctacctatctattatattattatattataaagataggtcgaaaaggattcgttttggaagccgagaaattattagattttggtggaccaaaataaaacagtgcgattgataatagagatatagatgagataattccttatataccactgaaaattggtcggttcctgtgtatgccactcaaaattggctcttcctctatatgccactggctcaaatttatatacccactcatgccactcccgtatgtttactgtgcattgattgttaactatggagtacaaagacgtatttgccctttcgagttttagacatgtatatgtgccaagtgctacatgtatacataacatgtacatggtcggcgcagcgggcgcggccggcagccgatggaggaggagcgcagcggagaggagggtcggcgcgatgagcggtggttggctgccagcgggggaggagcgcggcggagagaagggccggtgcgacgggcggcggttggtggccggcgagggaggagtgtggcggagaggagggccggcgcgacggtcgacggttggcgacggagaggagctaggcatcgggggcggcagcgtcagggaggaggtcacgatctacgagctgcgaccccccatccccttctcccttatccctctccttccccagccacgggcggcgagctgcgaccccatcccccatatccttctcccttctcccttctccctccctagccgtggcagaagatcgcggagcgtgtcgagaggaagaccggcgagctgcaaccccatcccccatcccccatccccttctcccctctcccttcctagccgtggccagcggtggtgaatacaacaatgacgccgccgccacagcctcgccctatcatgcccgtcggcgcacacttctcctcctcgcccgggtagtgctggctggcccctcgtgatgaacggctggtggcttccactccaaccggtagtgccgccgcagccaaggccacctcccaccgctggagtggcacccttcccaacgtcgtcgatggtgccccttcctctgcctgatgcaagaactattgaatatatgaatgattgcaggcacataatttttagccaaaggttatttcggtcatttatgccaaaaataaaactgacatgtgactagatcctaacgtcaatcaatgcacagtaaagagacggaagtggcatgatagagtggacaaatttgagccagtggcatgtagagaaagagtcaatttttagtagcatataagtgaactggccaattttcagtggcatataaggaattctaattcaatcaagtactatttattattgtatataaaatatagttacatatatgaaatagaaattaatagttgtataacaaataaaatttaattagaatatgcaaaattgtgcgggaaaatttccaagttgggatatcagttagtaaataaatgggatatgcaaaataaaaatggttagctcagacagggtcacagggaataactaatagtaagtagttacttacatatcattagcatgtatcagacgtcttgacctgctccgtcttggagtagcccacatgcacaggccatcctgttgaccgattccatcacccaaagccacacaaatgcacttcactgaagcttaggagaaacttccctcgaggggatgttctctcgtttgcttaaaaaccatttaaacggttatgaaaaattctggaaaaatttaacaatattcatacaacacatatatacaactctacaaaatcttaagtccaaactcaactcacacgtcgagatataaaaaagacaaattcagcatatgaatagtagcgtactgtttatatctaaatttgtcttttttgtttctcgatgtgtagatcgaatttgaatttgaattttggtggactagtaggtattattatactttacattgttaatttttttttagattttttcataactatttgcatcaaatttgaaagaaaaatgtatacgagggggatatcccctcgagagattagaatccactcccggagcttagaccaaaccaaatgcagcacacacatatgcatatgcatgctacgatacccggtctactctagcttccatgcatcacccgagccaccatgcacttgaagccttgaaccatagtgctcatgtgcattctttcctttcagttttcttcgccaataccaaggcttgcacatacaactcgtcaagctcgttacaaagacctctcacaagttgtcctccacctctcatccatataagaaccgaaaacagaatcggctaagacagatttggcagctagaggcgtaggcggcggtggtggctcaatcctattggatttgagaaatatatcgagtttggttgccaattcgtgaatgtgttctcgtgttcattgtgaatcttggggtcactaacaaattctggtatcagagcctcttgttccaaaactctctcgatccggttataaaattctagagaaggattgtgattgttcttcggatcaaatcccgcggaaaggcaacttgccttcttttggttgactagatttgcagtatgagcgagttggttaattctagagcgaccacgctatatcaccgagcaagcggcgcagatcacggtgcaggaagggaaggttgctttgcttctcaaaaccatggaggagtatgagaataggagggttgaagcggaagagagggcgcatgtggatttggtggacattaagaaggtgcttgaggtgaggctacccgtggtggagaagtggatgagtttggtctgcatatcaagcgctttagcagaaggttgaacaattggagaaaaacgtgtccaagcaagggagtgattcatttcagggtgatctgtcctcggcagcagcaaatccaatatcaccatggcttgcggggaagagagaaaacatgtttccttctcctgttcttgttcactttggtgggcattcagggtcggcggcaccagggccacggggcaggggcgcaggcgggaggtcggcgcggatggcggcgctcatggtggcacgcccggcgcagcggcgcgcactgcggcacgctcaggatggagaagaggtggaggggaggggggagggagtgctgtttgccgtcgtcgtggatctgggagctgcttcgttcacatcctcatgctcgacctcatcatctcctatggcgtcttcggccagaggaacgccgacttcgaggtggccgccgtggctgccaccaagaccgtcgacgacgagtcggtggagtccttcgtcagtcgtcacccagatgatgcacagccctttggtctttgaggagagagtgatggcggcagtgaagctaacgccgccggcaaggagggcgtccaggcgtggagctctctgtacttcccagacgatcccctcatcgtcgtcgccgatgtcgtcccccacgcctcccccgcactgccgctgtcccccacacctcccccatgcctcctcacgggccatgtgcgccgaccgccagcccacccttgcgcgccgctgcccgccttcgcctccgctgccagccgcccgcacgacctccgcgtccgccgccggccgcccgcgagacctccgcctgcatcctcggtggcgccgtggcctgtgctgctgaggagaaaatttacatttagccattctcagggtggggtttcgccagaatgccatcgccaaatgtggcttcattataatgccatcttcaaacgaccccatcttgccatactgccatttcaaccaattttgattatttgcaaatattttccactgttttgcttatttggtttgacccaaatgcgcttgcctcagccgtggggcctacttgccaggagcgtcttccacctccgtccgccaccatccttccctctctccggtgaactcatgccccaaattgatctccctcctcagttgctctcgccccaaattaaatgcaaaaatcagttcctctcgtcctcctcatcaattcccccaacaaatcccactcaaatcggcttaactccgtggtggattttgaagtccctcttcaatggcgagctccaccatagccagcgtcgatctctctccccgacgaggttggagcgggcaagcggctggacgccgtggagtggagctggctgcggctgcacgcacgagcaggttgcctcgacgaggagctccgccgcgagtcgctgcccacgtcgaggagctcatcggagaagggagtgacgccgtggcgcgcggtcaggtcgagcgcttggtgcgccacgccgccaagccgaaccgtcgtcctcgtccacgccgacgccttccccgtccccagtcgcgccgccgtgccgcctttcccgttcccggtcaccgtcgccaccgccggcaacctacgcgcgaacccggtgagctacgccgtcgagctggtgagggcgccgaagggcggcgtcggtgccatccccggcgtggccagctttctcatcccgtaccggttcggcgacggtcccgagctgcgccggcgccgcccaccatctgcaacgaagagagcaagaggtaggagaagagagatgagataggatccaagggtattttggtcatctcaacaagaaaaatcattaaactgagaagaaatggatgaaatggcattttaacgaaaccacttttgggagtgtcgttccagcgaaaccccgttttgacagtggcaaaatgtcaattttctcgctgctgaggggagggagaagagagagagatagaggtggggaactgataggtagggcccaccgacttttttattaaaagaattgctaactgaattatcccgtaggaccaaaaccagcgcggattgagacgggggattagttgtctttgtatagttggggatgaaaaatgtccggttttgtggtttatggggtaattcgtattttttttataaaaaaaatggtatggctaactatcgcagtgtaatactgttatatcggtcggctggtcgctgcatgactttagatttgcaacggcgtccggcacgaaacttgcgagaaagttaattacatctagtgacgctcacctcacctgaaaacctggaaagacaacgtgtgtcgttgcttaaattttctgtttgatcaactcgagaaatgcatgctcataaggatgtcaaccatcgaggacgaacgtggttagatggatcatgactgtgcaattgtgcatgttgtacatttctattctccaagttgcatgcatgacttattgggtcgttctttttaccccgtaagggtctctttgatttgtatgaaactagtgtggtggtccacgcagattacgcggctagcattattatattttctctcatataataacatatatgttttctcaatgtaatattcaaatatattaaaatgacaacataattttaattttgtactaactttacgaaactactaatgtgtaatattcatattgtattttatatacgtgttagttattaattatttttaatatcaaattttagttatttgtaaattatattcctatatggactttagactcgtctttcaatattttttatttaattccaaattttcgttatctgtaaattgtatttctaaatagactctacgctcttcttccaatattatttatttttaattctgaatttttattatttctaattgtatttctatgtggactctaaactcatctttcaatattctttaattttgaattttgaattttagttatttgtaaattgtaatatttttatatgaactgtaaactttacttttaattttattatgtttattctgaattttagttagttttaaattcctatatggactctatactctacttctaatattctttatttttaattccgaatttctattatttcttaattgtatttctatatggactctatactccacttctaatattccttatttttaatttccaatttttatatgaactccaactctacttttaattttattatgtttattccgaattttagttagttttaaattcctatatggactctatactctacttctaatatctactattataaaaattgaaaatgtttttgccggtattttggtaagttatccatgtatgagtcggttttaagttcgtttgcttttagaaatacatatccgtatttgagttggtttgtaagattgttcacttttggtaatacagaagaaataatataagaaatctgtttaaaaaaactcgcatgctaacatgagacgatcggacttctaactgcagccgattttctaaaaatatatatatccaagcgaactcccacggtgaatttcatcttaactaaaccatataacaataataagataaaaataggcttcacccgttgcaacgcacatgcatttttctagaattccttatttttaatactgaattcctattatttcttaattgtatttctaaggactctatactctccttctaatatttcttatttttaattctgaatctattaacttattaaaggaatagaaaaaggagcctccacgttcgctctcatggcctagaaattctcatattaatcggagaaaaaaaacagagtccatatagaaatacaatttagaaatagttgaaattcggagaaaatataatgatgctagccgcgcaatccatgctagtttctattatttcttaattgtatttctatatggactctctacttctaatattacttatttttaattccgaatttctattatttcttaattatatttctatatagactctagtctcctcttccattattccttatttttaattctgaattcctttttttttctgaattgtatttctatatggactctatactctacttctaatattccttgtttttaatttcgaatttctattatttcttaattatatttctatatggactctatagtctgcttctaatattccttatttttaattccaaatttctattatttcttaattgtatttctaaatgtactctagtcttctcttctaatattccttattttttaattccgaatttctattatttcttcattgtatttctatatggactctatactctacttctaatattccttgtttttaatttcgaatttctattattttttaattgtatttctatatggactctatactctacttctaatatttcttatttttaattctgaatttctattatttcttaattgtatttctgcatggactctagtctcatcttccaatatttcttatttttaattccaaatttcaactatttctaaattgtatttctatgtggactctatttttctttttctccgattaatatgagaatttctagaccgtgagagcgaacgtgaaggctccttttctattcctttaataagttaatagatttggaggatttcaattctattgaaaaaatttctatggaatgagtaatcctattgagatttggagaaaagttagcaggaggt

SEQ ID NO: 44444 - DNA, 959 bp, Oryza sativa
  unsure (1)..(959): unsure at all n locations
nnnnnnnnnnnnnnnnnnnnnnnnnnnnnnnnnnnnnnnnnnnnnnnnnnnnatcgtaccgtgatggaatatcttcatgagttcaatcgtctagctcgctatgctccagaagatgtgcgtactgacgaggaaaggcaggagaagtttttggaaggcttaaaggatgagctatcagttatgttgatctctcatgactatgaggattttcaggagttggttgacaaagcaattcgacttgaagacaagaagaacaggatggataaccgtaaaaggagaatgactgtattccaggaggcacaaggtagtagccagaggcagtgtatcaagccactccaaattggtgaacctttttccgctggtcaaggacagtcgcaaccgttgaacatcggtggtgagatcaaattagagactaatgatgaacttaacatcgagcaggctaatcagctggtgccagttcagcaggatcagtctcaagtgaataacagtagtggaagggagcagcaggtatgtttcaactgttacaagccaggccactttgcaagagagtgtccgaagccgaagcatcagcagctgcaaggtcaggtcaacaacattgttgtcacaggagccaatgcagtgccagttgcgtcttcaagagttgtgtcttcaagtgttacaactcagccaccagtttcaaggcagcagtagttttcttcaaagccttataataattatcggagttatggaataagatagactgcagtttacctatccctttttctttctagccgttccgaatctcgggacgagattctttgtaaggggggtagtttgtcacatcctgattttcgtttcaggatttataaattatttaataaattattaatagaatttatattaaatgttctttaatttacaagtgaagtaaaatgtgggaaataaannnnnnnnnnnnnnnnnnnnnnnnnnnnnnnnnnnnn

SEQ ID NO: 44445 - DNA, 957 bp, Oryza sativa
gcaaacaggccataacaaaggaataggttcacaccacccagtgacattcgaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctatttaaagcccatttaaaaagaattaaataaatttaattcaatttatggacaattttaatatgtagatctttattttacacaacttttgcaacttgaaccacattaaactgagttaagatgaattagatatgaatttttaaagattaaatcggattaaaacctttaaactgattttaattgaattatgacgcaataatgaattatttttgaaaaggaaaagaaggattattgcgtccgcggctagggtttcggtggaccgggcgcacgggcggcggttcacgcgaacggacggccgagatcgaaccgatccaagatggacggccgagatcgatcgggtccacggcggctcacggcagacggggacgatgacgtcagcgatgacgtcaccaccggcggctcgggctcgcatgctcgccggcgaacgacggcgcggcgacgcgaacggagagcaccaggacgtagaggacgacgcggcgaactcaccggtgaccaaaacggcggcggaagaccaacggacggcggcggcgacgaggaggaagcggcgaagctcttcgggtcgacgacggcgacggcgctccg

SEQ ID NO: 44446 - DNA, 1454 bp, Oryza sativa
  unsure (1)..(1454): unsure at all n locations
nnnnnnnnnnnnnnnnnnnnnnnnnnnnnnnnnnnnnntattttttgtgctcttggaattgtaatgccaccgggcatgacagtgttgaccccggtaaagaaatcacaactacacaactacataattgattttcgtggacgaggccaacctccagcctctaggctgaccataacatcatccacttgcgataatatcgatcccgaaggaaaacaagatccacatgcaaaaaatcaattttctcatgcgagccaacttaataggccctccagcgaaaataacttatttcacaagcgggcctgttaagtggcatgcctatgccactagcccaccaggccgacgactgtcgacgtctgatatcgcgattccggtatttgcatagtatggggatcgttggtactagcatatatatatatgcgagactgaggtaaaagagacggagatgaggatttttatacaggttcgggcccctgaattatcaggtaatagccctacatcctgttggccgaagccggtcgttgctcttattcaccataatcaaactagtacaatatttggggtagcctatctaactattgtcgacatggcggtctgaaggtctaactcatagtcgacaacagggtagtctttctcctcgaatccgtgcccggcgatatcagagacagtgcattcgtctctcctgacagtatccggagacattgtaggggactagccgtgcttatccctgaagtcgatatccggcatcttgttttggcgtatgttggcttgtatgttatagcttctgttgttccgtagattatggtgggtgttgattgtgtcttcgtatcccctctcctcctagggggccatctatttatacccataggtgtccccttgtccaagtagaactagggaaaccaatatggatacaatccgagtagtccttgtcgtttccatgtagaactaactctggttgtctttccttatccggaactccctcgatgtcagtttccgtataagacatggtatgtggtggatcctgccgagatttagtcaactactattaggtatgtggtatccataaccctgacagtagcccccgacttcaatgcaaataaacgaattcatattctcaaccgcagaccctggagtaactgttgtcgtgctcacgtgaccattcttggtgagtaacgttagacttcccttatcagcctcgtgcgggcacctatagggtttgtctgagtcaatctccgatgtcaaccaagaaagtacagagcatacaactaagtctcatatcttgctgtaatcgagaatttggattgaagtcaagaaattttatcttggcgggtacaccatctcttcaatccgtattccttgtcgagatccaccaaccgttctcgagtgatcgagaaggtgtagaatatgcgatgaatccttgtcaacatttgtcgtactcgccttagtcgatcttggtgtag

SEQ ID NO: 44447 - DNA, 4678 bp, Oryza sativa
cgatattgtgtacctgatatcaactttgttggagtagaagtaatgggagtatcgctacacctctggttgaaagccagttgtagccccaactcgactacttgaagtaaaagtagtgggagaatcgctacaccactggtcgaggaccaggtagtagtcgtaactcaaccacataaagtggaaatagtgggagaatcgctacaccgctggtcgaggaccaggtagtagtctaaactcgaccacttaaagtggaaatagggggagaatcgctacaccgctggtcgaggaccaggtagtagtctaaactcgaccacttaaagtggaaatagtgggagaatcgctacatcgctggtcgaggaccaggtagtagtctaaactcaaccacttaaagtggagatagtgggagaattgctacaccgctggtcgaggactaggtagtagtcgtaactcgaccaccagaaataaggtgagagagatcactacgttctactggtttgagaactaggagtaggagtctcttaatcacctataggggcgctaaagttggtttattacatgtgcatctcatgtggccagcatgattcacataaccaacttatagcatatccggatgtccgctcgcaatcatgttggggatcaagccgacaacgtttgcgagaatttatccgttaacaaccttttctcgaatagcccagccatggtcggcgctatgagataggtcgtcggtcttcgttggcaggttaggtgcgataactccacatttgtcgagaatgttctcgataatggggtgtactcgaccacagcttactcgagtgctcaattgttcctgaaaaatattttctagaaggcaagacatatagcggataatatcgagtatgtactcaaaaaactgcatggatcttctagcattatcaggatataacgagcagattaaacatcaggcattatgtaaaccgtaaacaagcatgattcatacagaagagaacaaagtgagcccccagcgttagaccgtagttggcctaacatcggggacacttgcacaatagatattgtataaaaaacatgctctaggtaaacataataaattatagatctgataatgctgtatgatctgaataggtacgataaattgcatataacatattgcgtaccttcgtagatacatgccggatgtatctacgaaattagtagattaatttaaaaaaccaatctaccaattaccttgttgcgtactcgttcgacatcatacgttctgacatcttttggtacatcttaaggcttggtcgatctcaagagatcgagttgttgatgatgatggttccgatctcgtcgggagacatactctggtcgggttaaatctccccacagccgaagtcgtcgagtagtttgttttcggagaatccatctcttgaacccatctcgtcgaaaccctgaagcaccaaaatccccctacctggcgcgccactgtcgacgtttgatgtcgcgattctggtatttgcatagtatggggatcgttggtactaggatatatgcgagactgaggtaaaagagacggagacgaggatttttatataggttcgagcccctgaattgtcaggtaatagccctacatcctattggatggagccggtcgttgctcttattcaccataatcacaccagtacaatatttggggtagcctatctaactattgtcgacatggcggtctgaaggtctgactcgtagtcgacaacagggtattcttccttctcgaatccgtgcccggcgagatcagagacagcgccttcgtctctcctgacagtatccgagacactgtaggggactagccgtgcttatccctgaagtcgatatccggcattttgtcttggcgtatgttggcttgtatgttgtggcttctgttgttccatagattatggtgggtgttgattgtgtcttcgtatcccctctcctcctagggggccttgtatttatacccataggtgtccccttgtccaaatagaactaggaaaaccaatatgaatacaatccgatcgagtagtccttgtcgtttccatgtagaactctggttgtctttccttatccggaactccctcaaggtcagtttccgtataagacatggtatgtggtgggtcctgccgagatttagtaaactactattaggtatgtggtatccataacgctgacaacaacccactctcctctttcccttaaaaatatcttatcctctcctctcttctctcatcctctccgctcctcaccccaccccactccacctcctctccacttcacagtccgacgtcttctcctctcctcaccccacttacctcctctccacttcacaggccgacaaaggtggtggcggcagcatcgggcgctcggtaggtggcaaaggcggttgtgttgacggctacctcatgtgggaagaggagcggcgactgtggctttgttggcccgtccacgcatggatccggtgggccaggctcttcccctcgacatggatcccgccacctctcccgccccctccctcgtacatggatctggtggcacacatcaatggcagggaggggtggcgacgactacggcggctgcagtgactatgtctggggtgaatgggaagatccggcggactctccccttgacgtgcagatcctgctgactctcctccctcacgcatggatccggtggacatgggctctcctcctccacgccagcgtgcggatccgccaatggcagcaataggaggctggaaggatagggagggcatcggcaacgacgacggtcaccggatatggagtgatgatggcagcggccgctgagcaggggagctgcatccgcttcggaattttttctttggaattttttttcagaaaattctttttgccggcggatgtcctaacaagcccgcttgcgaaaattcctttttacacgcggtttgtgcttcttgtctgtgaaaattctgatttttacagacaccttggaggtaagtggtcgctacctccgcctacgaaatacattcttgctgtatgtaaaaactgttttttgtagttgtgaatagatggaaacaaggaatcatcatatgttcccgaatgtgggagttttgtttttgtgggagaggaaaaccgttggggaaaccttcacagctgcaaggagctcctggtgcaaggaatcactgggagaatgagtttagtttaatttactcgtacgctttggttacatcaatgttacattaaactatggttcccccatcgttgcacgagtctaattcatctttgaggtaccatgaatatatcgacaggttggcctaaatcatttcttttgtacaactttagtgaccgcccgttactttttattagagtgtcatacgacagcttagaattattccggtggaacctttttagaaaaaaaaatcgaagtctcaaataataggtcgattaattcaattgaaccaatggtcggatgttttattattttctcttagaatttctctgtttttttaaaaaaatatgttttttttaaaaaaacttaagaggtgatacgttcacgtggcagcttaggagcggtccgatggatatttaatttttatgactatttggatgatataaaaagggccagaatatagactagatggttttttttaatcaaaacatatataacatacatagttcttaaattgttcgtatagttgctaggaatagaattgttcagatgaattcgaaattgaactgaatacgtggtttagttgttattgttttttaaagtaaactagtaaggtagtccgcgtaatcgcgcgggcatgcatcctagactgtatttgaaaaacttatacaggtgaaatattaattaccgaaacttataaaagatcatttggtttgtctagattatttgtgcacatttagaaaaaataccttagtaattggaatattttctctaattaaaggcgattttttgatgcagtggctaggactattcatatttcagttagttattctacttttgtagtgtagtttaatttagctatacatgtttcaaaacatgtcacggtgtgacttgtgttgttgaatttttctttttcttttggcaaattgaatatgtaatttttatttctatactattgatttaatttagctatacatgtttgtagaaggattcataatgacataatatttgttgtcaaaattttaaggtatttagaagcgatgtaaagtgcacgagtggactgtgccccaatgctataattcttatatagcaaaatatgggcatatgtatcttacattgttagtttaattataaagagagaccaattagatagaaatcaactgtgtagcttataaaaaaactatagttgtttcaatatttattgtttatcttctagttcagtagctacaaaataaggaaggggatagtagtgtttttttgcatgtgagagggaggaggaggtggagggaatttatttttctaaataatttaagtgaaaaccgattataatgtttctttttttcctcaaaatttcttttattgtctttataacttttaagacatgacacatgttgacttaatgttttgcaacaatagatctaattgatgaaaataataaatccatcgagttaaaatgaattgtcttctaatttttaagacgtaatacattattactttgctctatgggatgtttaatcaatttttg

SEQ ID NO: 44448 - DNA, 6320 bp, Oryza sativa
cgtcacgttgtatcatatgagcatttatatgagcatcatgcggtggcttagaatcgtttataggaagtttaatggacatttaccgttgatatattttagcgacacatatttgttgaattatttaaggtgacataatatatgttatcaactattttataattaaaaaatatttcattgttatattttgttgccatgtaaagaatatggcccatagaagaatatggatcttgaattatttatttattaattataaataaaataataataaaaaaataagacatgtaactattgaaattggaagattagaaaagggaagagaatatgagaggagggagtacgtatcgtacggtactaattggaggagatgaacgtaccagaggaggggaggtggggactggtactgtggagagggggattttatttattttaattactaaatctaatggttaaaaatattggacccaccaattcaaaggaaaatcaacggttgcattttagagtgccacttgatggtttagaaacatttgtaggagcgacatatggtagtttagaagcgtgtgtagaaagtttaatggacttttagtatgcaataggtagatttattttgaataatcaactactacctctgtctcaaaatagtggtcgctttgacgtttgactaatcgtcttatttaaaaaattggtgtaaatataaaaaaagataagtcatacttaaaatgattttgataataaagcaaatcataaataaaataaacaataatcctataatttttaataagacaaatgttcaaaagttacaaacaaaaactcaaaacgataagtattttgggatggaggtagtaccgtacttatgcttacttaagagttaagactcgcgatggagctattagcaggcacgggatatcatggagggattaacttttttttccacaaatctaatataagggtgtaaaaataacaagtccacgggtaaaaagtgagggccaaatgtttcctttttctttagaatttctataaacattctataatagtttataatttattagagcatcacttaactacgttcaataataatagatatactattatcctatatcagtttttctacaagttttttacaatcatatttcggtataaatcgatgcatgttttttttttaataatgaccctttttcttatgtggcaagcaacagcagatgctcaaggggaactggggtttacttgtttgggacaaagcctatcgcggtttcatgatagttttctgaaccagctggaataagaagatagctagctatgtctgaaataagttgagctcaacatagcttgtttgattgtttcagtgtcaattagaaccaagtgcatactgggtgtgtttaagaagttgggagaagagaatattgagagatgcgcaaaagataaaccattaacacaaaattattgaatatattaattattttaaacttaaaaaaatagattaatatgattgtttttataaacactaatgcgcgaagaaaagagctatttcttaatcttttctagcagggacgattgcagctagtagcgcttggtggtagtatatatgtaaataattggctcgctttgcagtgttcatccaacgtggaggcgacgacgaagactcggggtcagtcgttgggcgtgtgggctgagtcagtcaacacaccattgaggagacaaatatccgggccgggttttcgttgctatttattaatcatttgtactattagaaaagctattcagctattcagcattcaatttaagttcattcgaccgaaaagaacagtactagttggaggccgtcagtcagcgaatattaatcattattactagatgtggatgcatgaactgcaaagaggaaaaaatggctcctcgatgatacccattaccaaatccgaaagcaatggatcaccaagtccgaaagcaacggacgaagggcctgtttggttcattgaatggttgctttactttgccaaactaaatcaaaattgaaacgaacgaagcttagtcaaaaatctggcagcatgctgttgtatttgtggtaccaaaatagtttgaccacacttatgatacatgtactccatctatcccattttgatcatccctaagatttttttaggtcttcccaaaatgaatatcatgtaatatgtgtctcttcatttatttgtgtaaaaagtaaatacgcatcattgaatgtgttgcatgcacctaactaggattaatttctattggtgcagtgacttgcaatatttaaaacattagcaatccacgggacacgaatcgatgaagcatattaaccgataagaattaatttgagaataatgaatatttggtgtcattggttttggtggatcgatggcagaggatgcggacccggatggatggagccttttggttaggagatgagtctatgcgacttaggatatagaagtagaaatgtttggcacagaaatgtttggcacaatacaagtgtggcatgtctagcattgcccacatttatatatatgttaataaatctaggcacacatatatgtttagattcattaacatatatgaatatgggcaatgctataaagtctatttcaatgtatgttttaaaatttataccgtaaattttaattattacggtcataataaattcttacatgtccactcagcttcatgctcgtgtagtatactactacgaaaaccatctttcatggtggccattttagcttttcgctggcggaatttggagccgccacaaagcaaaggccagtgaaggtctaagattttcgctggcggtttcgttccgcttgtgaaaatctacacacggttgcggtccgcttgtgaaaatcgattttcgcaagcggacaaacgatttttgctggcggttgagtgtcgcttgcgaaaacccattttctctggcggttacctaaagagaaccgccaatgaaaatcaacccaccccgccaaaaattccctaccccaaattcaaaattccccacccggccaaattcaaaacaatccatatttagaaattgacataaacatcattcaaacacaataatccagagcatcacaaatacgtacataatattggcatcaatccaaatacaacattgacatcatcaacagaacaaacacacagattaacctaacaaacatccttacaaaccaaaacacacaaaaacacacaaagagaaccaccgccgaagccatcgggacgagccaccgtcgctgccatctaccggtcgcggaaccaaaacacacaaaaacacgcttgccggcagcatcgcggtcatcgtcgtcaccacggttgcggtcgttgtcgtcagctccaccactggggatgaaccgctgctgtcgccgccatccgctgccgaggacgagccgccaccatccgacgccggggacgagccgccgccgcccgcgccgcgtgctccccgtgccaccaccggggcagatccacgcgtcctccccgccgccgcctctgttctgccgccggcggtggcctcctcccctcagacagatgggagaggaggcgatgggagggcaggggcggcgcggggagtcgccggtcgtcgccgccagagccgccgccgttgccgtcgctggtcgacgcccccagagccggcgccgatcgtcgccgctagagccgccacctccgtcgcaggtggagaggccgagagggaggagagagagaagaggagtggataagaagaggaggggatgtgtggtgttttaatgtggagaagatgatgaggatgggtaggtgggtgttttaatgtgacagatttttttggttggattttcactggtggttctgtttattgccctccatgaaaaattggaccgccagcgaaaattatctattttcgttgacggcgcacctaattgaccaccagcaaaaatagacatattttcgctagcggccacattagatgggccgccagtgaaaactcattttcactggtggtcagtgcccctcaccccctcgttacaagtttgctggctgttttcacattttttcgccagcgaaaataatagaccaacgctatgaaaaatcatttttctagtagtggtagtttgttcttcgttcctcatattttgcacattcaaccatgtttgttctcatgcactacactacataaacgatttttacaaaccgctaaaacacattttcacaaatggctagacgacctgccaagaggcgtttgcgaaaatagtattttatcaaatgggtggcacaactgcgtgcaaaatccgattttcacgggcggtcaagttaagccactcacctaaaaaaaacccacaaaattcaaaacctagcttcgattcaccctagccgcttccatcatcattgatccagtccgccgccgccgccgccgccatcatcgttgctgagaccccaccacactcaaggccagcggcggaggatccacccctccaagggtcagggctgctggatcgtcgcacccggagcactcgatgttgctaccgctttcatcacctcgcgtagcacctgacgctcctgccgccttcaccacctcctagagcgcatgccactgtcgcatccttcgccacctcctagagtggaggagaggagataaggctatgagggaggagaggaggggaaaggaggaggggagacaggagaggataggacttagactttttaagtgagagaagggtgggcagctgacctagtgggtccgccgacgaaaacatttttattttcatagacggacctattaagagacccacatacgaaaattgattttgcattcaggtcttgtcttccttgggaccaacattactgtagatggataatgtcacggttcacctgcaggcttagtagattcattataaaaacaattatatttttagacggagttagttctgatgaggacatcactccttcggacacacacaacaatccaccaccggtcattcaaggaccaattccaagagctcacgcgtgacaattgaatttagaggtgaatacgttcctatattcttctttgtatgattttgagaatagattgctacctaatgattatattatgattaggagtcacttagagagggacttagaggcgtggaggatcggcaaaggcgtccaagtcaagatggaggcccaaaccaagtcgacttcgagcacgtttcggagtccaggaccagtctgcactaaaacgggtgcccaggtcgcatacgtgctcggatttatacgttctttatatagatggaaaactaagaagaaaacctttccaatgtttctggtcccatgtccaaattctttccgagtcaacggaaatggaccgaacaaattaacgtccaaattctgttccagtgctgcgtcaccgtatttggacctttgagccgtgtatcgtgttggaacccattagggttgcgtcaagggttgtttgcacaaccctaaactctatatatcaatacccaccgtcacctttacagtttgggttttgcttagattattcagtcaagaactgtttcgcagctagatcggtttgtaagaccccaacttgtgagtttaatcattcatctgcaattttggttgtattcttccttgtttttgtttgtgttctttgatttgtaaacaggaattagccttctcagcgagatcaactacgtttcggcacggttgataactagaggtgacgtggtgctgcgattgtggggctcaagggcgtgttagttcagaagctggatctatttgtgtcgcgactccgcttaaatcaactgtttatcagaacctttcagaagattgggaactctggtccacattaagtaaacattagtaagatgtaatattctacgaggaaaggaaaacaaatatggatgtgatcaccacagtgaagacattaacgtagtgtagtattgacctgcgcgctgttttttattcgtgatttgttaatcatatatacttgctaaacatatataattagctgcagattaaacacgatctgaatgtaacatgctgttacctaatatatgtcgtgatacttccaagttgcaacagccagtaccttctttgagtggttaatgccgaagaggtacaaaaccatcacaccacacgtacgattggatttgtactgttaaatttaaacgtgaaaaactgaaaattatacttgggagttgttcaaagatctttgatacttcatccatccaaaataagttgatatagtacgggatatgacatattttagtcctacaaatctgatcaggtggaaacctccactgctgcacaaaccctttgtagccccggtttgcaacaacctttaatccctgatagcaaacggggctacg

SEQ ID NO: 44449 - DNA, 2566 bp, Oryza sativa
  unsure (1)..(2566): unsure at all n locations
ccaggacttaagatggtagcgccacgtggctggcgctaccatttttattcttttttcttttattgttttttttgctgcttgcatctcctgatttcaaccacacacgccgtcatacccaaatcccaagaaatcatccataaaccatacacaacaaaatcatccacaatacatgcccatccacaatccacaaatcaatcacaaaatcatccccaaatcaacaaatcattcacaaaataaaaaaaatccactggccgctggccacccggcctcccctcccgccagatctggtgaaggggaagctgccgcccgccgcctccgccgctgcccgccgcctttggggggagggggaggagatggggaagggggaaggggaggagaggggagggagagaagggggtgagaatgagaggggaggaggagggggaggagataagatcgaaggttgacgaggtgctcgatcgacgcgcggctcggactaaagatgccccggttgtatataccaaccgggactaaagataatgggggtctggcatgtttttgaaccgggactaaagatcaaaaagttgtactgggctttttaaccgggacaaaaaatgaggaaccggaactaatgcggtttttggctaacccgacaaagatggtttctccagtagtgctctccagatttatatagtactatgacatgtctcatcctttactatattaatttattttgggatgaaggaagaagttattaattaaccctactgaaaaaatgtcatcaatacagattgaaaaaagtcatctctaccggttgtagctacgaaccaaaaatatttttaatactcctatcatccttacataccacttcagtgttggatgtagacatgaacactcctaccatctttatcgctgtataatatgaagtctcacgtctcaaccactaggacctatcttttcaagtcaaatataatccttttcatgggggaattcgaacctgagatctctcccacgcgtgcacctatatttaccaacacgcctacaagcctattagaaaatgaatattgttttccttttaagccttcctaattgagatttgaatcatggatttgagtatgtaaaacaattcaaataaaaatattgtcaatgataaaattgtagttcttatcaagagctacaatttttatatacactttgtcgcagttcgagttcgtatgaaaaattaaagttcatatctaaaaccgacattaatatgactagggtcattagtatcaggtcataagaatacatcgccttttgatgtgagttgtattagtgtcgggccggtatcatgatatttcccgccaacaagcctacccatctccgattggcttgaaccaatactgattccttaatgataaaatttgctataggacattaaaaaacatgtaattagctgagagacaccgcaaaaatgtgtatttgctataagacatctttaaaaactggtaattagctgctggacacccgcggtattattttattattttcagaggaataggagagagaaaccatgtttaaaaacaagtttgccttggctcaaatgaatccaacgtgggccccacatgtgaccttaaatgtaagcccctctctctcccccccacgcagcgccgctttgaccagccggaacacgccggcggtggcaacaagtccagtaggctcttcgtcgtgtaatcaggtcccgcgctgcgacgtcgtgtggtgaagcggccgagcatgcggtggcggggcgaatggaggttgccgctagggcagaaatctttgacaatgcaggagttgtcctagccggcgttgaagtcgacaaacatggtgtgcaggaaagtgtggtcgagccagcgcaggacgcgcttctcctttgaggcgacagaggtagacgttcccgatgtccgcggctctgacgcagcggacgagggtgaagtcccacgggccgagtggcgcagcggcggcacagatgggcgcctagagaggtcggcggcgtcgtgcggatgtggctgggaggaggtgggcatggccgagtcgatagagaacatggaggagcggccagcgacactcggccgtccttgcctgcacgccgacatccgtccgtccttgcctgcgcgctggcatcacctcccctcctgctctggcgccacctctactgcgtcgtgctggtcccggcacttgcgcgcgaccgcaaagcgccaccccatccaaggcgccacaccggcccgcgcctcgtcgcgtggtcaccggcgctctccctccccgtcgggttcacttcaagaaagagcaaagagagaaagaatttgatagagagagaaaataataaggaagaaggagtagagaaggatagagaaaaacaaaaagaaaaaaaaatctaagggtagaaccgtacttacacagttgtttctctctccaatttctccggatataataaaataatctcacgggcgtccagcagctaattaccaggttttcatggtgtcctatagcaaatacacgtttttgtggtgtctcacagctaatatgttnnnnnnnnnnnnnnnnnnnnnnnnnnnnnnnnnnnnnn

SEQ ID NO: 44450 - DNA, 3605 bp, Oryza sativa
  unsure (1)..(3605): unsure at all n locations
nnnnnnnnnnnnnnnnnnnnnnnnnnnnnnnnnnnnnnnnnnnnnnnnnnnnnnnnnnncagaggccaaatcgagggaggcggcggggtaggtcctgccgtggaggtcgaatccccggaggggaacgagccggcgaggtgggattcggccggccgcatacacgcgcctccaagtcaaaccctcatctctcggttgctgcgaaatctctccaatgcgtctcataatctccgtcctgaccggctcctgagaaatggttgaaatccggtataaagtatggagaatttcagcattccaatctaatcctgcatgacgattctcatttctcaagtcgtacaatagaaattttggaaatgtgctagtcggagatgatttcacctgtgttacttgtattgcttgtagcagttatccctgcacataactctattgatggttaataagatataagctcttcttctagtttcaattacacagtcatgctattgatcttcctatgtactgttcctttgatgaatgatcagtatgtttggcttctttcagtccactttacaggaaaaagacttgatggcacttggtttgcatccaccagagaagatggtgtgcctctgacttttatattaggacaaggtataactgtacaccctgaatttaccttttagtaattgccgggttaataaatccataacacacacacacaccactcgatcagaaccaacggattcaaaactatgtaatgttcatggtactttctatttaaccaacctatggtattcttaatcttcttagatattgtaatggctgtgaaaccttgtgagttgtgatcacaaaacttatgattaaacaccagtatgccactaaccaggaatcttagggttttctacatccgtcgccacaaaaccattgattttgtgtaatttactcaaacagtactcccagaaactattatggaaaatgcatgtttagcacatgggccaagtataatttatttttttccttttagtttgtgataaatatttaaattgcttcacgaacttatttatattttttaatgagtaaatttcatagaactccacctattgtggtccaagttgcacaaaaccacaaggattttggcatttggcacataacttgtattatggttctaaagtttcataaaaccacactgttaaccaatttgacatattcctatatcaaattttataaaagctttacttatatcaacgtaatatgtattatattatagataaagaattcataaatttgggatgtgattgtagaactcaaaagtgtggtagatgaaagttaaaataatgaatagtgtggttttgaaaactttatgaccataatacctagggttacttgaaatttactcttttttaatccatcatgaaactgtcatgtatgtagttttattgatcttaatctgatcatctagtcatatattaattgttttctttatatggatttgttgatttctgtgttgtataaacttctccacggacctatatgatcaaacagcgggatttgtgtcaagactcttgttaaggactgaatcttttaaagcaaaagtgactgttaattatttggtgtctgacatttttgtttcaagccataaaagattctagtagaatgcagtagataactagattacatggctcatctttcatgtgtctttgtttttcaaaaaaatctggctccttgggtgtttgtactactgtaaccatacttttctcaaaaacgagccacactccaatgaaataaaactaaatgctgcttatagagaatgtgatgcgaggcttcagtatggctgttagctcaatgcaagcaggggagaaagctgtgttcaccatccctccagaattagcaggcaccaagtctcggtgtccagttgatatcccagggaatattgcccccaatgaagcactgcggtttgatattgagctcatctctcttgtcaccataactgacatcctcgatgatgaaggcatactgaaaaagatcatcaagcgtggactggggagcgataagccttgtgatttggatgaagcacttggtatgcaatactacattagttactccctgannnnnntgttttctttagttttgaatttgagaaattaattgtgccaatatttttccattatttcttcgatactgcaacagtgcccgtgctgtgagttcattgagctaatacttttacattttccttttccttttgtagtgaactacaatgcttgcctggaggatgggatgtcagtgtccatgtctgaaggtattgagttcaaccttgcggaaggtaagaatatttttcctttaccatgattgaatacacttaactatagaagtattattttactatgtcagtctaatagaattgtaaaatccaggcttcttttgtcctgcatttgcacgtgctgtggagactatgacagaaggagaggaagctgttctcattgttaaacctgaatgtaagctcccctccttgtatgtaaccttctagtagttgagtaaaattaacaatttgtgtcttctcatgcaacttatatcttgtaataaattcaatagtcaaagcagatagtggcaactaaatagtcaacaatcatcatctcaaatcttcctttctttgcgtgcatgcatgcattaggaatatttacaagcgtgtctttccatgtgtcattttttgaagaatacactcatcaattaatcttgtagttaatatgtattcgttggtgctctctttctcttgatccctagatggttttggtgaacggggtagaccatccataggggatgaagccggtgtgccacctgatgcaactctctatgtgtaccttcaattgatgtcatggaaaacagtgaggcacattggagagaatgggacaatcctcaagaaaaccctttgtagaggaaatttggaaggacagcagacagagaatgaagcagtggtcggaggtaccttcaagttagctcctaatctgaaattctgaagaacatatgtaggcatatagctcattacctcttgcttgcatatcaatattcctaatgttcgtttgcaatggcagttcgactgattggtaaactgcaagatggggctgtatttgatcagaggggccacgaaggagatgagccgttcaagttcatggttgacgaaggttgaatttctacaactcgactaactaaaacttgcttgtttctgataagtgtcagctattacttttgaaatgcagagcaggttagcgaaggcctagaggaagctgttcttacaatgcgggagggagaggtctccttgttcaccattcccccccatcgtgtgcaggatcaacttttggttgtccctgttggctcttccgtgacctacgaaatcgagcttgtctcagttgtaaatgtgcgtatatcacttgacttagttgccatgatgtgaaaaattctatattgttaatgcgtgtatgcagcttgagttagtttccatgatttgaaaatatagaaccaatcttttggaaactctacatgacatattggatctgaattaaatttaggacaagcctccccggctcatgagtcaagcagagaccatcgaagctgcagctgaaaaggaaaaggagggagac

SEQ ID NO: 44451 - DNA, 9221 bp, Oryza sativa
  unsure (1)..(9221): unsure at all n locations
nnnnnnnnnnnnnnnnnnnnnnnnnnnnnnnnnnnnnntgcatgccacaaatgttcagactgaatctgaaaatctgtttattttgtttgaaggccaggcagatcatactcctgcgctttggacgaggagaaacagatgaagaaattaaacaaatgttgatttcccttaccttcaaagctgctgagtgcgcgaatcagcttcaacgctatgaacaagcataccaccgctatcgtgaggtgcttctattaacaagagaatattcctttcccaaatgttacatggtccaattggcattcattgggcgctttttgccactgttaatcatacgctagcctcctgtacacacctatgagcttattttttacaatcaaaacagatattggagtatgaccctggaaatgtgaaagcacgggaaatgacagggcgggcattccctgaagcatctcttggaatagacactgccgcaatgcataggggcttggatcaggtacttttttttattgttgttgtatatcttttatacaaaccgctaaataatagaggactgctatataccggaatcccgttcataaacgggatgataccggttaggtatcagatcctgatacctaactggtatcatgcgattctaccacgtgttaggtgatacttgtgaggtatcagatgatacttattaggtatcatgcgattcttaccacgtagaaggtgatacctgtgagatatcaggtcctgatacctaaccggtatcgggtgatacttatcagatatcatgtgattctaccaggtattaggtgaaacttgcgaggtatcagatgatacctatcaggtatcatgcgattcttaccacgtagaaggtgacttgcgaggtatcaggtcctaatacctaaccggtatagggtgatacttataaggtatcatgcgattctaccacatatcaggtgatacttgcgaggtatcagatgatcctcgtcgtctccactgcaccgcatgcccattcctcccccctccccgcggtgctccaccaccagcaatgcatcggcaccccagtagcaggaggaaggatcccttggagtacaaggagtacatcgtcctcctgaggctgtggccggacgccgccaccgctggcatggacgacgacggcgcgcagcggagctagtacatgcccttcctccctggcaacaccaccgccggcggcaagccgcggctagttcgctcgtacaagcacgtcgttgacggcttcacagttgtcgctgtgtccaaggagcctgatttccgacgctgcttccaggacggcatcgcttgcttgcattgttggtttaagcaggaaggaggatggcaaccttgctggatccggccatggcgacaacgcgctgcgcgcggcggcgagagcacccgaggcggagctgcggcggatgcgtcggggcagcggcgttggcgacgcgccgcctgcgtggcggagatcggtgaggtgggaggacgcgagggatatgacggcgccgccattctctctccaatccaatcccttcatctcgtgctgcagggtggatgacacggtggacgaaaggggatcctgtcccgtcccgacgggatcctgttgtttagcatttctgaaataataacctttcggttaataatgttatcctcaaaacatacttttcgccgggccagcaaagacgccagtcgaaatcttattagagtaagtttaatagtatagccaactattagctccaaatcatctatagtcgatttaatagccaatccatacaatagttatctataaacatgttacactattaatatatggtcctgcctatcatatatacattgtgtcttggaatccgtgctgtagctggctacagatctatagcccactgctctcctctcctcttttatctcctcggtatgtgtttagatatgtgtttatagctggcttgtacctgctcttaagagagagagagagaaggggggggcaatagggtgttggcctgggtacaaacgtcgaccctccggcgacatgctagagctcaacaacacaaattttacaccaattggtggatcaatggaaaatatagccctcaaaacgcactgttatgctaaaatggggttgggcccttcagggcagaaacaggccacaccacagggttgggctcctaggttgagctagttgttcgaacggttttaaaaaacagaaatttgctgtcagcaaaacacttgagaggatggtatccatatatgcttacatctacttatcacctatcgtagccgtttgaccgaaagaagacatgctctttctcccatgtttcgtggcatgtctagtaggtttgtacgatgaaacgtttctctcctgactcctaacgttttttagcgatgaaacggttccctcccttatttagcccatatccaaagcccaatctcctgacgtgctggtctgctctctcgttggcacgcttgcatagccaaccaaagcactttctttctaattatatattaagcaattttagtcctaattgtatcttatatagtaattgtacttagcgctcatttatcatgtggcaggttaagcaaactactcatacatatatgttccttgcaccttggacagggatagcatcaaccctagttggaagtagattctaatggccacaatcagaattggatgcagacaaagttcatatatgaaccaatgtcaaacagggtttgcatatgtttagatacatagaatttctagagacaaacttaaagccaaagtatagtactgcttagcacattaattgatgtcacatgctgatgaagcagaacttgttcaaacattccactcttcagattagatagtaaatttagttcgatcagttagaaaaaatcatgagatagaaggtccaaaatatcttcttttcccttcagattagatagtaaatttagttagattgaatactaactgatagatcgtgctaacataatctcaagtatagatataatcctcaagttagatgcaaagaggttaattgggctttagggcccatgagcgctccggagtcctcactaccgtgtgtgcgtgcgccgtgcgttcgcattaggtttccctgccgtccgcgccgttgcgtttgatcgtacaaaaatcggaattaaaaatcgtatgcatagcattttcctatcggtatgtattattcaatggcgttgtccaatttatgatcgcacacaacgccactttggatttttcggattactctacaatttaaatacttatatttgttttggacgtgtggaagtttaagcagactgctcacatttttcttttcctttaggtgaactactacgtacatgcaactcaataaaatgttctttttgttttctgaacttgacgctttgaaatacttgtagctcaccatgtgattgaggtatgttccaaggacaggaactgccgaactgaaacgagcaatgctataacttcaatcaggcagtcattccatcagaagcattcaatgaaaagcccaaaatgatgatttttttttcttgtgcagccatttaggccgaaagaagagtttcgcgtgtgcggcggctacatgaccccggagttctctgagatgagactgaagcaagggcataaataccatggaagtataaatatttttgtccctcctatcccaagaccagagaccaatgcaaatcaagctgttccagctgctcctacaggccacaggctcacacacagccctactacacctccaggtccaaataatgagaaaagaaacagaagcagtcgtgttccagtcgctgccaggaaggggctagcttcttgcttcagatgcatctcttcagattgtaactgaagacatgttccctgaaagcaataaagaaaaaaaatcttgaccagcaacagggctgtactaacactagtttattttttttcgaactaataatttaacttaggtcgaaattaatgacgattctatggacacaacccaacggtggagatggcctgaagaatagaacgaaacacccaaaatttcatacatgaatatgttccctaggttcataaggaacaaatatttctgatgtaaaatcagtaaggaaattcagtgcaaaatactagtaggcgtctagttgcgtcaagaacataagaaaacgttgttttgggttggagagatgttcagcaaacccggttgaaagagatgctaagtagaggaagaggtagaaattaggcaaaattggttatatagcattgaaagttcacgcttttaggccccctttgaatcgcagggtagaaaaaacggaggaataggaaaaacacatgattctgacaggaattgaagtgtaaaacagaggattgcaaaacacaggaaaaatacaggaattgtcgtttgattggagcgcaggaaaaacacaggaatcggatgagagagatagactcaaaggaaattttccaagaggttggagctcttgctaaatttcctccaaaatctacatgcaatgtgccattccataggaatttcataggatttggaaagcttcaatcctttgaatcaaagggccaaatagaaaattttcctatatgatttgaatcctatgaaattcctacataaatcctttgattcaaaggaggccttaagtttatagcaccgaaagataccggttcactttaataacacctaaagttcaccctgttcccatgcatttttaacgcttccgtcaattctcggtcgtgcctttgtgcctggaatttttgagaatgtttcctagtgtttttgtgcctgctctcagtttgtgctagtacctggtcctggccagtcttttactcttttagtctctcgcttgatttgttttgattttcctaactaaaacaacattcttctaggtacggaggaagtactatttctatgttctcaagtgtttaactgatagccaaagatttaaaaggtttatccaaaatccagaggcagtgtttggttaaagggatagggaaatgatttcccacccaccaaaagacatatttaaatcctaaccattcattctcccttttccatttaattctaacccttcattcatttcccaatctcaatcccactcctcatttcccattatccaaacacacccaaagagtactcacaagttacaaatcttttatgtaactagcgaggaggatggggcgcgacgttgtggggcggcgcgagcgcggcgtgggtggggggcaccgatattttttcactaattgcggatcgcgatccggaggagtcgtgcgatggtggcgcggaggaggagcacgatcctgcagcgtccggcgataacccgtcccgcgcgatctgttgctagcgcggtggaacagccgttggtagggagaagagggatgcgggagcaggtggtgggggcaccgtgggaggagccacccaatgacgacgacctagagccgacggcgacgtggagtaggcgtcggcgacgggggcagccagggaggaggaggagtaggcgtcggcggcggggaggaggaggagtaggagtcggcctggcagggggatctggagtgggctcgacgggaggggattcggcgttggttgcgggtgggtggaggattcagcgtcggtggtgggtgggcggaggagtaggcgttggtggtgggtgatggggaggaggaggacacggcggcggtggacagaacggcgcgaccggtgttggggacagtgtctagggttttggagtccgccgcgaggagtcctccctgcgccagcggtggtttgacggaggcggtggcagtggggactggatggagtgggggaatggggtggagggaacgggcgacgaagcgggcacctcccagcgctggcgacgacgacagcgactgcggatgccctccccgcgccagcagaggagattagcaacgtcgtcggttggatcggaagccggagtgcgccacgcagagtccttgcgccagcggcgggggactggacgacgtgggggaatggggcagggagcggcggagacgagcggtgtcaacatttgtggtgtagggggtgcggcggagacgagcgcgtcggtggttggtgatgggggcgaggtaggaggagcgatggagtgatgggggcagacgcataggaggggagcgcgtgggatatcggaagcgttggatctcacgatcctacgcttagtattacgtgtgtatgtcagggtgagtcactgccaccactatggactttttaagtagtactccctctgttttagcttataagacgttttgattttggtcaaagtcaaattatttcatgtttgactaagtttatagataaatatactaatatttataatagtatattagtttcatcgaatcaataattgaatatattttcataataaatttactccctccgtcccctaatataagggatttttttattttgcttgcactttttgaccatttattttattaaaaaaattttggaattattatttattttatttgtgacttactttattatcaaagtaatttaagcacaactttttattttttatatttgcacaaattttttaaataagatgagtggtcaaataatgcaagcaaaatatcaaaatatcttatattagaggacggatgtagtaatacttttctctacgaacttaatcaaaattaaagcagtttgactttaaccatagtcaaaatgtcttataccctgaaacaatgggagtagagattttacaactctcaactgtgtgattgtgcttaattaccaaattcaccttttttcaatggaaacatggtgaagtaggtctgcataactgcgagcacgacggcgactgcggcggcgacgaaggagatggccgaccacgggctggcgaagtagtcgcgccggagcgccgccgtcttcctccgccaccatgtcccgcagtagcggtccacgtccttgtagagcccgacgaaggcgtggctgtcgtggttgacggcgccacagtcgccgaggtggttgaagaaccgggcggcatcgtcgtcgttggccagcatgttctccagcacgccgcgccggcggagcagcgcgacgtcgcgcgccgtgacgatgagctggcccatcagcgccacgtagctgctgaggaggatggcctcgtcgttgcccaggctctgctcgaacgcgatcaggttcgcgagcagcggcgtcttcgcgtcgtcgatcaatatggtgggtatctccatgacgcccctaagggagtcgaacaccacgtcgtagccgttgtctgagttccgccgcacggcgaaagtcaccccggcttcgctcatctcgacggcgcacggtagcactcgcggcgccgtggtactctgttcttgctgcggcgtccgctggctctggggcacgaagctctcgtagtacaggtgtaggatgtgattgacctgcccgttcggccatctgattggaacttgacggccggcgatgtactgaaggagaagctggaggaggttatttccggcctggccatcctgttcgccaaaggcggtaacatataacttcttgaggacgaagaacgggagctgattctccataaggagcaaatcggagatgacgaacgtgaggccccaaccaacgtcgcatagcacatcgggctgatttctgcgccacttacggaagaactcgaggatgaagcatccgtccaggaggagcatctggacgaagtcgtcggagctgaggtcgacgggttgctcgctgtagcaggcgcgcgcctcggcctcgagagaccgcatcttctcaaccaaggcggatgcggagagtccggagacaaggggtggaagtggaacgcgatggttgggttccggcggtccttgcggagacagcaggtcgtggaggtagcgccacttgtggtcctccatggcgcggagcgcggcggcgccgtggtagtaggggccgatggacaccaagcgcggctcgtaggaggtccggctgctctcgcgaagaaaggcggggacgcggaagatggtgaacgtctgattcgttctcgattggactcctcttagaacactcaaccttgcctccaccatatcttccaaccgcgccatgcttgcaactcactgggagaaatacaacagctttctcctaaaatataaagtcactggtacttagcttgatgttaatacttatttcgttagttgagatttatagcactaggtgatatctaattaaatactatgttgctagtacattttaggatggacaaaagtttgtttagtttcataatcagaaatgaagttaatctatctattaacttatcaaaggaatagaaaaagaaccctccacgttcgctctcatagcctagaaattctcacattaatcggagaaaaagaaaaaatagagtccatatagaaatacaatttaaaaatagtttaaattcggaattagaaaataagaaatattaaaaaagagactgaggccatataggaatacaatataaagctaattaaaattcagaataaaaaaaggaaaacatagtctatacatgaatacaatttagaaataatggaaattcgaaatcggaattagaaaataaggaatattggaagaggagactagagtctatataggaatacaatttaaagctaactaaaatttggaataaaaaaagaaaacatagtccatatacgaatacaatttagaaataatggaaattcgaaattaaagataaggaatattgaaagttaagtttagagtacatatagaaatacatataaaatttacatataattgaaattcggaattaaaaaataagaaaaattaaaagtagaatttagaatccatatagaaatacaacttagaaaaaactaaaattcgaaatttaaaaataaaaaatattagaaaaagagtctaaagtccatatataaatacaattcggaaataactgaaattcaaaattaaaaagaaagaaatatcgaaagatgagtttagagtccatataataaaaatacaatttataaataagagaaattaggaattaaaaataagaaatattaaaaaaggagagtagagtttatatagaaacacaatttagaagtaactgaaattcgagatattaaaataaggaatatggaaagaagggtttagagtccatattgaaataaatttgtaaataacatgacttcggaaaatataagaaatattagaagataagtttatagtctatataggaatagaatttagaattaactaaagttagaattttaaataattaataaatatcacgtatacaaaatacaatat

SEQ ID NO: 44452 - DNA, 2800 bp, Oryza sativa
ctaaaattcgaaatttaaaaataaaaaatattagaaaaagagtctaaagtccatatataaatacaattcggaaataactgaaattcaaaattaaaaagaaagaaatatcgaaagatgagtttagagtccatataataaaaatacaatttataaataagagaaattaggaattaaaaataagaaatattaaaaaaggagagtagagtttatatagaaacacaatttagaagtaactgaaattcgagatattaaaataaggaatatggaaagaagggtttagagtccatattgaaataaatttgtaaataacatgacttcggaaaatataagaaatattagaagataagtttatagtctatataggaatagaatttagaattaactaaagttagaattttaaataattaataaatatcacgtatacaaaatacaatatgaatattacacatcagtttggtcaagtcagtacaaaattaaaaattatgttatcattttaatatattttaataacaaagtataaaaatatatatgctattatttaaaaagatataacgatactagccgcgcaatctatgtgggccaccatgctagttgtaacgaagacactagtatcatgtgcatgaagaaattggatggggagacttcgtgataagggagcaagtggctaacccataaatccatttgtaaattaaaatatgctataattttacttatgttgatttataatgggttcacgtgttaaccacttatacccctacttcccgattttcattcagtttagctgttgaggtaaggctgtttatgcctcgctttcgcgtgattgccagggatgaagtagtccacttcactggtgtccactaattttagtaccttgcgtatgataaaatttgcatttatgggttatttaatcttattcaacattactatatattcataaaataattattttattatcgaaacaaacatggaggtaaaaactattattttattattgtagagatgttcgacggaggagtcgtgaccaccacgggctaaattcacgtgtttgtagttacgtacacatggatattggaagctcattgatttatcaccaaatatacgtaataactttaagctttgcgtgcattaagagggccgtacttgtgggtatgtatatacagtgtgcatcttccaagtatataatgaagaaaaagaataggatcgagcatatcgatgcaagtatcttccacagagaccacgtaccattcacgtagagtaaactagctaggtggacggcacttatataaaattatctatttttacacatatttttttttaaaaaaaatattaaatagacatatcgttgtcttatattttaaaaacaaaccttatcagcatcgggttttttatttttataatttttaaaagtcacactggtcaccacccatccctttatttgcttgtccagtcagtctatcacggcttcttttcatcttcattaaaatctataaaattcgtcggacattaaaatatatttttgtctcgaccggcgaattttatagataaaatcaaaccttatatttttgggttaattggatctatgccattgcaaatttgcctcgttagaaaataccattacaattcgtctattcgtagccatgccgctagaattttatagaattataaccacgccatcaccatcacatttttcatcgttttctccatctatacatggggcctacctgtcagaatcatcttcatcctccatcctcccctattttcttttttcctcatctctctccattgcgcagcatcttcctcctcgtcccacacctccgaggactatgacgacaaggcgttgaccggagcagagccgatccggcgacgggtggttgcttcctcctcggcggatgccgctgccgtcggtgcccctgcacgatggaggcgagctcgacatcgacatcgtcctcccctaggtcatcgcaccgtcgcccttctccgctccggcaggtagcagcaagcaccttatcgtccatctcctcgtcaccgagggggaggggggcggccctcgacacctcgtgtctcctggacttcccgccgctggccagcccctcggcggccgcacgctgcgagcaccccgtcgaggccggcagcaccccatggccgacccccaacctgctccggcttcgtcgtcgacgccgcactgccatgaagggatctgggccacctctgcatgcgtcctcgccggctccgcctcaccacagccaatccgtggaccccgcctcggccaaccatcgtcactcggcgtcggacctcgtttcctaccaccaccggcgggtggcccgacctccagatccacgccgccctgcttcccctcctcgatgaagcgccggatccgcgatttctccttcccgtcccgtcatcggcgcggaagaggatacagagggacccatctccgtcggctactcctccgcctatgctgccgccgcctagatatcttgtggccaccgccgccgcctatgcccaccacaatgccgggagctagagtctgttccgccgccctcgcctccaccagaaccgccaccgcctaatgttcgttgcaaggaagaagacgcgagaagaaggaagaagacggaaaaaggaatgagttgatggaaaatgtgacggcaatggcacggttctaattttgtaaaatttcaatggtatagctataaatagacaaattgtaatggcatttttctgataggcaaatttgcaatggcatgatccaattaaccctatattttttgtgctcttggaattgtaatgccaccgggcatga

SEQ ID NO: 44453 - DNA, 892 bp, Oryza sativa
cataatgttcgttgcaaggaagaatacgcgagaagaaggaagaagacggaaaaaggaatgagttgatggaaaatgtgacggcaatggcacggttctaattttgtaaaatttcaatggtatagctataaatagacaaattgtaatggcatttttctgataggcaaatttgcaatggcatgatccaattaaccctatattttttgtgctcttggaattgtaatgccaccgggcatgacagtgttgaccccggtaaagaaatcacaactacacaactacataattgattttcgtggacgaggccaacctccagcctctaggctgaccataacatcatccacttgcgataatatcgatcccgaaggaaaacaagatccacatgcaaaaaatcaattttctcatgcgagccaacttaataggccctccagcgaaaataacttatttcacaagcgggcctgttaagtggcatgcctatgccactagcccaccaggccgacgactgtcgacgtctgatatcgcgattccggtatttgcatagtatggggatcgttggtactagcatatatatatatgcgagactgaggtaaaagagacggagatgaggatttttatacaggttcgggcccctgaattatcaggtaatagccctacatcctgttggccgaagccggtcgttgctcttattcaccataatcaaactagtacaatatttggggtagcctatctaactattgtcgacatggcggtctgaaggtctaactcatagtcgacaacagggtagtctttctcctcgaatccgtgcccggcgatatcagagacagtgcattcgtctctcctgacagtatccggagacattgcaggggactagccgtgcttatccctgaagtcgatatcc

SEQ ID NO: 44454 - DNA, 955 bp, Oryza sativa
  unsure (1)..(955): unsure at all n locations
nnnnnnnnnnnnnnnnnnnnnnnnnnnnnnnnnnnnnnnnnnnnnnnnnnnnnnnntgtacatctttacccagaagacacatctttactccgcattccatggccttggaacccgtcgtaaagatgtgacatagtttccaacccatcctagccttagacaagagtaccgacccaatcccacctacggccgggatacccgggacaggcaggcagaactgagcccctagcagcagggcaccaaccctctgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccataactggcatgcacccaaaccccaccgaaaacaggttttaggggttttgaaagaggaagagaggtgtatgtccaattccaccataatccaatcaattccaaagtgtccaaatgatatgagaattcccaaagtctaaagttataaaaccacctaatgttgcctaattaatcagcgaagcatctacctaaattcatactagtggaaccataaatagagtactcactagttggggttttgtttaacctagggtgaacaaagtaataatatcaataacaagaataataaggtcataacaaaggtaagtaggtatggctagataaaacagtgataacgcgggaatttaaataaagcggtaatgcaataatttaaatcaacataattttacaaactgggattcaatatgttcaaggatgatgtgacttgccttgctcgctttcccaaacgtcggcttaactttcacgaaaaacggatctttcgaagctgc

SEQ ID NO: 44455 - DNA, 11047 bp, Oryza sativa
actgaaaaattattaaccaataattcttacaagcacactgaaaattaatcaggcttatgagctcctctaatcccctacagctacaagctactgatcgaatcgaactaggggtggtgattcttttggttcccattcgattcgaattcgtttcagtagaaccagttggatccggcgtacttcgccggcggttgctgcatggcgccgccgtagtccacggcgccccctcctgtcacgttgaaatttgaactgaacctgaactccggcgccgccgccgccgtggcggcgacgtcgcctccgaacggcgcgtcgtcgcggatgaagaaattagcctgctgctgctgatggtggtggtggtgcatctgcgtggcggcggcgacgtcgttgtcgtacatggtcatcagcccggcgaggcatctctggccgtcgacggggaggtcgaagtcgaagctgccgagtggctcgaagatgtgcggcggcggcggcttgctctcggcggcggcggcggcggcgttgtgcttgcaggcgtactgatgggcgttgcgttcgttgcggtcgaggaagccgagcgcgtagttgctgtgcgggcactgcacgttgccgcaggtgtagacgcgggcatggctgtcgctgctcagcatcagctccggctcgctcctcttctggatgaagtcgacgtcgatggcctcttccttcatcagcggcatgatcaggaacttgttgttgctcagagcagcatccatggtggtggtgaggtccatgaacgcggtcgcgtcgttctgcgccttctgcaggttgttgttcccggcctcgtcgccgtcgactccttcgacgtcgtactcgccggagacgctggcgttgaaggacgcggcggagagcggcggggggagggcgccgggatggagcttgagatagaggtcctcctcctgcttgaggacggcgagccaggtgacgatctccttggcggtcatcttgtcctggaggcacttggactgacgcacgaggcggcggaccttgtcgacgtcgggggacatgtgcttgatgacggcggtgagcacggcgaccttccacgccttcttgaggtcgtgcggcttcttgtacggcggcgggccgagctccttgggcacgccggcctcgggccaccacgcctcgctcccctccggccaccacggcggcggcacgcccttctccagcgggaagcggcgctgcggcgggtcgcagtgctgcatgagcgccgagagcagcgatcccagcgtggtgtcctgcagctcgtgcagggagtgcggccccgccggcgcggcgccgccggcgtcgccgtcgcaccccggcacggcgttgtcggcctggtacttggcgatggcggccgggccattgcggtcgaagcggaccttctccttccaccatgagcggaggttgtcggaggcgccgctcaccggcttccccttctccgggatgatgccgtacacgaacccctgcgcgttgcacacctccatcatcttgagcatgtacttgaggatcccgtcctgcgcccgcgacatcttcttccgccgcgcctgctcctgcgactgccgctgctgcctgcctccgccgccggcgtcgcccgcccggctctccctcccggcgcggctctgctgaagctccttgagccgcttgtgccggacgcggtcgcgccacatgcggcgctccagctcctcgatgtcgtccacgtcgtcgtcgtcgtcgtcgtcgtcgtcgccgtcgctctcgtcctcggcggcgaatccgccctcgtgcacctgctgctgctgcggcggcggcggcgccgggttgaccaggtcgccctcgccgacgaagcactcgcctccgaagaatccaaaggcggccttgctatcaacgtcggcctccgccgcgaacgccatgcgccgatccaccatggtcaccgctgctcccatcatctcctcgatcgtagcacagactgacttaatagcagcagcagagcagtagctatctatagatccacctgcacgtaagccgacctcgaattagttttttttccccatagtaattactttgctgatcaatgatcataagcttttggtaactcaaatgatgatttcattaacaaagagaaatggtttagcagaagtgaaaacaagctagaacatgcgcccatgtgccaaatgatgaacaaaggatcatcaaaggccatcatcaagtaagaagacaaaaataaaataataatcgggccgtatacagacacgcatcaaaatcagggaactcaaaatggaatctttattgaatgaatcctaggagcatggaacacacacatacctctctctgactctctctatgcccttatctgatctccttctgattactctaccactctttccataagcttggcactcagctagtagaaagagaagaagagagagtgcctttgtgtgtgtggactggagaagaagaaggacgacaacaacaataaggagaagttaaaaaggataagaagagaggagaggagaggagacgatgctgccagccacgagtccactgtaggaggaggaggaagaaaggaggaaagaagcaagtaggggcgggcgacgacgaaccgagcgagaggtgctgggaaacaacagcgacaactaccatttataatgccctcttgactaacgcctttgcccaaattcaatccaggaaaatgcagtactacggtttttaataccacgtgttgagtggtatctctcctcgtgcgccgatgaacaattgtactaccaaaccaaggcggcttctttcgctcaaaaacaaacaatttgccttgcaatacacaatactgctgcgtacactccgtcagtgaccaagcaaatttaccagcatgatgcttgtaaaacatggttcaagctctgaaaaacagtttttttaattaaaaaaaagctccgaaaaacaattgcggagttctgaacttttttgttgcaaaagggaacacactgttcatcggctttaggggtggttcctagttcctgctggaaattaaaagcacaataattagacaaggtaccttcatttgctacgtggcgaactctgtgctaatggccaaaaggaccaacacaatcagggccctaccataccacccacaccacatgtagtagcagcagcagtttacaagaggcctgcaaattctgttggggagaggtagctaggtctcctccgtctccatggagatggagaccacatatttactcattagccttatcgcacagctattgttttggttggttcctctaactctgagattaatttcaggatttcaggccccatgtaaaggctggctggaccatcatgcccatcttcttcttcacttgtgtcattctccctaccatttctccatgtttatctgtaggtgtcggcaggtttggccagcttgctctctctaacttcatctgcaaattaaaacccagcaccttgatagcgatccacgcgtttactaaaggatcgttgaaagacacctctttcatctgcgctgctcttaattcatgctgttgtatattcattctgaaaaatgttgtgttgctgtgctgtagtcagtaacagactaacagtaacacgcctcatgcacattcaattttggagaggtcaagttgtaacataaagaatgaattctcaggatcagatttcagaagacagtgaatgagagagagagattttgcaccatgtttatgcctgatgctttgattgacaacaaaagcaagtcaactgtattagcaacttgcaagcgtggagagtagtactagtatatcgaatgctgctgggtcgaccatgtttccggtagcagtggcaatgattggcccaagtattctagagagttttattcagttatcgacatctcctccccaatcctttgatctgatacaccacgttgtacgcaatgtttgccaacttatttaatccagtttgatagttctatttcaggtcgttatcgctgttagtttattttgcttctttcttcaagtctccaataggagggatcactacatttgcaaatgccgactgaattttttgaaagatcgccgactgaatttattaacttttttttttctgaaggtcagtaaacttggtgtgacaatttcttgccaaatttcggcacaaaaacaagatgattcatactagtactaagaaaacaagatgacttgctttaactttgtgaagcacatgccatctctccaaaacccaaagtgaacaggttctctgaacaacgaacaggtagcagaatagctcgcggtgttgcatgtgtaggatgtcgcacgcagcagcaaagttttacaagagttgcagataattgacgatgacaaggatgtgctccctcctcatcaggcaaggatctccttggatcatctcgaatctagatagatactcaggaagatctcaggagcaaatctcgtcgtcaatggtgttcagttcactgaacagggctgtagaaacctgcaatgatctgaacattggagttccaagtcattgcttggacttgtgtgcaatcatttgtccatgttcagatcactttgggcgatggtctttctgaatgacttcagaaatctaactctatatcacttatatagcatgaaacatatgcgtagtttgcttagaattttttttgtcaaagtttatgaacttttgaatcttgagttcgttgtgtcttatatcactttcataaattctgaaatttaaaatgcctaaaaaatttttgagcacatctctgttactcaaagcacttgaaaatgttatactgccacatcatctatatatccaaatcagtttcagcttaagcaagcattggcaactgtgaaaattctcattttattcctccatattctgaacatgtttgacttcgaatttcagtaggatgccggaaacccatatttcgcacgctcttgattttttgggggattttttcgtggtgatttagtgggtaaaaatggggaaaggttggtcagggaagagaactccgaccccctaatgagtccgaataaagctgaccgagtgaccggttacctccttccgttgaagaattttgagcacatctctgttacttgaaaaatgctacactaccgcacagtctatatccaaatcagctgcagcttcagaaaactccgaaccccctgataagcaatgcaaaacctgtaacttaagcaaaagcattggcaactgtaaaatttctcattttatgtttccatcttctgaacgcgtttgacttcgaatttcagttggatactggaaagccgtaccccgcgtatccttaacatttttaggggaatttttcgcggattaaaacggggaaagatttgggggtcggagaagaaaacaccgaacccaaccccaaaaggagtccgaataaagcggagcagtcaacgccagcggcccgtcatctccttccgctgaaaagtcaaatcagtcttcgcctacgcagactcccgtcgcgctcactgccatgtgggcccaaccgccaacaaaacccggctccgccttccgaggcgagcacggtcgtcgtctacggcgccggcggcagtccagcggcggcgcacggagtcacgatgccggtcgtcgtcgagacgagattgtgcctgcagtcaagatcgcaggcgacagtacaagaagacctaacgcaacgtcttgtggttaaaaaaaaaagcctacaatgctgtttaattagggtttagtccattcagtcatccaccgaaccctgcaaccccaagcgcctccgcttccctccttttttgtcgctgggccggcgggggcacgccggccaaatattttaagcaaaatccggcggccggcgcctcctctcacgcggttatctatccaaagctgaaggtgcgatggccgccgccgccgccgccgcgagctactcatctacttcttggagagtccgacccggcctaaccccatttcgctcccctctccagccacacccgcagggacgactccagcggatagccatcttcgccacccgcatccgcatcgcaacaccctcggcggcgatgcagtcgtcctcaacgcggcacaggttgcgccccctccccccatttcgttactctgataggtctgcttcactgtaaaatgctgtattcctgtccatgctatacatgtctgaaagtctgaaattatcctgagtgcatgtctgaaagtctgaatttatcctgagtgcagagcatttcataggttgcatgtttttctaagtatttattagctactcacccaaaaccctcatgttgttttcaacataagcaggtagaaacctccttgttcaagtaaataactatattcagtactctatatgtcgagatatggataagaggggcagttagggcctgtttagattcatactatcattttaaaccatatcattgtttggtaaaatcaacaaatgtatggcggtgtttactttgttatcaaatattggtcatgtctaaagaatttgacaatatcatatttaatctatattttagcaatgctaaattttggaaaggttgaaaatagctataaagtgaacaagcccttagtatattgttccacggcaataaaagctattgcctgtttattcctttctgctgcctggttggggtaatgcatagatgatatctataaatactctttattcctactatattcaaagaaattggcacacctggtgccggttcgtttccccaaaaaatagtaagctggttaggtgcaacagttagtctgaacttcttcttctttttttaggatcagctactctaaacttttgaagaaccgtattttgttagtttagcagcattcagtttaaccattccgctctcatgagacgtcaagttactcataaaaatcatagagtttttgcatttttctttctgcaccaagaacaccaccctgcgccaccagtacttttcagcacaaaagagattatagtcatttttactattttatccaatgcaacagaactcacactgtttgttccacaggcttgaggcagtgaatcatgaccatgaaacaatacctgaaaggtattactatacatacaaaaaataggcacttttagtcctcaatgaacaggatactaaatttttgcctgtccgatttaggcttgcagtagtcactggtggaaacagagggattggcctagaagtgtgccgccagcttgccctccaaggtgtgacagtcattctgacagcaagagacgagaaaagggggaaagatgctgttgagtccctttgccatgaatctaacctctccaacataatcttccatcaacttgatatcctagatggtaacagtcgtgcctcattggcccgatacatcaacagtagatttggaaagcttgacatcttggtaaaaatacagctgtttccttctctttactacaaagtctaaccaatctgtttctacaagaacgaacatatactgaagatcgcgtgagaaatgcaggtgaacaatgcaggtgttggaggggttgcagtagaccaggatggcctgagagctctcaacattgatcccagggtttgggtatgtagatttatgttagctttttactttctctggattgataatacttattgttttggacaaagctattttcaaactttaaaaactttaactataaataacatctaaaatatttattgtagaaatatggtgaccatatgtatagattggtcttaaaaggtgctccaataaaatcatatatttattgatattatatatatatatatatattataataaaaaatagtggttaaagttgttttttgcataccgtgtctttgttcaaaacaacaagtattatcagccagtaggaagtagcatatttgcatagcttcaaatgcctcccctattttgttctctaatttttcccttggatgatatggccccttacagttgtcagtagttttagtgtcagatatccttgcgttattttggtgcgtagtgttcattgcgaactttgaacactggtgtctattcaattaaaaattctctttttgatgcacaaatgaatagtcagcagcaaccatctcaaccactaaaaaatgtgtttgcaattcagctatccggcaaagcagtcaatctgatccaatcagtaattgtacaaacatacgacgaggcagtaaaatgcctcaacaccaactattatggattgaaatggataacagaagctctcctgccgctactgaaacaatcgccgtcaggagcaagaattgttaacaccacctctcttcggtcagagttgaaggtacaaattctttctattaaaaaaaagggtacttctgtgcttcaactagcttacctaacaacatgatagttcctgtgccaaacttgccacagagaattcccaatgagaagctccgcgacgagctgcgcaacatcgacatctgggacgaagcacggatagaagcgatgctgaacgagttcttgcttgacctgaagaacgaacggcttgaggaggcaggatggccaacaatgctgccggcttacagcatgtccaagaccgtcgtcaacctctacaccaggatcctggccaagaggcacccggagatgcgcatcaactgcgttcaccctggatttgtcaacacggagatcaactggaatacagggatcatccctcctgaagaaggcgcgagaggtgcggtcaaggcagctctgctccctcaggatggaccaaccggttgctactttgatcaaacagagttgggtgaagcttggtagtaaaatatagcattataaaattattaagcatgtttaataatcatccttccatgctagcttagcgatcagagctgtgtaaacatataccactacatgattcatggatgtttcacagactaaatttgttatgcaaggatgcttaataatcaaccacttttgaatcgttttgcatggatgttcagagatgctcagggagtggggaacgttgatgatgtcatttttttagaagggtattcttttactctggatatatacaatctttttaaattagaaacttagcctattaaaacttagccctcaaataatccaatccgaatattcgatcttatagagatttgaactcaagatcttaaaatgctactcagaaaacttcaatcactagtctccgtaccctttcatggtaatgctggcatatgctactcgtcttctcggagataaggggcacacttggccctgggcgtgaccaaaatcctatcaaacgtgacacgttgcaatacgtgtccaccctctaagggacgtgtcgcctagccgtcgcacgtacaggtttatatatgttcatcatcagaggcgctaccctacgacgaacaggaaaccaccaatttagcagtgcagtgcgcgatcatgtcgtcgacgcaggagaagcgaggcgagcagatggcgcgcgcgcgggaggcggcgcgcgagatcacgcccgaaggcaccgagcgcgcgcgcgtggtcggcgaggaggaggccggccccgagcaccaccgcgccggcatcctggaggcggcgcagcggggcgcctggtccctcgtgagcgccgtcggccgcacgctcggcgtcgtgagggacaccgccgcccagaccaagcccagcgagtacggcgacgcggcggaagcgaaggacacccccgtggagaaggcaagggagacgaaggacgcatccaagcagcagaacgaggagctgaaggcgacggacagcgttgcaggcgagcgtggaggcgacgcggcaacaagcggacgcgggcaggtggcagggaaggaggaagactagtacggcccgcccatgtgatccgtcttgggccaagtcggcccagaaacgttgacctaattattagacttggaataagtacactttgggtccctctatttgttgcccagtccgattttcgtcccttgaccgcaaaaccgggtatgacccagcccccaacttaagaaaaccgggtaaacgtggttcctcggcgttttgaaggcagtttggctgacgtggcgcctacatagcttatttgacttggtcttcgtcccatgtggcattgatgtggcgcttacgtggcaattatatctcgggaaaataataaaaaacgtggccccacatgtcagctgcacaaacaaaaatagttttaaaatggtggggcccacatgtcagcctcactcatctcttcttccctctcccttctctctctcttctttcctttcccctctctctctccttcccaggcaggggacggcacgggtgggcggcggagcaggcgagctccggcggcggcggcgggcgtggttggcgctgctccccgaccggagcgccgccggtccgcgtgaaggcaggtccggccgttcgggggggtctggcagctagcgctacggcggcggcgatcggcggcgggagcgctgggcgggaaaatgaacggggcggcggcgggaagagcggcggcacgaagccgaaggggtgctagcctcgtcgtcatcttcttccggcgcatagtcgtggagcggccggcggagcgacgacgacgggcggcgggcggagggcggagtagaggggcggttgacggagcgacgacgggcggcgggcagcgtggcgagagcactgcgagggaggagcgagctcgtcagggtggtcggcgggaaaagaggtagcgcagcgcacgccggtcgatgggagggagggagaggaacgggggtcggcagccggcgggtgtcggcggtgcgtgggggtcaacggctggtggaggtggccggaggaggaagaggcagaggaggaggtcgccggcgagcgcgggctccatgccgtcggccgctccgcccgagatgcccagcagaacggcgccgcccctcctcgctcggtcgccgagcgccgccttcctcctcgcccggtcgccgagcgccgcctccctccttgcccggttgccgcgagcggcccctcctctcacccagccgcggcgcgccgcctccctcctcgcccgaccgtcgcgcgccgctccgcccaccgccccctgctgcgccgccgctcaccattctgtaagggagagaggagggatagagagtagagggggctgacatgtgggaccacaggggccccac

SEQ ID NO: 44456 - DNA, 917 bp, Oryza sativa
gatttttcttcaggataatacagtaaaacagcatgacaagggaactcattgtttcaaagaagggttttgttggggaataagggtaggaaaaatctacctgaagctccaagtgcttagccttgtggttcatgcaagatagttcgtcctgaactctctggatctcatttctcatgacatcctgtatacgaagtgaagatgccagatctgactctaattgttcaacatcaagttcctttgaaaggagagcctcctttagcactctattgagtatagcctcttctttcagcttgagttcaggaatatcctacaataagaataagatggtggtaaacaaaggctcaaggagtcaaggttctgcacctgctgaacttataacacatattatactacactaattatttttccagctgagtgctcccctgtcttttcttattccaaccaaaaaggaaaaaaaacttgattgaacagaaaaagatttacagtaaaacataataggtgctcataccagaggtaactcatctgtgtgctccctggaaggactagatccaactacagtctctccagaacttccctttatattttccttttcagtgaggacagaactaataatccccaaactttgcttcagactctggattcgtcctttgatgctctggaactccaaagtgtagtcagtgacagttaatgcagctatgccattgccagcttcattttcatgccttttgcatttcattagttccaacaatttgatgcacagttggctagtcttatcaagcaatgacaagccatgtatctgcaagttatccactctggctagtagctcctggtcaagacgaattgaggacaagcgcggtccatttccagtactttgtatacgatttaaaagtgcaatgttctcttgccttagggactctgat

SEQ ID NO: 44457 - DNA, 1155 bp, Oryza sativa
  unsure (1)..(1155): unsure at all n locations
gacatggaggctctgtcaaatacgtaaatcggcccaatatcatgctgaattgctgagtagccgtactgaatatctagcccaacctttttccccctttccgtgatgaattcatatgcgtgcaaaatttatgtgatctctcctgaggcattcgctagctgtcacgattggatcctcgattaccttccatacttgagctatgatttactatatatgctgcacctaggtgtcatggcacctatcatttgcatgtgacttaaatagttatagaaaaaattaaaaaaattagtaacatcgtttgtgatgatacaagtctatacacaaacatgcaagactaaatttgatctacaactagagaaacaaaaataataaaatcagacattcaatagtacccgtacagtgcagataaaatttcttatttttgtttcttcatatatcgatcgaatttagacttgcatgtttgcatagtgacttatattatcatggattatcttatcaaattttatgtattttttatataattatttaaattacaggcatacacctaggtgccatgtcacctaggtgtaaaaaatactttctgttatagtgctggactcgataattttcatagttaagggaggcttataatatgtttttttgcgtttatgggatcaaaatggcctgtagttaaggcaggcataataagtgatgagttcatatacgtgcaactgcaaacttatctgatctctcgcgacattcactagctgtcacaattggatctccgattacctcccatacttgggctatgattttcctacaatgaattaaggtgcaaacgtggaggatgaaactaaaactcgtctagattcatgcagaaacatagataagtgttgcatttgagtcgctggcagaggatgaattccaacccaaatctgctgagatatcaattgccatgatacgtcgggtccagatcctctagagttgggtataactctatcgggtggagttggctaaatctgtgccattcggcatacttcaagggctaggcttaagccacattaatttatacttaaaaaccagtaactgaccatgcaacaaataatcttgtatcaacannnnnnnnnnnnnnnnnnnnnnnnnnnnnnnnnnnnnnnnnnnnnnnnnnnnnnnnnnnnn

SEQ ID NO: 44458 - DNA, 27078 bp, Oryza sativa
  unsure (1)..(27078): unsure at all n locations
nnnnnnnnnnnnnnnnnnnnnnnnnnnnnnnnnnnnnnnnnnnnnnnnnnnnnnnnnnnnnnnnnnnttaatttattaggtgaaaattccttaaaaaaaacttattaggttaaattgacgaggaatgatctcagccgtagaaaacaatggatagcacagatttggccaactccacacggtagagttatactcaactccaggggatccagaccctgatacgtccacgaaatgcattcctctcaaatcccagccggatttggcaccaactaatggcggtgaattggataggttaattcatagatgaaggtaattgattgatacgggctaatatcatcttgccaaaacaaacatgccatccaggcgtgtataacaacacatcaccaccattgcaaagcttcttcatcgatcgccatcgtcttctccagtcctcatgcaggctatggcgtccttactcccaattctgttgctcaccgccttcctatcgtctaaacctgcactctgctacatcaatccaggtgcaacgccgccacagaaaattggcacgaaatcttcaggtggccgtgcaacctacatcgtgttcgtcgagccgccgccgccgcttggccacggcgatggcgaggacgaccactgccggtggcatgaatctttcctgccactgagtgagctcgccggctccgacgacgagccacgcctcgtccactcgtacaccgaggcggtcagcggcttcgccgcgaggctcaccggcggcgagctcgacgcggtgtccaagaagccggggttcgtgcgcgcgatcccggacaggacgctgcagctgatgaccacgcacacgccggagttcctcgggctgaggaaggacgccggattgtggagggactccgggtacgggaagggcgtcatcgtcggcgtcctcgacaccggcatcgactcctcgcacccttccttcgacgaccgcggcgtgccgccgccgccggcgaggtggaagggctcctgcagggacaccgccgcccggtgcaacaacaagctcatcggcgtcaagtcgttcattcccggcgacaatgacaccagcgacggggtggggcacgggacacacaccgcgtcgacggccgccgggaacttcgtcgacggcgccgcggtgaacgggctcggcgtgggcacggtcgccggaatcgcgcctggcgcgcacatcgccatgtacagggtgtgcaccgtggaagggtgcaccgagtcggccttgctgggtggaatcgacgaggccatcaaggatggcgtcgacgtgctctccatctccctcggtagcagctttgctgcggactatgacaaggaccccctcgccatcggcgcgttcagcgcggtgtccaagggtatcgtcgtggtgtgcgccgccggcaacaatggcccggcgttcgcgacgcttagcaacgaagcgccgtggatggtcacggtcgccgccagctcagtcgaccggcggttctcggcccccacgcggctcggcgacggcagggtcatcgacggcgaggcgcttgatcaggcgagcaactcgagcggcaaggcgtaccctctgtcctactccaaggagcaggctggtctctgcgagatcgcggacacgggcgacatcaagggcaagatcgtgctgtgcaagctggaggggagccctccgacggtcgtcgacaacataaagcgcggcggcgccgccggcgtggtgctgatcaacaccgacctcttgggctacaccaccatcctccgggattacggctccgacgtggtgcaggtgaccgttgccgacggagccaggatgatagagtacgcggggtcgagaaatccggtggcgaccatcacgttcaagaacaggacagtgctaggtgttcgtccagctcccaccctcgcggcgttctcgtcgcggggaccgagcttcctcaacgtcggcatcctcaagccggacatcatggcaccaggtctcaacatcctcgccgcgtggccctcgtcggttgctcgcaccgatgccgccgccgcgccgccgtctttcaacgtcatatccggcacgtccatggcgacgccgcatgtgagtggcgtggcggcgcttgtcaagagcgtccaccccgactggtcgccggccgccatcaagtccgccatcttgacgacatccgacgaggtcgacaacaccggcggcccgatcttggacgagcagcacaacaagaccatgttgttcgggcccttcaacaccggcgccggccacgtgaacccgacgagagccgccgacccgggcctcgtctacgacatcggagtcgccgaatacgccggcttcctctgcacgctcgtcggcgagtatgtcctgccgatcatcgtgcgcaactccagcctgcagagctgcagggatctcccccgggtggggcagtcgcacctcaactacccgtcgatcacggtggagctggagaagacgccgttcacggtgaaccggacggtgaccaacgtcgggccggcggagtcgacgtacacggcgaacgtgacgctggccgcggagacgtcgctgaagctgagcgtgtcgccggagacgctggtgttctccaaggccggggagaagaagacgttcgccgtgacggtgagcgggaggttcacgaaggcggcgcaggcggtggcggtgctggaagggagcctgagatgggtgtcgccggagcacgtcgtccggagtccggtggtgctctacatccccgtcgcttccgcaccgccgtcgccgccgatgccggcggttgggactcggcgcggagacaactgggcctgaagttcttcatgggctatgtacatgggtcgtacgctttgctgtgtgaatactaataactgggccgattttttactataatcctaatgggcttttgggttactctcgcacgcagtttcagcccatcagactgtactggaaaggattgagatactctacctgccactttgccttgttaataacgggttggtttggtttgagtcctatattggccttaccaatatttggcaatttcaatagtgtttattgtctatttggtttggagccaaattttggcatgcctaagaaaataggccatttcaacagttaatttaggctattttggtttcaatccaaacacaattttacctttgccaaaattagccatgacaaaagttaccaaaatttaacattgacaaaaattggtaaggccaatttaggccacgaaccaaaccagcccaacatgtgtgggtctagggttcatcgggcttacatattagtgatggaatcagtttacttcgaaggttgaggatcttgatccgtactataataacacattttacttagcttttgcaattgaattcaactgcatctactactagagtaagtactctagttttgctattttgcaagcttcacatcttccttaatataagctcgacagaagggcaggagaaatggaaagaagaacaggacagacagaaagaaaagcttgagctcggcatgaagccatggggatggagatcaggatggcacgagagcaccttgcagcttttatggtgctcttgctagctgaataacggccggtggaaggtgagctacaggaagattcgtccttatagcaataaacaatgtcagcatcggtgcacagaacctaactgttcgctgttaaacgcaaagcagctcttcagttcagttcagttcggttcagctcttcagttcagttcagttcggttaggttcagttgacagcaacaggagcatcacttactaaaccaacacaaaagtagataggacactacctctatccagattcgttgtaacatgtagtatctcatttactcataggttagttttttcttatgggatggagggaatactccgttccttttaaaatacagtgacctaaaatggatggggtaaattttaacccctatttatattcgtagtattaaaacgcgtctcatactattgtatattgttacattttagaacaaagtaaggactccacttggatggttcagactactctacaaagactgcgttgctcgccttcattcaggtaaggagagagagccttctctaatctctacaacgaactgaaccgtgtgagcgagatcaatcttaacgctctgaacattggaaatgcaggacaggaaacgaatcgaatccgatgaaatttcagacgccagtaaaaagggtggaaggtacggtgaaggtaatatcaaaacgtgagaaagaatctgctgcgaattggacagcagtagcagtgaaaggtaagatcacagtagtagtaggaggagcattttcaagaccaacccgtttacccgcgtgcatttccacgtcaggcccgtacgaaagtagaagccgcagttgccacttgccactgcagctagctggaatagcttaccgtacagcattcagctggatcactcaaaaaaaaaaatctgtaaaacatcacaccaactcttcgtttgcactacccgtcccaaaataagtgcagcattagatatctgtatccaacatttgaccatccatcttattaaaaaattttaaaaaaattagtcacacacataaagtattattcatgttttttcatctagtaccaataaaaatactaataaaaaattcaaataagacgagcgatcaaatattggacataaatattgcaaaattgtatttattatgggaaggaggtattactgctacttcacgtttgcgtacgggaaattcgtttgtactccattgtcgagaaaatctcagggctcattagggtcaaccttcatttttatttttgaaaacaatgttaaataaacaaacttaaaaagtaagacatgattgatagttagacttaagagtagaatcaaatgaacaattgtattttttctataaacttgtaaagatgtttgatttaggataaacccaaaataacttattacataaaataagtttcaaaattttagtcaaataaaatcaacaattttggccgtgtttagttcccttcaaacttccaaaaattccatcacatcaaatgttttgacacatgcatagagcattaaatgtgaacgaaaaaaaacaattacatagtttgcatgtaaattgcaagacgaatcttttgagcctaattacgccatgatatgacaatgtgatgctacagtaaatatttgctaatggtggattaattaggcttaataaattcgtctcgcagtttacaggcggaatctgtaatttattttattattaatctatatttaatactttaaatgtgtgtccgtataattaaataaaaattagccaacgaactagacacagtctttatacaatatgcggatggagtacgtacgttatagggcaagcactgcctcttcttaggtttcttctgttttgagagaggggttgaacaattgcaggcaggcactgcagcgtctagaagaattagaagctcggtttttgaatcatgtacagttctctctctttttctttcctggaataaggtagagctagctctcgagctcaatcttaattaactcgtctgttaaaaaaaaatctaatcctaactatgtatttagacacacatgtatttagattcgtagctcaaagttagctttttatatacgtcctgatgaatgatgtatagtggcgtgtgtggtgctgatgatgattagctatttaaatctgggcgtgccgctccctgatgctgtgattatgaacttattttggctcttcctcttgtagctctcaagagtgtctgccatgattgagcagggccaggggcatggatagtttacaaacaagtctaccagatgtgtccatggacccgccatcttcctatacaaacgcaccctttgatactcaaaagattcagccacaacttgtgctattaaagaacgttggttacaaacgtttacagctttgcacttaggtcctgtttagatcccaccctcaaatttttcaccatatcacatcaaacatttaaacacctacatgaagtattgaatataggaaaaaaactaattgcgctgattgcgactaatttacgagacgaatctttttaagcctaattgctatatgatttgataatatggtgctacagtaaatatttactaatgactgattaattaggcttaataaattcgtattgtggtttactgatggattctgtaattagtttttttattagttctgaacaccccatgcgacacacatcctatataatacccgatgtgacacgtcaaaactttacacccctaaatctaaacactcccgtaagattactataccaacctgaatctatctctgtttttttttctctttcacagaaggatgctcccatgaattactagctgatgagtatggtactatggtgtgtactcattcaggccattgatgatactaccaagcaaagttatcagccgatttattttttgcttgatgcattactgcattatccctttgtaattttactttgggacaaataaagtagaaaaaggtggacaggggaatagaaaacgagtagtacaaacgttggaacttgaactcttgactgacctatcaccaaccatctcgtggtactagcacaccacttagggctgtttagatacctcgtaaaatttttcactctgtcgcatcgaatgtttagacatatgtatgaagtattaaatatagaaaaaaataattactagattacgtgtaaattacgagatgaatcttttaattctaattgctccatgatctgacaatgtgatgttacattaaacatttgctaatgatagattaattaggcttaataaattcgtctcgcagtttacgggaggattatataatttgtttttgttattagtctatatttaataattcaaatgtgtgtccgtatatccgatacgacactccaaaacttttcacccatatatctaaagacagttttaatctccatccattctccaaacatcgagatctctgacgagtataggccaacaaataattcctccatctcaaaacaaactaatctcatattaaaatataatgtatactagtacatcgaatctgaatatactctatatccagatttattgtattaaaatgtatcgtatcttagtatagagttgttttatttttaaggcggatagagtactctaaccaactcaacagtcaattaccattagaaaccacctgcgacaacactactgccattagtttatctggaatgagacagagcaatgagccatgcgtttaacccaggagaattctgaggcgtgctgacgaaaatgggaactttccttacacttcctctattttcttttatatgatgttgcttagtatgattttctatactctatctattgaactaaccaatattaaaaaatatttactactgatactttctccattttataattcttgaggtttaaataatgacaaataaactaaagaaactggaaattaaaatctagtgtggtgcaacttgatagtaagcagtgtagtctacttgaagtggaatacttcctccgtttcaagttataagactttctaccattgcccatatttatatagatattaataaatctagacacgtgtcttataatctgaaacggtggtagtagtatctttgctcggctatcaaggtgcagggaaagttctcattggcatagagcgtatctgacagcaagtctttttagcttttggcaacatctctcttcgctcgtcgtaactaggctttcgatgcaatcgagagaaaggaaaacttcaaggacatatccagttgtgttacagaaagatcagtggagttcacttcccctggggccatgcaatacatgctgagttttcagttcagtttcagagaatatataaaagacttttggatccgtagcactcagcaaaactcttatgtctcggaaacatctgtgctcagtttgatttgaggtcaattttgttttccttagagcaagttcaataaaagaattaagttggtggtataatatcgaggctagcaaaagcaatgagcttgagaaataatctttttaacttattaattttccaatcatccgtttggaggaaaagagtagtattattttttcacaaaagctgggaaaagaaggtgggctttattcttcaccatgccgtcacatgaataggggcatactccatgccaccatcactaatcaatgtcacatcctgctaatgcaaaactcttgcacaaatccactaattaaaaccgtgctagtcaccctaagatgacgccaaatcaagatcttgcacatttaattaaactactctaagatagaagtatgctttatgctaaagcaaatgaataaaaaccattaagagattttagagtatccaggtggccgaatttgctaaaagaaagggttaagagaatttgttcttgccatttctgctaaagccgagcatcttcgtactcctacatgcatatacatgttctgcctgccggaatttcttttctactctccatttaaaaatgtaagaacctataaccgaatgatacgttttatagtacaacatatcttgatacactcctatctagatatattatattagaaaacgttttatctgattttagattcttaggccctgtttagatcccaccctaaattttttcaccatatcacatggaacatttgaacacatgcatgaagtattaaatataggttaaaaaataactaattacatagattgcgactaatttacgagacaaatcttttaagcctaattactctatgatttaacaatgtggtgttgtagtaaacatttgctagtgacggattaattaggcttaataaattcgtctcgcagtttactaacggattctgtaacagattttgtaattagttttttattagtactcgaacactctatacgacatcatatataatatctgatatgacacgtaaaaactttacaccctgaatctaaacacccccttatattttaggacagaggtgtagtagcgttttcttatgactgctggaatttcttggtgaagggaaaacgcacactggactgccacgtgtcacgcacaattagctgttaagcatcgggcagtgagcgacgcgatctgctttgcccttttgttaagctttggtttgacagccaagccatgtcggggaggcgccacgtggcgtgcacccaacaaagccctttcttttacctctccttttttacggttcacgattggttgctggtggcaacaacagtaaaaactgtactgtagtttggtcagaggggtgacgagtgagtccgaaatggagtcagtggtcaagtcaataataggagtagtccaaccacgttacctgtgacgaaacaaaaaagacgcattgcattattaatttattaatggtaggagtacataaacatttgggaccaataatcgctacagtttctgcacatacaggagtaccagtactactcctacgtgggtgttttttttttcttcattactacccccattccatttttaaacgtagttattagttttcgttttcagttttaatggtttgtcttatttatttattttttaaaaaataaaaaatataagtcatgcataaaagtactactcatattttatcatctaataataataaaataattaatcataaaaatatttaaataagacggacgatcataattaaacactgaaacttatagttgcgcttaaaatgtgatagaggaagtaataatagtagtagtggaccaaccaaactttttgttgttcacgtccaagtgtacagtacttctgaaatttctgctaatggttgggttgctggagagactccggagacatgggaacacagcaactgtcaatatccaacacatgaacaggacattatcagataagtgggcttgcaccattaatattatggtccagctagctgctggtactcctagataagacattatctcaagtacttaagtagcattagtagtacttaattatgagttaaacggcttgaagaaaaaatatatgtgacctttggtacttagtacaaatcaatgacgttacgcaataattaccatcattagctagtactaggagataagctcgccggctaatcaacatgattaatttgcttagaaatcttttttggtgcatccggcgatctgattgggccaggcaagatgttttcggattctttaaggcaaagttgacgttgtttcgctaaaccggagccggtgaataattaaacaagctgccgaagaagatgtgatgcgctgctggttaatggaattaaaagggaatcagactaacatcatctagttacatgatcgagcgacatttccagcatcttgttaattagtaagcaattatttcttccatgtcgatcgttcaagtgagctagacaacatttttaacaacataatatggctatactcttagggccatcggatttgtagatatttaactatttaccacttttagatgtgacaaataactttttgccactggattcacatgtcatagatacatgtggacccacatatcgttgaaataggggcaacaaatagttaattgccaattggaaaagtggcaaatagttaaatgcatacatgtgtcttataataattaagacaataaagactctaatcattaacctaaaatatattttttattttctattctaaaaactctaaaatcctgttgagtgagactaagtgccttttatgaatgattattgtacatgccatattaattagtgatttgctgaaacatgcataatgaaaacccgtgaattaatttttgtatggtacaaattccattccttggctgatcttcaacggcgatgcaaagccatatagtcctatatgcaggcaggggcaggcatgaaatgttccctcgtgacactttttttttcctttgctctatgcctttttctgtaccctagcaaattaacaagtttttgttttctttatcctgtgcctttttgtgtagccttggaaattaacaatgacaaataaatatatggagtatgaaggacactagatagtgcgtcatgccgttttcggcagcttctttttctatctttaccgtgtataggaaagaaggaatcggattccttcctgaaagacagacttgatgagagaaatgacttgaccaattttcttgcatgtttactagtagtatgccggaaggagtcaacaagttcaacagattgcatataatcgagcgagacacactgcattacatggtagcacaatctgtagcttgcatttgtttggtcttaaacgacaaagtgcattaatagtattttctcctttcagttcagtaagatgaagattttcccttttttttcggcatgttctttgtaactgatagataaaattaaattcatgacaattatttgaggacacagcataataaattaaatattagaaagctgaaaaattgatttgaattttttttcaaagaaatgttgattaagaaactttcttcactagaatttctttgaatgttttagagcttagcaactatgcccgtggcaatccataatctataagggcatgtttagatccccggtaaaatttttcacgatgttatatcgaatatttggacacatgcatagaatattaaatataaacgaaaaaataactaattatacatattacgtgtaaattgcgagacgaatattttaaacctaattgctccatgatttgacaatgtggtgctacagtaaacatttgctaatgatggattaattaggcttaataaatttgtctcgcggtttacaggcggattctgtaatttattttgttattagactacgtttaatacttcaaatgtgtgtccgtatattcgatgtggcacagtaaaaatttttaccctggatctaaccaatgtctaagacaaaaagaaaggacaaccctgagttcagaaccggtgtgacaggttaagccaatccattcatgtttatttcagggtagttaagaattttcatgcaatttccagttgatcaggacatcagaagaaaactttgatccgatttctcccgtaatagtagattcactgagatacctaggatgatccaatattattcctttccatccatatcgtttgcctgttgaagggaccccaccaaaactgccctaaaccccttgagccaatcaatcagtttgaccgtccgagtactacgagtacgagcagtactagtagtatttggtttgcatagtcacacactaaactgtcagatgatcacgttatccacaatagggtgttgtgtaggtcactgcaattacatagtaggctgtgtttaaatccaaagtttggatccaaacttcaatctttttccatcacatcaacctatcatacatacataactttccaatcacatcatcttcaattttaatcaaaatataaactttgcgctgaactagacacagccgtagtagcagagtgctatgatagccggcatcttgtgctgctcttctcttctccatacgtttgtttgttcatttgtctctgcctttatcggacgtccaatccatcattgactagccatagcccatggccagccagccagccctccttgtgttgctcatccaatgcccaaacgatgcaaaagatgtcagactatgcacagtgtttagtacatgtcctccattggcatgcttcctttgctctgggacggttactgttgtgcttctattatccggctgcatttcttcactatttttgaattcaacatgtaaaagcctgtacaatttatgttacaagcacttttacaaatattggtacgagtacgtagtactggatgttaccagctatagagcttgattgagcaaactcacggagatagcaaggacaaagaatgtacttcctccattccacgatgcaagggcccctttgaatcgcaggattgagaaaacgtaggaatataaaaaacgtaggattttgatagaaatataagaccttatttagatgggactaaaacttttaagtccttatcacatcggatgtttagacgctaattataaacattaaacgtagactattaataaaacacatccataatcttagactaattcgcgagacaaatctattgagcctaattaatacatgattagcctatgtgatgctacagtaaacattctctaattatggattaattaggctttaaaaaattgtctcgcgaattagctttcatttatgtaattagttttgtaagtagtctatatttaatactctaaattagtgtctaaatacagggactaaagttaagtccctggatacaaacaccacctaagtgtaaaacataggattgcaaaatgcaggaaaaacacatgaatgaccgtttgattgaaccgcgggaaaaacacagtaattggatgatagagatagactcgaaggaaagttaccaagaggttctacctcattgttaaattttctctaaaatttgcatgggaagaggcattccataggaattttataggatttcataggatccattcctttgattcaaagggctatataggaaaaattcctataggaataaaatcctctaaaattcctatgaatttcctttgaatcaaagggggcctaagtcattctagcatttctcacattcatattgatgttaatgaatctagacatatatatcaatctagattcattaacatcaatatgaatataggaaatgacagaatgacttacattgtgaaacggagggagtataacccatggtttagagtgatgaatcatatgtactgttaggccgtgtttagttcatccccaactaccctaaacttccaactttctatcacatcacatcacatctaaaactatcctacacacataaactttcaactttcctcaaacttccaactttttccagaaattaaacacagccttatatgtcaacattgggttttatagcagctgaagagctgcatagtgattgctttataacttatgtcttgtattacagaaacacatagatgatagagattttcttaaatctcaaccacctgctctctagccatggatcttagcctagtaaaaaacattgtcttcaatctctagccaacagagagagggacgtgaatcctgatggagcttagaactcaaggtgatggaattatttcctacgattgtgacgtggcagtagtacaagcaaggcggtgaaagcaacaacgcccagagggaggaaaggagggatttatgtctctttttttttcttccaaaatatcttcctctactacatgtccatctacattggcatgcttcctttactctgggacaattgctattgctgctattatcgacctggaattcttaactattcttgaaatcgcatacaaaatttatgttaatggcacttgtacaataactggtggatgttagtagggcgagagcttgattgaaagaattcagaggtagcagggacaaaagaaggtataacccatggtttagagcggtaaatcatacttaccgttatatgttaatgttagattttgtactagcaattgaagagaagcacaacgattccttatataaataaatatatgttacaaaatatactatagattgtgattttcttaaatctcaaccacccgcccatctcccctctctagcaaacagagagagggacatgagttgtgacagcattgaactcaaggtgtggtggcggagttttctcccgcgactgtgacttgagagtgatataaggaagtcagcgataacaacatcgatgaacgggatgaaaggaggaagaaattatgggctttttttttccttccaaaatatctcaaatttgttatttttgtgttagtaaaaaaagttctacagcagaaacactaaaatatcccaaacagaaagccccaaaaaacttcttttgagattgatgaggcaccttggggttgggcccagccagcccagtggaggtggagtactctgctcatccccacaagccacagttctccctccaaaaaccaaaaaaaaaaagttggaaaatactgcttccttctactaccccagcaatacctacagccctggaacattggccatgccaaaaagttaggctttctttccattcattcattcattcatcagctagcaaagcaaagcattttctcagctcaagttgcttgctcctcttctttctttcttcctcctccccttccctttcaggactcctccccccacatcagtagctttcactgcccaaaccctctttgtgggtggcaaccctagattattaatgtcctcctcctcatcatcaccatctcctcctcttcttcctcccctgcttctctctccagattctcttctcatctggtcccttccttcccctgctttgcttgctcaggtaaaacctctcccctccttgcaagattctcccctttcttggcatgctccaagatttttctttcctcctacatcgccggcaagatcgcttctgttaatgtttccgcgccatttttttttgtttgcagctagctgatcgcacgtgggtagggtgagtgtgtgtgcgtgtgtggatgggagtccacgcaatgtcgtgccacggcggcggcggcggtggcggcgaaggggcactgtcgcggcaggggtcggtgtacagcctgacgctgaacgaggtggagagccacctgggcgagccgctgcggagcatgaacctggacgacctcctgcgcacggtgctccccgccgcggcggcggcggcggagacggcggggaggaagacggtggacgaggtgtggcgcgacatccagggcgccagcaccggccggcaccacgcgacgcccatgggcgagatgacgctcgaggacttcctctcgcgcgccggcgtcgccgtcgacggtgccgcctccgccgccggcgcgcattggctgcgtgggcactacccgccgccgccgccgccgacgacgacgacgctgcagtacgtgggcggctccggggcggtggtggacggcgtgtataaccgcgtggacgggcacggcgtcgcggggttcctctcgcaggtgggcgtggcggggcggaagcgcggcggcggcgtggacggcgtggtggagaagacggtggagcggaggcagaagcgcatgatcaagaaccgcgagtcggcggcgcggtcccgagcacggaagcaggtgagctttccatccatcgaatcaatctgcagagaagcttcaatttccttccccccccccccccccccccccatggattcgtgagacgctcatgtggtggcaacgcaggcatacacgaacgagctcgagaacaagatctcgcggttggaggaggagaaccagcgcctcagggagcacaaggtaacaacaaaaaaaatgtttattagtagcttctcctcctaaatcctactaattgctcactgctagtactcagttccactgatcttgatgtgagcttcagctccactgtttctttgtttgtttttaaatcttttctgtggctcccagtttgcacaaactctgcaaagtcattttttagttaaagccaaactagaaatataattttcttactagttgttaggtttataattgagctggatgctcagtggagagagagagagagagagagagagagagagagagagagaggggtaacgagccttgattagcatcttgtgtgtgtgtgtgcaaatgtggtactccttgggatgctgggtcatagatgggcgagcaaaggttgcaatttgaggttaaacaggtgacattgtggacaaatcatgcacgtagtactctgcaaaaaatggttctttatatcttacttgctctagtatattttctcaatgtactaattcctccagatgcgcacttataggacagattatgactgttcagggtggtacgaatttctaatttgaactgaacgatcgtcttaattaactagggagtagtatatagttttttctacagttcagttgatgcattactgaatctttgtttttatgaaacaggctgttgctgatttctcaacattccctagctgcgtcgatttcctgaaagcattcttgacgcagaagctggaaccagtaatgcagattgtgccccagccggagccgaagcagcagctgcgacgaactacttcggcctctttctaatcaaccaaccacaatgttcatagcgaaatgatttaaactcgatctctgtaggaaaatcaatgggggtttgtacttggggatgctggctgttgtgaacaagagctgaaacgacgaactcttttcttaactatcgatctgcacgtctcttcctcttgcaaatttcactctgtggttaaactttcaacgaaagattcactctgatgggcgtgattcttgtgttgatcgatgtggtgcgaatgattctcttttgcaaggttcgagtaattctcattgatccttgtattttgctgtttgtttcttaagtttcttcgtcttagaaatgctagtactacctctgttttttttaaaaatgttaactttttacatcatgtttgatcaccttgttcaaaaaatttaagtaaatatcttttcatgtgttgtggtttgatttgtcaataaacaaaatttaagcaatacttatatttttaatatttgcataaatttttaaataacacgaatgatcaaaggttgtaacaaaaattaacaactttatatattataaaaagcggaggagagtatagtaccggtatattgtgaagcaacatattttagagctcaggtaacttgggcccttggcccgttttggaattaagaaggcctaggtctcgttccgtggaataagttcatctgagatcccttaacttgtcaacgaatcttattttcatccttcaactcaaaaatcagatacagcgggtccctcatctatcaaaaccgatgcagataagatctcttggcggtttagatggcggttttggctgatgtgactcctacgtagctattttgactatgtgttcatctgacgtggcgttgacgtggcaatttgaccaagaaaaataacaaaacttgtgggacccacatgtcagtttcacacacaaaataaaaaatggcaagatcgacattgggttcgcgctcctctcgtcctgccggagagactgagggagggaggatagagtcatagagataagatgaagggacctctgttgtacctggttttctggttgaaggacgaaaatcagattcgttaacaagttaagaggcctaagatgaacttattcttcgttccgtttgacgtcgcgtaacgggcgtaaggcctgctaatctggctgtctgggcctcccttggcgtggcccacgtgggcttgggtcaggcggattcatgtacgcacgacgcacggtcaccgcaagatccaacggcatgcagtctccggagctaggttagcgagaaaaatccgtgcaacttttctttccaacgaaccaagagggatcaacatagaatagactagattgactctgtatttaaaaagtaaattatattaacctaacacaaacctaataggtggatgcaacatagtacagtggaaaaaattataaaatacttgtcacaaacttgtctggtgtgtgcaaaattaatgacgccaaaaccgtggttgatatactaagttgaaacatgcttagaatggcacatgcacacgtcaggaggtcatgaggcatactatatgtgcaaattaccactatttttttttcttccattgtttttaattcactgcatcactggtatttttttcactgtataattagcatcccctactatgtatttgatcgagtacacatatgtctagatggcatcattctgaaatgtgtacccatgtagcatcctaataaacattcaaacttagtaagattaaccatggcatgcttatttggttctgattcgcatgcatcaacatgtccgtacattaaaacgtgtgttttacaagcttatgtaattcgttacatccaatacaatttactctttaaaaaataggcatccaatttgtcttcaacataattcgaatttgaatggtctaggcatacacccatacccatcaaccaactgagctaagccctagaatccatgctagtgcttactactagcatgcgggcgaagcatatcgatatcgatgccacgaagcggtcaatttttttcgaacagccggtcagaattgactggcgttatattgatagaaggagaaaaagtacaaatagccaaagggctaagaaagagaaaaactgtacatgacaacatgcaaacaagcttgcatgtagccttcctagctcctcattgcaacattctcccaatgtgtttagcgccggccatactccaccaacctaattcctcttggatgtgactaatcatctggtgtactgtcgcctcctttgctctaaagattcttgcatttcgttccttccagatttcccaaacaatgagcaagaagagagttctgagtcctttctgttttgttgcttccgggtcgcttgttccttgtgtccaccaatctaagaggtttctacttgtgttccatttcgggatgatgtgcccttggtgcagccatgtgagaatcccaaaccagatttgctttgagaccgggcattcaaacagaagatggtcgattgtttcgagatttcgaaagcatagctggcagaaataattatttggccatcccctgatctgtaaccggtcagctgtccacacccggttttgaagaaccaaccaactgaagattttgcactttgccagagcccatgcctcccaagacaactttgttgatggcgagagtaccattccattgaattggaattggtacgcggatttttcactgtattccccattagttgtccattgccaaacaatcgagtcttgtaccccctctattagttgtggggtgtcacgggctaaaatttcctaaacatagaaggattcatcaagaaggggaatggtgaggctgtggcggatgtcgttaatccatctttcttgttgcaacgcgtcctggacggtgcgggttttcctcttcgaatgcctataaagattcggtgcttgactttttaggctttggccactgatccaatttgattcctaaaagctcgccttttgtccgtcaccaatttggactctcgttgatgccgcgaaaagatccttatccaattcatcacagggtgtttcagtccatatccaaggcttctctggcgtcctccattcgaaccataaccatctcagtcgaagagctctggcaaacttttctaagttcggaacccccaaaccaccgtaccggacaggtgagcaaactttaagccaattgaccttgcattttccgccatgcatattcttgttacctgcccacaggaaccgccttcttgctttgtcaatttcttgaagagattgtttcgccggtttcagcaccgtgagggtgtaagttgggatggcacttagaactgagttcaccataattcggcgcccccccatgtacaacaatgatggcttccatcccgagagccgacctttgatcttatcctggagaggctggaaatgcaccttacgtaggcggccaggagtgagtggtagccctaggtaagtcagtgggaagctggctcttgcccccgaaaaactacgcaagacgtcgtccagatctacttcctggcatcgaattggtgccaccagactttttccaagattgacgtgcagccctgttgccttgccaaagtccctaagcatggtaataagaacatccacctcgctttgtacagggttgagaaaaacagctgcatcatctgcataaagcgaagtcctcaatctagcatggcgacttccgatgttggttagttgcccaccttcggtcgccagatgtagaagcctttgcagggggtcgatagccaggataaagagatagggggataggggtccccttgcctcaagccacgtctgtgtgcaatgcattccccctggtctccatttaggactaccttgaaagtggtggtggaaaagagcaaacagatccaatttctccaccgggggccaaaacccatgttttgcatcagttcaagtaaatattcccaggagaccgaatcaaaagctctagcaatgtctagcttgaaaaaaagtgttggctttttgctggcatttaggttcctgagcacattccgaacatacaggaagttgtcttgaatgcatctttttttttatgaaggcgctctgtgcaaccgagatcagtccatccatctgcctggcaagccttattgttagaactttgaatatcagcttggcgacggagtgaatgaggctgattggcctaaaatcggtcaccaaggtaggggcgttcctctttggaagcaaggtaattgctgctctgttgagtgctctaaagtttcctcctgacaggttatacaaacactggaaaacatccatgatatcctgtttaattaactgccagcatttcttgtagaaggtaccattaaagccatctggacctggggccttttctgccggcatctgctttaaagcggcccaaacttcctcctctgtaaaaggttcatctagttcatcggggtgaacctgtggtagatccatcgcgtttcaatttagggtgcaatacgtagcggtcaatttgacttcattaattctagggtgcattcatgcagttgacttcctttaatttgttacgggaaagcgatcggttaatccatgttgagggcaaacatccttatccgaaatggagttggaaccatttgaatcattaggcagagtgaatcgaatttcaaccagaaattgtaatacggtgttggagtgtcatttgggactgatcatgcagctccagatcgaacgcacatatacgaaaaacccaccgatctacactaaaattagtcacaaatgtcatggacatactcattctcaggcatcactttggtccctatgcaccaaaacaagttttgggttcatttgataggactctaactcctaaattctactccctccatcccaaattgataatcacacatataatgtttgtgcactaagacaaaaagttatttaaaccgcatcgattaagagtttaagacgtcatgcacaatatacacacattatctcataatgcatgcatcgattaaaacacaattcataattatatccttagcatgcactacattctcctatgctacattaattgtactccgatgaaatccgtgtccacgcgattatatgacactaatcaatttgaaaaattatataatgatcaatttggtaaggagggagtactttagaaggatatattagtcgtgctagcttattttgtgagagcactataatcagctccactttacttcctttttaagtgaagctaaaattatttggttgaggttcagctctatataagagatgaaattgaagctagaactacgccgaattaacacttactctgatactattacgccaacgatacacatgatgacataaaaccaataacaatgatactaggacaggaacatctctcttgtatgaacaacgtataaaatactcagagcacaagatcgatcgatgtacgcgtgttacgtgggcctgcctcatccaacaaaatagaggcgtgggcgatcgagtgatgagacactcggacatcaaccaacgttacgttacgtgcctccctctctacgtggcgctcttctagttctccctcgcacgctgcctgcctgatgccgatcgatcgatgctgcgacgtgatctccatgcatcgcctgcctctccatctcgaacatcaattaggggatcctctagagtcgacctgcaggctattttttttttgtcacgttgtacgtttgaccggatgtcaaaagggattttcggtcacgaataaaaaaactaaaaccacgagacgaatcttttaagcctaatcaatctgtcattagcacatgtaagttattgtagcacttatagttaatcatggcctaattagactcaaaagattcgtctcgcgatttatatgcaaactatgccattagttttttatttatctatatttaatgtcctatatatgtgtctaaagatttgatgcgatgtttttgagaaaagtttttggaactaaacacgcccttaatggctagagccaggtgctactgcttcgcaggtacgccatgaacatcaccatgtccgagtccgaatcctcctcgccgtcgccgtcgccgtcgtccgccgccgccgacgggctctgcaggagccggcagcggcagagcgggcacgtggcgggcggccgcgccgacaaccaccaccggtcgaggcagccacggtggaacaggtgccggcaccggagctccctcacctcgtcgccctcctcgatgccgctcaggcacaccgcgcactgatccggccgcccaccatcatccgccgccgccgccgccggacgactactctcgctgccgcctggttgttggacagcactagcggcagcggcggcgctagcgctactgtaccgcgccacgcgcagcagctcgtcgcgcgccgcctgctccggcgccaccttcttggcgatcagcttcctcaccgacgacgaccccgacggccacgcgaggctcggcgcggcgacggcgaggagggcggacaagggtggcacgaggagcaggagcagtgcactcaccaagatctccatcactagctagctatagctactcgatccacaacaatgcagtgagacgcgaggcgacatgggagacgacgcaatatttatatatctgcgcagcagcttcaattcaaagcttaatgtcctctaaataatttatctatttaattaatacccactccatcttaaaatataaaaatttagaatcggataaaaaatactcttatattttagaatggaaagagtacaaattaagatgatcgtttaattaatttatcttcgtctatctctatcgctattgtacacagttgcacaagacgtgtccaacatcgtgatcaataggatggctgaaagctctagtgctgtaaatgtcagcttgtaatagaagcatcaatggctttaatatttgggtctcgttttcaatcggtagctacagatgaacttcatctagatcgtctttttggtttggtgcaaccaaattgggcatttgctcctctgcaagtagctatgccgtcgagcatcagtaaggagatatcatacttagttcgtccttctgacttttcgatgtgtttttgcattcaatatgcaatcctttcaggacaatgacttcaaagagaggtagaataacagatagagatcgtgtcaccgtgccattcaatgcgagtcctacctgttcacaagtcacaacaccatctcatatctaggcatctgtctccctttctccccttaatttccagagctactatacccaatcgatcacacgtctcctctctgtccctggttcatttttttttaagagatggttgatgcttcttcatatatagtccaagaaaccttacaaaaaggagggcaagttaattagcatgggctaattgagaaaaatggaagatttttctctcttaatactactaaacaggagaggaagagactagacatacatgcatggatgtaataatagtaaaatcaattgggacgtccaggattcaggaaattcagacatgagggtagctctccaaatcttgttctggtcaacttcttttttctaatccggattaggcaaaaacttaatgcctatcttaatcagtctgtaccaagatcaacttgaacatactcctcttcaccgatgttcactgaccaaatataaatatcccagagaggattctagattgccaaaaacaaattattcagagttccaatgcaacatacactttcggagtgatgtaatcgtttcttaatgtcaagctcaaaagttaaacagatctggtgcacttatagttaaccactgaggtattccttcacttccactcaataaataatgtatacacagtgtccagacttagggtgcgttcgtttggagaacaaagcgagtgagtttgtttcgttttccacgcgcacgtttcctgaactactaaacggtgtgtttttttaaaaaaaaattctatagaaaagttgcttaaaaaatcatattaatctatttttaaagtttaaaataattaatactcaattaatcatgtgctaatggctcacctcgttttgcgtatctttctaatattctctatctcgttcttctcaaacacacccttaatgtctgtctgacacaaacttataaaaataatgaatgagaggtaagactaccttacgctgccgctgctcacaagcttcaaagccacatggacagagaacaggcacacctatcttaatttgattcttttatactccctccatcccataaaaaatcaatctaagatcaaatgtgacatattttagtactataaatttgaaaacatctgctaaaatatgttatatcatcagatattaagttggttttttattggacggaaggagtatgtatctactagtacttttttttttatggaaccttgcatatctatgtcagacgccccttttcacccttcattttaatgaacagacgaagaccatatttcagcgtacagtccctcagagcattgcaccagtggttgaaagatacctaaaaatcaaataattattcaaaaaggttggacaaagccaaagccaggaaccccaacatattgcttaaataccaaatttgcaggaagcagaatgaaactgtcgcatgcatttcattgaaaaaaaaattgaaactactgcaaatgctagatgctagttgctgctgatctaccacccactaatgcaggttttggtctccaatcgctcccagtgcagcaaacaacaccggcaaaaaggacacctgaattgtctagctacctaccattaggccatcaattcatgcaacatgtgctcactctttgatcatcagtcgataaaacaagataaacgcattgacactggaatatctcattctactttgccacaacttccggattcatgaagagacatgaacaaaacagaaaaaaaaaatggaatagtcgttgaagcttccgaaattaagatagaagtacgcaagctttacaaaaggtataagctgggtaatgggttgcataacatatcggtatggagtagcgaagatattgtagaagcatatgaacactgtattcacaagcatctatctttgtcttcagaagtataaactattgaggctatctgacaatctctgttctaaaaccttttctgtgtatgcagttttcactccaggccaaactccttcactgatctaggactgcagatgaagtcaagttgaggattcttgatgttatcttgtagtattgatatctgaccctccttaacaagtatgtcttcctcaagggcttcaattttcttctttagtgaggcagtctcattttgcatgatgctgatggtttttctcagctgctttgcttcctgccataaaaggtccctctcatcagttactgttttcagcgttcctctaagggcactaatctcctttgcagattcctggaaatccagctggacctgactaatgatctcatctttcttcaagccctgctagtgcaacaagtatgtaaacaaacaaggtatacaaattgtaggttctaaaggagtgcatgggaaaaaaatgccactaatacaaaaggacgatcataagcatataatccgacatagagaattttcacacgccttgcaagttacaccactagaggctcctggtactggtcaaataacatgctaaatgtcagattatagactgtctctatacataaactgatttaaggaccctggtgaattttcatgcttcacttagtataacaaagaatatcacattgtaatctcatttaccatttatagtcagtttgtctaagcatttattttatgatccgtgagctgatactgatattcttgttgaccagaagccactaaaaactcgcataatttcatacgctaattcagagtcttaaaactttggaacttcttctacaataatctgaaacacctcagttgaagaacctatcaagaggcaaattgaagagcttccgttactgacctaagctccaatactaacagatgacctttttctctcagattgtcactaatatttacggtttaggtcatatgaagtctgatttcattagtgttaaacatgtcccttgtagcacacgtataaagtcataagttgattcttagtaagac

SEQ ID NO: 44459 - DNA, 25663 bp, Oryza sativa
  unsure (1)..(25663): unsure at all n locations
nnnnnnnnnnnnnnnnnnnnnnnnnnnnnnnnnnnnnnnnnnnnnnnnnnnnnnnnnnnncaacaatttgatgcacagttggctagtcttatcaagcaatgacaagccatgtatctgcaagttatccactctggctagtagctcctggtcaagacgaattgaggacaagcgcggtccatttccagtactttgtatacgatttaaaagtgcaatgttctcttgccttagggactctgattcaagatgacaagattgaacttcacctcttaacttctgctcaactcctgtcagtctaataagttccatttgcattctcttctttatcttgtcactgcactcaacagatttcttatctaattcagtactgtatccctgtcttaagccactgattgttctttcttgttcattgcatatggtttgtagccttgaaatcactttatgcaatgctttgttctcaccatccttatcttccaagaatttcctgagatgatctttttcctccacagccttagtaaaacaatcatgtaactctacagatgaattctggagattgtcacaattgtttctgactttctctagctcatcaattagttttttgtttcccatttccaaacaagcaaccttattagaagcatcaaccttttctgcttcaagaaaagtaacctctcgctgaaaggagacattctgctctgcaagttctctcacccgatcacgtaatctctcttcctcgcactgaaatcttgatagtctgattgaccaatcgtctgatcttctatccatctctttctccaaagtagtttgcacttccatcttttccttctctagccttctagttctgatgtccaactctttcttcaaatttttgcattgctctttggcagcaaacctttctgtaaggcgtgccttgatctgtgaagacaattcatatgctagttgtttcctatcttcagtcaaacattggatcatctggaacatgtcatttgcgcttagcctcttgtttttggacatgttaagctcatattttttttcagaagagaccatgaactttgcctcaacctcttttgccctttggagcaacttgtcatcagtttctacatcctctgttgcaaaatacaagccaatatcagaaaaattgttgggcaatcatatatagaagagtatggtaatatagcatcttgagttgatacctgaagtaggatcgatggagggatgattaaagtcttgcaaatcctcatagatatcttcaacagaagtaacactttccgatttgtaatcttctaaatgtgaaaatctctcagaagcatctagcagacctgcatggtttctacttgcattgcacagtgttgtaatcttgcatgtgtctcttgtatcctcttgagctagttggtggagatgttcatcctttacatcctcatatgggtaagtctcaaggatctcttttgttagtcttggcaaagatggtactgtagactgcggtcgaggcggccttcccaaattcgaaaccgcagatctggtgggagagttttgcttctgtctctcaccaaggatggtggcttcctgctctccatcaatgtatcgatctagaacttcattcttgttcaataaattggttagtcttgttgacctgcatcgaatggcaatgggagaactaacaggagagtgccctgttgagcatgaatagcatctcgaaccaggagagtcactttgcaggactgaatgtgcttttggatcctttattgtgtattctcttggggctggacgcctttttggtgaccatgcatagcagctgcaagtcagtacgcactgttaggaccagcaaaaaaaatacacactttattatcatcactcagatgaaaggaaatggtagagtcacaattgcacataattcacttaatgagtgaggattgcaggtccatctaaaactattctagttgaaatgagtgaagaattacattgggaaaatgggatttacaagtaactgaaatgcctaaagaaagctctgagtgcattggctgaacaatttataaggagggcaatcaccaccgtataattaagcatttaacaattatagctgataagctgaaatgagtaaagtttgcaagtgcacaatacttctccttttcttgtttctactaatatggataaaaaagggaatagggtgttgctaccatgtattggtttgatgatggcaaaaacatcctaggtttcaatgcactattgaactgttgatggtaatcaaaatgtaaaccaatcacttacttagcaacatgatcgggtgcatcagattcattaaacagagaagatgggacatcacccgagaagctgaagctccgatccttcaagaaactgttgccggctggtgatgagaaggacatagacctcctgagctgcttcggattagatggttcctcattgttcagatttcgacgccggctctttgatctacacacttttgtgacaggggaattggaagcggaactggagctgccattgctgtcacctccgtccaatgccttcttcttaatcctgctatcatcgtcacttggtgttttaccaccattcccagtgcttgcggtggatgatccaaagaaaaagaaccttctcatcttacaaatgttcagaacatccgcagatccccacaattgaatcagtccctacaaggagcgaatcttgatcagcaaagaagtagcaacgagaataaatcttgtagcaactactgaatgacaccagatgatctgcaaatatacaatagcaaacccttgtgcgagggaggaatagccaataataataattaaacaggagtaacgaaccaagcaggaaaagcgatatctaaatgaagtttcaagcaattccacgtatccttttgcagggaactctgcaactaaaccacacatcaaactagtttgggccaggaaattgatcgagcaggtgacacgcaaggctaaatgaaaccaaaacacgccagcaaagcatcaacaagccacaggagacaaacctaaccccagaattcagaagcaccaaccccttgatttggcgcttgatcccggacgcaacaccaaatccaaaccccagaattgagattcgcaaagcacccgagacaccaaaaacgaacccaaaacgaaacgaagtcgcaggaagggagaggaggcgaacctctcgcggcggagggagacgaaagggaagtggaggagcgtggtggctttgccctaccaacggtcaagaaatttggggaaaaatcaaagcaaatcatacgcattgattgcgatttaacgatggagacgcgaatccgggggaaaaggaaaagggaaaaagggttttcaagtcgaggtgggagcgggacgggaagaggaagaggaagaagaggagcgtcttaaatgggccaggccgagccgaatcgcttctgtgggcttaattggttagatgggccgtagcggagtaatgatgcgtcgagagggaataagttcaccagaggtccctcaacttcacagcgagatttttcgaggtccatcaaccacaaaaccttctgcccctaaattcagtcaaaccgttcaccaccggaggtcctttggcagtatttttgcccggttttcctgacgtgacatactagtcagcaaaaaaattaaaaaaaatcatacggctcacatgtcagcttcacatatctctttttctcctcttcagtcttcttctcctcttcacttttctcttcaccggcggagcagcggtgggcgagaggttcggctgctggcggcgccgaccagcgacgcaagagaaggggagggcgtcggcggcggcgggaggtggccggaggaggaggtcgtcggcgagcgcgctcctggtcctgctctggctgttgatgcggccgggaggtatcgccgatataggggctcgtcgttggtcgtcgtcacgggaggtatcgccgtccgctggggatgtcaaaatgcagagagttcgtgtcttagaagacggccatgagcttggcttctcccagcacatgcccctcgatggcgtccatcagcttatccttgatcacctgtaagcaatcaagaatcaatcacagttaattaatccttaaacagcaaagataatcgctaaaagattgttcgatcgacttgccttgttgccgaggtgcacctcgtcgtcgaggacgtaaagcttaaactggatgcggtggccgcaggagggagggatgacgacgacgccggccgcaccgccgaggccgcgacttgcgccagggccggcgccacgctcgcgccgagcggccgccagccgcgcctagccgcatcggcgccgccgtcgctcggccgagctcggctgcatcggcgccaccgccgccgcgcctgcgcagtagcagccagagcaggagcaggagcaggagcgcgctcgccggcgacctcctcctccggccagctcccgccgccgacgacaccctccccttctcttgcgtcgctggccggccccgccggcagccgaacctctcgtgacccgtgggccgtggctccgtgctcgttcgccgtccgcttcgcccgcagcccgcccaccgatgctctgtccgccgcccgctccgcccgtagctggccgccgctccactgccgcgctcgcccaccgccgctccgccggtgaagagaaaagtgaagaggagaaaaaagatatgtgaaggtgacatgtggtttccacgaaattttttttttttttctgtctaggatgtcacgtcagcaaaactgggcaaaaatactgccaaggagctcgggtgaacggtttgaatgaatttatgggcgaatatttctggttttgtggttgagggacctccaaaaaatctcgctgttaagttgagggtcctacgatgaacttattccgcgtcgtgagcgactcggcaagtgggcccgtggcgacgcgccacacacacgcacatctgcagttactcactcctcttcgccgtcgccattgctgagctgctgctgttgctgtggctggctgataggcgacggcaatggcgccctcctccactcctcctccgccctccccgagccgccacctccttccggttttctctacacccccgcgtacccttctccagtcgccgcaactcacacagacacagtactgcatccaagacggacggccgtgccgcgcaaatttttcaccggcgaggcggcgacgctggattccttcgccgtccaagtccagccatccggacgctatccagacaggttctttcttttctttttcagattttcttgtttatattggagtaatctgctagcagaatggatgagaactggttggcttcttcctgatccctccaaaccctttcttttggggggagtttgcttgacaatatgtatatagtctcttgtcgacttcaattctagcacatgaattaactatggcagttacaaaatcatgcagaaggtgatcctaccaccaacctgtggtgattggtctcaaattttcatgccctagtaatctctgcacagctttcagtgctgctgctgcccttcaaaatgggggtggcgccttctaagattgaggatgatagggccctcgtgttatgccaggagaggaagcgtttcgtcagagaagcaatcgacggaagatgcgcacttgcagctgctcactgtgattatattcggtcactgagagacactggctttctgctaaggaaatgttttgaacatgaagcatctgaagaatcgataccaaataataaatcgccgtcttcttttcaggccagtcatatgaaagctgccatgaattccattagaacttatctggagaaggtggcaactcctgtgacagtgactatggtcagtgcctcatctcaagatcctactggtacttcaccattggaccattttgaccaaattcacccaggtgacaaccagttttcacctaaagaaaaggatagatctggccaatgtttggacaaggtggatgatcctagacccttcctagaggagggaatcccagagctcgaagaggaaggggagagaactccttcgaatgaggaggatggttttgcagaatcaaaagatgattttgcaaatgaggaagagaatttctctgaatcaaatgatgctttcctcagtccatccattgaaacgtttgtgccagtgtcaaacagcaacgacgtgtctgataaaaatagttcaacagacaaggcacctgagcatcatggtcatggaagtgtggcatcaaaagatattgctttaccaaatactggttgccaaaatgataacccccaaaatgagaggagaatgactgacattcacacaaatgaaaattatagcaattctgctgtgtccccagttaatgtcgtaccaccttcaggtgctgcctttcctatggtctcaaaggaaccgtatccttatttaagcatatctgtgaagggcctatatacaggcatggtagagattgagagattattttccagagcttgtgattcgggaaaagaagtcacaagggttctcgatgaagataaattacagtttcgcgccctactaccacaagaaacaggttagatatcttgcaatgcttttttctgttgcactatttcttttcatatcttctcttgtaatttgaggtgcacaataatttctggcagcgcgtggatcagcatcatctagttttctgtcaacattgtttgcctgctgcagggaggatgtccctcttcctgaaagtaagcttttttttccatttattagtatgaaattctatttcctgcactgctcagccctatgtactccttttttttatagacatatgacatatcacatggaacttgtaatgtttctgtgtaattgttcttattgtcatactcctctattgtaatagatgatatcatactctgctattgatctcatttagttttgttttttttaatctctcagctattgcattttccttatattgtaacaaatggtgtctcatatagtcatatcttagagtcaagattgtccgtcgtaatttgaccttgctgtttctttagtgttctattttcctgtgtaaactgtaatacctgtgtgttcccactgtacaatgaatttaatgtaccatggtataatgcagctccttctcaagctgaggtaaaataccttacctggcataggtcagtgtcttcacagttgtcgctgtctagaaatcctcctggggctattactgtcatgcatacctcaacactagataaactgtatgcatgggaggaaaagctttatgatgaagtcaaggtaattagcttttttgtggctactctatgtgaaatacctaaatcttttaattttggctgacagtttaatccattttgatttatgttccacatgtctgattgcttgtcacaacatgactttcttttccccgcctttcagaaaccatcgaatatacattgattcttctgattaatcccttagctggaactccctacattgatcgctagaattcatagatagattacttgcttctttaatcatagaggtttcagatattgtattagtcagagtttatgcagtttatgactagtggtagtgattttttgtcaagaatgttcaaataaaatctgataattcttctgaagtttcacaccaaatgattatcatgattctgctttcaggtcaacagtgccatatgcaggagatatgatgagaaatgcaagcaactgagagaccaggagtcgagagggaaaaatcaaattcttgttgattttacccgcgctactgtaaaggatttgcattccagaattctagtggctattcagaaaatagacttcatttctaagaacatagaagacataagagataaagagcttcaaccacagttggatgaactaatcagaaggtatatttgccgattcagtttttatagaataatttgtagtttgatgtgcacaagaagagagtattgtgtgcttgagtgtcatgcattgtttcaggattttctcagactgttttaacagaatgcaccaatcacagtatgcagtttgcattaaactgacagctatataaatctgacagtgtctgcctgtctttactgtagtttaactaggatgtgggaaacaatgcttgagtgccatcatcttcaacttgcaatcatgaagctagtatccagcaaacggagtgtaaaattatcatttcagtcagagtctgaatgccaagatgcccttctcctctcagctaagctaattaaattatgttcagacttccaaaactgggtggcatcacacaaggtttacctgtctagccttaacttatggctgcacaagtgcatgaaaccgctgaagaagaggaagggctccaggaagcaaaatgttgttgatgtttctctaacagaatgtgctgttgcacccatatttacaacttgcgaaatctggattaaattaattgacgatttactgaccaatgagttggtgaaagccattgaaaatctcgttgcagatgtcggccgttcctttccgcaccaagagcaggtgctaaatggtgaaacaggaggagaaatcctgagaaataatgcccctgctgatgtacagtcaagtctgatggcattcttagagaagcttgaagccttttcagcagtttcactgcagaagtatattgatctgcagaaaaacatcgacgaggcaaaggataggttttcgagagaagattaaagtacgattgcaagtagctcaagtgagctcttagtaatatggccccccttgagttggatgagtaaaatgttccatatgtaaattcctggttgtgatgatattgtgtatcgagtcgttttgtcagttgtaaatgttttgtgtagtctctggtgggagtatggggctacagttaagttagaaacatgagaggacaatacgctgtaagatactgatatgaacatgatgtatgcaccatttttccagaacagttcagtgatttgtcaatgtagcgttgaaagctaagtctccaatctcatgaatttgacgaagtacaaatgatcagtatgaagactttatgaaagaacaagtcctcttgatgcatattttagatgataccatcatcatccatgtagggaaaaagttatttctgtcaaatactgggtacctgttccaatgccccagcacccagctgggcaagtgatgtgagctgaaagcctgaaacattcaacttgcctgacagagcacacggatgcctaactagagtggcattcaactgtgatgcagattgctgctttctcattataatacgggaagggaatcagaccatgcatctgacctctaggaaacgaacaaacaggtcgagcagattcctgcctgtttaccctcgagaaaggacaaagccaagctgatccatggccaaagtcaaaagccatttgcactcaccatgatgcagatgcagtgttccttccctttgtttctcatatatacaaacaggcagcttgattgtcgagtcccctagctgctcaaactgaaaacaaaagaatactggtctactgtttgctgttcccaatatttattttttttcagcatatgagaaaatggattaggagatgtcatgctgttgcttaatttaataatgccagtgttttaatagcataatgcaggagagaggcaggggtttagaaaggtacaagcaacaaccatgcaaaaaacaaagctctgggccgtacccagcagctttccatgttctgaatttttctgatgaggcattgacctagggatagggacgttctcgcagcaaatacattacatgtcaaagggaattatgcgacaaggagatggtccaagcttaattgctttataattcctagggaatccggcatggttaggtacagttattttagtttttgtgtacagatgattatatatcttatatatactcctagctagcaatctttgttaatctgaaggtgttagttcagtatattctgaaacatgtacgactgatgctattacaaggaacaagtggatgaggagcaggtgtgataagtcaaaacagcctagtgtatcatcacatgaagagagctctctgatgatgtgcatggaatcctttaaataatgcacagtggatggccacagcatggtgatctcatcatgccctcactacttatgtcatttcttttccaatctaattgccacacattttatcttttgctgatgaaaatgaagaggactgatgagagtttcaggctgtctctgaaaacggttcaagtcagaacaatcataccgtaattttctcccttttctgcttgatcagcattcaacaacggatcgcattctggatgacttggattacgtagatcattgaacaagtaaaatacatctccgatgtcaaagtaggttttcagctttgcagttgaaactgacctatgcaagatgtgctgattagtgaggtaatactacgagctagtggaagtaatcaagtgtttgatggacccaatgacacacacaaagtcttcgaaagcactcaatcacaagggaatgcctcatgggatgtcttgattaaactaatttagccatgctcctacctctcgatcggtgcaaagctgctgcaacttgtggatttgtagtagtgttgactgctagcttgtgggttcgagattaattggagtgggtggctgctgaactgttttcaacgctgacaactgccggaaaccgtcaaacttgttcagttttgtgtaggagtaatctataagcctccgtccatgctgtcagctcgcctgttcatcctgtgcgcctctcgtccctgtgtgctgccatatgctgctggtcagctactatcgcattctcagaaacctgacgaatggcgatgcagtttgttcagagaacatctgtccacgccttgtttgagtgttcagactgatttccgtagtctgaatcacagtgttcagaaaacgaataaggctgtcagaagcattaccaaattgccctttcctgattactcatctaataatttcctgattgatttacagccttacgcaaatatgcacatgacagcagagcacagtggtggttattgaagaaggggcatggaagatgtgcagtcgcattttgaacacacatttggacttgtgcagaggtcaacgaatggtacagcatcgatgaggattacgcaatttggtttgagctcaatgtcgtcgtcgcctcacgagaccgattccatacagttgcagggtttgattattactattgttttttattcggtggacagacacagttacagaatacaacatttttctttttctgaaactgaagattatagtattaaagagctagagctggagatactccatataggcatcgtggaatcattcaaatcgttggccggtggtccttttcactggataggtgaaaactgcaagctcactcatttacactgatttacagtggacgcatagaatcaccgtcagaaaagaaaaccaaggaagaaacgaatattcagagaaacgctttcaggtaaagttggcaccgcaccatggacagaacgaccgatctcctctagatcttggcagaataataatctggtgcagtagtgagtaataatatatctcatgcggttttgtttggtgacgttacggcagccaatataaagaagagatctttaaactttttctctgaaagaagaaagaggaaatctttaattaggtaatactccatccgtttcaaaatgtttgacgccgttgactttttagcatatgtttgaccgttcgtcttattcaaaaaatttaagtaattattaattcttttcttatcatttaatttattgttaaatatatttttatgtaggcatataattttacatatttcacaaaagtttttaaataagacgaacggtcaaacatgtgctaaaaagtcaacggtgtcaaatatttcgaaacggagggagtgtggtttaggtgctagagctagcatcgatcggaggtggatagatggatgaatggatgcagagtgtgatggacaggtggattgtgattctgggtagggcaaatttggccatttttgatgagcgaggttgatcgagaggggtgtaggggctagctaaggcaagctaagctaaggtggagtgtagagagagatctttgatgtttgggtgggtaagggagaaaaagaaagaaaatctggtgagagcgacaaggagcccaccccctctaccccccgctattcccgcgattgtactgctgattagccgggaatggatgctcgatctctcatggataatttgcacatataatgtgtgctactgctgcctttgtttgttacttacatatgctgctgattgctgctcgatgaaaaggatggaagaaaataaaaaaagtttgaaataaattgtgtagtattagtggattcgactccctgttccttctggtctcttggcagttgtggaagaagcggaacttctgcagcctcatcttttcgcttatacttatgtttatcagccaaaatttgaatttttaacttcaattttggagttgattttgagggtttttttttcatcgaagtttatttgtcaacctttacttttagatcgttaagaatatgtatataaaagttgtatttcacaaattatttttcgtttgcaaatatgttgtttcgcttatcccccgataagtgaacgatggggctacagagttttcgactcagccgtctcctcggtctttgtgcgtgcttgtagtgtctgtccactcagaaggtcgtatgcggtattccgctggtataacaacttttaggggattgctgtgagtgtagcgtggctccgcctcctatctctcgtttgtttggagtatcctttgtttcatagtagcctcttggtttttcgtccttcccccatcccggcataggcctgtttagtcgattgcgttgtgtaattaaacttaatatattaacgtgtaatcttttacgcgttcacagaaaaaaaaataatattaagtggatgcataggtgagacgttggcaagcatattgcggccgacagacagttgaaaggtcgtgcatggcgaagagaagagactgttgctggcttgctcgcttggccagcagcacagggatcgagcgagttatacctattccatgctcgctacagttagtacgaaacacttggcaattaatcaattaatcagcaactagtactccacatgcatgcagttgagttacctgaaatcgcgaaatggcacagcatcagcatgggctcccaaaccaaaccaccaagcgatatccaataggcgatggatggcatatgccacatgccaccgtcgcgcgtcgacagcgccaccacgcgatacggcgcggcgcggttggcggtggcctccgacacccagacaaaaagcctcacctcaccctcacccgcacacgccgacaccccgacgcgttttccactgggtcccatgggccatggcctctctctatatactcggcccatccccgcctcctcctattcccaccttccacctccacttcctcctctcatcgaagctagctgatctgccatggacgctctctcctgcctggcgccgcacgccgcgctgctgccgtgcgcggccttcaccgacgccgacatcacgcgcgcgctccacttctcctcctccatgcccgacacctcctcctcaccctcctcatcctcctccgcggccttcctcgccgacttctgcggtggtggcgccggaggagggttcgtggtgtcggcgccgccaccgacgatgccggcgatcacctgcgagtccgttctcgtggccgacagcgcgcgcccgtcgccggccgggcctgcgcggcggcaccagcagcagcagctggggctgggccccgcgggtgggcgcgccgggaagcggcggtcgcgggcgtcgaagcgcgcgccgaccacctacatcagcaccgacccggccaacttccgcctcatggtgcagcacgtcaccggcgtccaggccgaccccgcctccctcgccgacggcgccgccggcatccttcccaccaccaccaccactgcgccgttcgacgcctcctccggcctccacatgctcgacaccttcgccgccgccaacccgctgctgcaagccgagcaagcggcggcgcttcagcagcagccgtgcttccccacgctggactcgtcgtggagcgccgtcatgtacgatggcagcgacctcctctgagcattccttcattcccagctgctgctgctgcactgcagtgccaacactagttaattaggacgccgccgccgacgacgacgacatagctagtagatttcttgctctcgatcgcagtggccggcctagctagctctacatcgatcgatcaatccactaccatttcttacttgattagtttgtcgttggagccaagatcgtatcgatgatgctcgcttgatcaggttaagttgttgagttactgtagggtgttactactagtattattgtacagctagcgcattatgcatgtcatgtcgtcgtccgtcggtcaaacggagtgtggctgctatatatgcccacattttatgcagtagtagctgtctatagctgatctcagttaatttaatttgtactacgtgtatgtcaaagctaattagtcagcagtaaaacatcagtttctctcgcaattaatctggtgaattctagaatgcatgctaaccatcgtactactttcgtttcatattacaaaactttctagtattatcaatatttatatatatgttaataaatctagatatttatatatgtctaaatttattaatatctatataaatataaatataagcaatcctaacctgaaacggaggaatcacatgcatagacaacgacttgctccgtgctggagtaattcattggctcgcaagacctgcgtgttggaggtagttgcagctagcttccaaacccacgatctggacatcattttggatttaagctatatatctgcaggttaattaattattattagtcgcaagaatgaaagatcgagagagatctgttaaagaataaaatatacggtaaacgagcgtactcaattaatattgccgcctttttgataattgaaatgagcacgtcgtgggtcggtggaattgacctggtcgcaccatggatgctgctgcttcgtcatcgacagacggatcatgtatatgatccgatcgagtggagatggaaggccgaggggtttgggccaggcccattcagtctcttgccgcctgtactaggcttttctcatcgataatatatgtgggcccatactaactaaaaaggaattttgcactatttatcacaaaacttcatgtattttacactatttatcataaaactacagatttaagagcttgtttcacaaaattatagatttagtgtctctatttatcacaaaactatatgtattttgtacaatctatcacaaaagaacatatttaagaacttgtttcacaaaactatagatttagtgtatttgtttatcatagaactacacatttagtgtcttgatttatcacaaaactacatattttgtgtctccattatcacaaaactacatgttttaacctgtagttttgtgataatgaagacaataaacctgtacttttgtgataaatgaagatattaaatctgtagttttgtgaaacaagttcttgaatctgtacttttgtgatatattgtgcaaagtacctgtagttttgtaataaacaaagacactgaatctatagttttgtgaaacaagttcttaaatctgcaaactttaatcagcctaaaagtacagatttaacaccatatttttcataaaattgtagattatagcattgtataaaaaaatgaagattaaactcatttctgttacaaagctacaacttttataactttaatagggctatggttataaactctaatatcggtagttctttcataatttcatcactaaatatataactttgggatacgattccttaaatatatatagttttgcaatagtttgtttgaagtacttgtacttttaaatttactcttttacctctcgccgaacaacacggccccggcccatgataattccatcaaacgaccgctttacaccggaattgctatttagtgcagcagagttcttaactcattttttttccattcataaaagttttcgtgtgaacattttttgaacaaaagtattcgagacgaaagtttaaagaaaaaagaatgcgctgggacctgggagcctggaaacacaatcgcgctaaatagcaatccccttcacaccgagatgaaaaagtctgcacattaccactgagaaggcccacaaataggaagcccaaaacctttttgggctcccgccaatttagcccatcggcgaagctgtctccagtccacttgaccacttcccagaactgattttattttctgggcgaaaaagaaaaaaaagaaaaagaaaaaaggttcgcgtttctctctcttgggcagccatggcgtccccgcggccgccgccggcgagcctgcggagcttcctggacgcgcacttcgcctcccccgaggacctcgcctccgcaccggcgctcgctgagctcctgcgccgcgagtgcgtgggcctggatgcatccctccgccgcctcgaggcgcagctcgcgtccgtatccgcctcctggctcgcgcgctccgccggcgctcgcgcatctctccgccgcatccgctcccgaggttcgcttctctgaaccctagtacggtttttgtcccccttttgtttcgttctggatttgtagggacgctcactgttacagtattattgcttcggggattccgctcgggtttcaacggattttatcggtggtaggcgggggattcggagtggaggaggatgatggcgaggagacgctgcggagcgcggagctgccggcgcttgtgcaggagatccatcggatcgacgccattcgactctatgcgggtcagccttccttcgtctcttcgtgctttcctattaacttgaaaattccgatattggatagttacagtgctaacttttgcaagttaatttggattatggggtcactccgattttagaaaaaaaaaagctcttagaatttcagtggtgttttacctgccaaatcagttctgagttgggcaatagcaagttacgcttgtgtcgagtaactggaatgtcccaatcttggactagttacaatattaaatttgcaaattagtttggtagatgtagttgttacctactaccatattagcctgtatgcttgagcattgagtaacttatctatgcattgcaatatggatctcttgatgaattgtttcttcatacttcactagacactaagtacttccctgaaataaggcactagctacaataacctggcaatgcacttcacgtgcccacggcccacccaccactcaatctcaaactactgtaacttgatgatgtcaatggagaatatctgtgttaaacaaagctattatcaacatcgagtttttttctcaacaattgttacatagagtcaggggcggaggcagcattttagctagctgaaccatatagctataaattttttgtgcaaattctacgtaaatttcagtgtttctccattgaaaatttttgccacgtgtggggcccaagcccaagctgccccacacgtggctccgcccctgcatacagtgcaatgttgaccatgacctttaaactgattaacgcggattacctgccagtgatctccatgggaacatgccatttgcgctaaagaatttgtttggtgctgcaaattatattatgtctcctccatcatatccggcatgatgtaggaatttgtagtaccttctgtaacttttctatgctgacattccagaagctgctctacagttggaagcttttgttggtaacctagaagatgcaacgttttccatcgttagacaggcctcaaagttgaacttgtcctcggtatttaggccagcatctaatgtgagaagctgagaaaccttctctttcctttttcttccttaattgttattttaggtacaacctacaattattggtcatgccgatatgacgtctgttagcagtatgtttgtttgatatgttaatcacgcttttttttctctctccaaatgtaggaaatgcaatggaagcaagaaaagttgtccaggctgttgatgccatgagggatattgaactagagttgctacggatcagcacgaataggccacaatggaccaatcttatcatggctgttgattctagagtggacaaaaccctagcaattttgagacctaaagcactaacagattatcgagctctacttgcagcacttggctggccaccttccttgtcttcaccagatgcagcaaataataagtactcggaaattccaaaccccctcatcttaatgaatgaggcaaataaagagaagtattcacaaagttttctagcactgtgtgctctgcaacatgcgcaagccaactgtgaagcgcgtcaatgccaagcgaaaggagcaagtgctagcatgtcagattcaaagtactttgataaaactgctgcatgctttgataatggactttgggcaattgatgagttggttcagcctattgcttccaggttggaatatcattttgctaaatggtctgaacagccggagttcatttttgcccttgtttacaaaatagcaagagattttatgggtggtgtggatgatatattgcagcctttgattgatcgagcaagacttgtgggattgagtgctaaagagtcttgggtaactggaatggtgaaaatgcttctaggttaccttgagaggcaaattttcccagtccttgtcacatcttatcaggctactgatgacaaatttgaagtacattcctcatggatgcacttgaatgacctgatgattacttttgataaaagaatgcagttgcttgcagattcaggaatacagaagatagcttcaatttctgaaggcctgtccaggtccttatctgtcttttccatatatagcgagcattctgattggcttcacatgtgggctggtgtagagcttaattctgcacaacataagctcaaatctgagatggaggatgagataaattggtcatatagtattaaagagcttggtctacaagagatcactagtaattttcttctgtctacaagagaagattacaaagctccaacaatttctgaatttgtggtcaaaactgcatctgctatgattgaaagaggccatgctctgccaaataggggattaaggattcagtataacagatcctcttcagtccagttcctgagtgatttctttcttgtcttacgtgaacgatgtgaagccctacaactgacaaatacagctttagaagatgattctttactaaaagcttcatttgcaattaatgctgctcgatattgtgaatatgttcttcgggaatgggatgacgacatagttttcctggagatgggtgcccataggaaacatgttgatgaaggccagggacaaggccacaaacacagtgcccaacatccatgttctttctttggcgatgaaatcgccttcttggctaaattggggaccgattatctggaacagattatgtcttccgttctgctcgagtttgaagatctatcctgggactatgtccaaaacattggattgcccaatgagcagatccatccagttgatgaggtcctggatgaagaaaatctcggagtatctcctggatttgttgcctctctagaagttgtgagagacagaaccaccaaactgatgctacatcttaattcgaaggatttccttgatctgtggaggagtatagcagaaggcctcgactacttcatctacagcagcatacgatggggggagttgacattctctgaccaaggagttgtacagctaagagtcgatacgaaagcccttctccacatctttaggcccttctgtttaagacctgaagccttttttccattcataagtgattccctgaggctgttagccatgagaaagacagatgcacgatacctgttggaagtgctcaagaatgccaaggagaatgacagttgcctgaggcaacaaggactgcaacatgtaaatgcaagccaagctatgaaaatcttaggtagcaaaaggtctgatggataatcttcttaccttagcgtagaagacctgctggagatgatcagaatatgattttgcctatgctgggctgctctatgtcactatgatgacggcaatcttctgcctgtcctccttccaggaaacatctcttctgagaagtttaacacgtggttagtggttaccggctgcaattccaggcccactccaaggataatgcgcctgttggaacgcaggatagcaaaacagtttgcgtttcaagattgaagagacttatctggtgttcgcagcagcttcgcgttgaaactagttttggcatgtactacattctctccagggtgatgagacctgcgagtcttggacgacaaattggagatggccgctttgcaacgcaaaagtccgccgccgccgccccctgtttatcgcttctttgaccggctcgatcgtaatcaacccaaacacatcatgttgcatgcaaagctagcagatgtaacaacaaaatattcaagatctcgtctgcctcaaattctctgagtaatatagtcaatgttcaccgtctcgcagactatgattatgtcgcatatctcatgtatgccgtgttaatcctgatccgtaccttgaaaaaaaagattataatcttaatcttgatctacctggtcaccagttgcatgtacataaataaaaccgccagatcgctctcctttgactccaattgtttgacgcagcgaagatacgaggatccgagcgtacagtgcttgcagatgccaatctatgacacccattaaaactcattctagtttgactaaaaatttgtttctatgtttttggtttcttcccagttcgactaaaaaatgtttttatgtttttggttccattccagttcgactaaaaatttgttttatgtttttggttactcctacttggaggagaggccaacacaaaagaaaaggttgtttttatgtttttggttactcctgcttggaggatagaccaacataaaagaaagaaaatgtcaattagaaataatatttgctgatcaggtcaagaaagatgagcaggagctcatgttgatgcacatgcatctgactttgagcttgcaaaaatgtagtttcttctttctctcgaacacagaaatgcagactattgataatatattttattgaaccttgtgagatccatgccctgaatcctgcattctacggtcaaagcccaacaatctgtagaagatgtgagccagtatctatcagtttgaatgtgtcaaaactgaaaagcaataatcctgtcttggtaaaactaactgcaggacaggagctattttgtgctagttaccggctacaagcagacagatcttcaacaactgaaaatgatgtgatagtgcacattactaacctttttcacactaatgtggatagctactagaggactactgattgttctgttcttgtcctttgtgagcactagtttgagctgttactgaatcacaccttttgtttcttccagcactgtactctgcagttgacaaagtagcaaattttgccacctgtttcagtgttagtgctgtatgatgctactagtagctgctaagcaataaagtttctctccgaaaccaaagaaactatctttttctgccaacatatgtattttttttcttctacccaacatgttcaaagttagaagctgtcaaagacttgcacctaatgcagttcccattatgaaccattagttttattaatggtgaatgccttgcctgcatcaaattaattgatggtgtttaattaacagggaaggctacatctaattagaggtaattaatttatcagcactttggttgactgacaaaactggaggaagcctccaagtaggcatctagtactagacatgtactcgtagtcagtcaactgacagtttgatcagtcatctctatcccttgaattctttgccttcctgtccatatattcttccatgcctcccatcacaacctaagaccatactccattttggagttcgcagcaactgctcatctgggattgcagttgcaggtgatcaaggattaagaggttcatccaaaatggggaactgcatgggctcatccaagtgcgccagtgcatcggctccacttgaatcaagtaagatgctactctgatatatacatcatatttctgttcgtggtttgattagccaagaaacatgatgaggaagaagcaatcaaatagacaattagcagtatccatgctgatctatgtaatatggtttgaaaattattcagaggttacgagaagcagcaactcgacgacgacgacggacaacacctccaaggcatcgcagcgcagctcgtcggcgttctcgtcggggcagttctcgcgagccagctccgacgagtcgtcggcggcgccgtcgctgtcgtccctcaagtcgttcaacatgggcgacctccgcgcggcgaccaagaacttcggttccaactcgttcctgggagagggcgggttcgggtgcgtgtacaagggttggatcgacgagctcaccctcgcccctaccaagcccggcgtcggcaagatggtcgccatcaagaagctcaagaaggagagcttccagggtcacaaggagtggctggtaattaattaattaactaactacacttactaatcatttcaacttttcattgattaattaaccttcgatcacttgcaggcagaggtgacctacttggggcagctccaccatgagaacctggtgaagctggtgggctactgctcggattccgacagcaacaagctgctcgtctacgagtacatgctcagaggcagcctcgagaaccacctcttcagaagtgagtagtatatagtacactgtacactgatcaaatcgaatcgattcttcaattcagaagtgaatgtaatggatgttgcatactgtatgatgcatgcaggagggacgcagccgctgtcgtgggcgatgcgggtgaacatcgcggtggacgtggcgagggggctgtccttcttgcacgggctggagaaccccatcatcttccgggacctcaagtcgtccaacgtcctcctcgccggcgactaccgggccaagctgtcggacttcgggctggcgcggaacgggcccaccggcgacaagagccacgtgtccacccgcgtcgtcggcaccaggggctacgccgcgccggagtacgtcgccacgggccacctctccgtcaagagcgacgtctacagcttcggcgtcgtgctgctcgagctcctcacggggcgccgcgcgctcgacgccgcccgcggcgccaccgccgagatgctcgtcgactgggcgaggccccacctcggcgatcgccggaaggtcaaccgcatcatggacaccaggctcggcggccagtatcccaagaagcaggcgcaggacatggcggcgctcgcgctccgctgcctccaccacgaccccaagctccgccccgccatgcccgacgacgtgctgccgcagctgcgcctgctgcagcagaacaccaagccatcctcctcgtcgacctcggcgccggcgcacaggtcgaggccattccaagcgctagcgagctagctagctaggcgtcttgttaattaattacttcgtcatctctcaattactccagtattatttgtttgtcaatttcatgctagcatagtagcatgtggtgtctatacagacaaaagaatcgatgaacatctagctacctagtttgtaattagttaggtaggagatatatatcattgctgtgtgaaaattgtgaattatatattgctagctgcaaattaagtagataatattattatagctaggttcagaaattccatgcatttgtgtgcatcatcagtatagagacgattgaggatttgtgatttgttttgacactatgttcttgctttcatttccttttaccatcaaatgaaggctttgtttgctcatgccaatctgttgaacttcaattgattaattacggacgctgttagagtttttatcgaatatgtgtacagagtcggttatagttcagtaattggagttgtactaggtatatgaatagagtaagagtcagaatctatcctataatctcttttaaatagagagacggacctgttgtaacctcatatcgacttagcataacgagagagaatagctgccggtgacggccggctgtgagccgttgtaacttgtaactttgataagcgctataatatgctggatcggggaggagcgcctgtaatcagtaccccgaagatataggcttcggctgaacctcgttaacaaatatcatatctcggtatcgttattgtgtttagatatcctatgatgtttcttccgtgtttggtgagccggttttataacagacgcttctccttcatatgtggagtaattagcagcttcaaaatggttcagtcagcgctcaagacgtgcacgctacacacaattagcctagtcatacagcataaatcagacgacaatcagtaataatattcggatttgctgcctcacttttaaccgtgcctaatttcgcatcttcgcgctttcagaaagcaagaactgattaacaccactattacgatatctgtctaactttgttaaactggtcatgatctcgcatatatatagatggtatccacacactttatactttcaaaggacagtacgtattcacacactcaagtttcaaaagatagtattcacacacgaacttggtgatatattgactatttgactagagtcatccatttcatcatgattgcgcgccgtatgttgactaaaatgacaatcacttcctgcaataacatacacccttcatcctaaaaataattaacttttagaaatatatttgaacgttgtctatagaagttgtttttttttttgacatatggaatacgaagcttcttttgtagatcaaaagaggatccgcttcttttttttcccctagacaatatggcatagcgaagaggtagagagttaattcagtgcattataaggaaaaaagacagttaatttaaatcggcgactctgttagggcatcattacgagtaataaatataatgttcagtgaacaagaccactgaacttaactctgtatgatcactgaaaggaggacaattgatcttgagtagagattcgatcaatttaggcccaatggattacagagaggcctaattgcaaaaacgagcccattaggcagtttgcatagacggactgggctttgcattttcgccgggcctattgggcttttcttaggccatcatggactggcccacggaatcactcccgtcactcctcgagtccggcggcagcggcgccggcgctggcgacggccacggcgaggcgtatcggtattggggagcggcggctagagagaaggtggtggcgagatgcggcttggccacctactcggcgtccgccaccgtggcggtcatgcccaagaacaaggcctagggaagcaactgcggcgaccggcagtgccgcggcggcggcagcgagccgtatcggggacgccacggcttgagaggcggtggcggtgagatggtgaggttggccggctgctccccacccgccatcgtggcggacattccagtataggtacggcaaacctatgcacaaacaaataggcaactatcttgaatcagattcagactgatttccttcagaattaagccaagcaatcaagca

SEQ ID NO: 44460 - DNA, 10533 bp, Oryza sativa
tgatgatgcatgcctcgatcgtctatctcatcttgtagtgcgtttcggcctttcaggcatatatatggaccgtgcattgagttggtgtgagctgcgagctcattgagcacaatggcagtgcagagaacagatgctgcctcttggctccgtgagctggttcttgtttacgccatgtgctggacagtctcactgggttttgttgcgggtcaaaccgggcagttgaatgtcgatgcctcgccgcagaatgcaaggaagatccctgataagatgttcggtatatttttcgaggtgagactgaatctggatattggtatctgtttagaacaacatttgttttctcactcaaaaagaaaatagaacaagcatttttgttctaaccggtatacgaactaaaagggacaattacttgtataaacttggtgccagcacaaacatttttcctagttgtagaccatattgttcagatagcatttctagttatttactgaatctcatacaattaaagtatgcactgtttggaacacagttattttctcctgatttgcaacattttcctatatatagtacctgcatatcaaatgaggttgcttcgacttctattccatgctgggagcttgaatatatttgtggttctacttgtaggagatcaaccatgctggggctggtgggttgtgggcagagcttgtaagtaacagaggtaaggcaaagcatatctgtgttaatcaagatgatagaagttatagaggagcttgtaagatgataggaggaacagcggtggttgggatatcgtacttttgcttaatgtttgtagtgctcaaatttatttccaggttttgaggctggtggacctaatacaccttcaaacattgacccatggctgataattgggaacgaatcaagtatcattgttgggactgataggacatcctgttttgagaaaaatccggtggcacttcggatggaagttctttgtgattctaaaggaaccaataactgcccttctggaggtgtaggagtctacaatcctggttattggggcatggtatgatgtgtttcttatttatttatctgtccgtctacaattttttttgaagtttccgtaatcttatttgacagtttaaatttgatctggcgtgtatttaactgattaaacatcatggaatacactatatagtatttcttcacattttccagaatattgaaagaagaagggtttataaggtgggcctgcacattagatcttcagatgcagtatccttaactgtttccttgacaagctccgatggtctgcagaaactggcctctcacaccataacgtaatatttatgtttccattaatatcgctgggatgctgcatttttttccctaataattgcttgaatttccatgttgcttccagggctagcaagaaacagtttgctaaatggacaaagatagagtttcatctgaaatctagccaaaccaatactaattcaaggctccagcttacaaccagcaaaagtggggtgatttggctcgaccaggtgtcagttatgccatcggatacctacatggtatactttattcatgtctcattttatttcttttggtgtaccattatctttacttatttcgtgcttcagctgcacagttttgcagactattcatcagtaaacgccagtagacaactatgatttttttaagagcaaacccatcactatactggatggcccatatcctataagggaaattccttttttgccgggtctataagggaaattcctactgagttgccatcagatttacaggtgttttatacttatcagttcccaccttttattcattgttatgttttcattttagggacacggttttaggaaagatctcgcttctatgttggccaatttaaaacctcaatttcttaagtttccaggtttgccaactttacatcatatattttttttctgaagttaggtatatcaatattatcatatagttttgataatatgtatcaaacttaggtggtaactatgccatgggaaattatctgcgaaatgcatttcgatggagtgaaactgtgggtccatgggaggaaagacccggtcacttcaatgatgcctggggatactggactgatgatggacttggattctttgagttccttcaggtaattggaacgtagtccatgacttcaaaactaatatttattaaaatatacttcataagttcatattgatattcatatactgcagctagctgaagacctcggtgcttcgccagtatgggtggtcaatgatggtagttcaaatctccatggattattaggtacaactaacactctgtttcatgttgtgtcaataaactattttcaacattgcaggagcaagccaaaatgaagaggtatctactgcaacaattgcatcattagtgaaggtttgttcttccaaaatattcaatcctttgataaaacgatcaatctagtacatcaataccttgttccccatttccttcgttcttgtaatgttcaggacgtggttgatggcatcgagtttgccaggggagggcccaagactacatggggttcagttcgtgcagcgatgggtcatccacaaccctttaaccttgactatgtttcaatagggaatcaagaatgctggatgctctattacagaggtctgtagctcttcagttgcacgtccttcctaacttcataccaagaattgatgtttgaacttaatgcatcatattcctgtacttcatgttggaaatttttgttaatcgaataatgtcatgtttgtgcttgcagatgatagaccaagagtttccttttccttcttatacatcaatttttaatagcgttttagtcctctataagataatttgtaaaataatttcatctacctttatatcttgtgggtaagcagggagagctcatattatatgatctttcaattaacaggcaattaccaaaaattctattccgcgattaaagctgcctatccagacatcaacgtcgtgtcaagttgtgataaatccactatttctccgtccaaccctgccgatctatatgatgttcatgtaatgtctattcattatgttcctttccttgtttgttttcacaatttcgtgttttttccaaattatggtttcgtttatggctgacaaaaacatcatctataccacaggtttatacctcatctagtgatatgttttccagaactagtatgtttgacaatacgacgcgcagtggaccgaaggtatgctcaaatgttatccctacatctgatatacatagatacttccactttccatgctcagaaattgacttggggagctctatgactctttaggcaattgtaagtgagtacgctgtgactggaaaggatgctggcaaaggaacactggtagaagcactagcagaggcagcatttctcgttggattagaaagaaacaggttaataatcatactttttttagaggaatatttatacttttattttctctccatcatggatttctgctgtgtaagctctgccataaattggtccatgataccaaagatttgaaactgcttgaagattaaagctttgggcatcaaagggcagtgtgaacgaacatgcttccccttcaggctaccatgtctgggctttctgcatcactggttgattgcattgcaaagataaacattccgtaccttgttttcctgcagcgacgtggtagagatggcaagctgtgcaccgctctttgtaaatgacaatgatcgcaggtaaggatccaacaactcaggaattcttatttttcagattgctttctttgtgtcatatctgactgagttcacaaccctcaaaaataaaatgaaatgatgcataccatagatggagtccagacgcaattgtgttcaactcatggcagaactatggatgcccaaactactggatgctacatttcttcaaagattcatgcggcgcaacgttccacccatcaaacattcagatttccagctacaaccagctggttgcatctgccatcacttggcagaatagcaaagacaagagcacttacctgaaaataaaggtgcgaactttgttaagctgctctttgtttcagagagagtgagctatgcattggtttagcttggaaatgaccaagtgagcacaaagcgaaactttttttttttttgcagctagtgaactttggcaaccaagctgtgaatctcagcatatctgtgtctgggctggatgagggcatcaagagctcagggtcgaagaagaccgtgcttacttccagcgggccgcttgatgagaactcattccagcagccacaaaaggttagtacactacacactgactgacagctgatcatgtatcctatcctgtaaattaaacaaaacagatggtagtaactatattgaatgtgtacgaaattgttgtaggtggcgccagtgtcgagcccggtggacaacgcgaatgagcagatgggcgtgttggtggatccatactccctcacgtcgttcgacctgctgctgcaaccgagcaagcactcgaccatatgaaaggagatatatactgtagtagtaatagtcttaagaatatttattagcctgcaaaaagaggggaaaagagaataaaggaatgttgatggggggcttgattgctcaggctaactgcattgcatggaacataatatgcccatcaatattcttattcgattcagcccaagaatagagagatttaccaggtgagggtgagtcatccgactcaagaattgttgtttcaatgaaattcagattagctgacgttgcaccgcatctgggatcttggctggcacacagcatatgtaagtatgtacatacgtgcataccatcaccacctgctagtgctaggaagcttcctaaattccttacagtggcaatttccttggcttattaggtcgcataaagctataacataatggtatattacttgtcaattgtattgctatgcaattttcagatgtttggtgtatatatagctgtatacgcgtcacctaaagtgcacttattgtattgttcgatcgagacacccatatagttcaggctatttaacttactgaaggcgaaatctcctggaaaatacatcatcttagcttgcaatgcagtgcgttgattgattgaactaccgatagctaaccaggctgctgatcggcgaccgctgacaaaaatatgcttaattaattcccttgtggctgacatgatagatgacgtataaattaatgacctgcagaaatgcttaagattaattaacggcaaattgtatatgcttaacctccacagttgactgctccaattaaaattcagacgtgcgcgcatctgagtttactcaagtttttcacatcatcgtgctaagcatgacgtcatgttctgatgtgcatgctgcagatgcctaaaaatcaatgcatttgagatcgattcatgtgacctgaaaaaaatcaagctactccatccgtttcacaatgtaagtcattctagcatttcttatatttatattgatgctaatgaatctaaacatagcatcaatataaatgtgggaaatatatgtctagattcattagcatcaatataaatgtggaagatgctagaataatttacattgtgaaacggaggaagtaacatgctaaaatggagttaaacagcccggcgaaaaaaatggagttaaacaagctagctagctgcaggtcaaggcagttgtgttagcctatattgattcccaaacaattcgcgtcttcaatttcctcgtacctacgggcgatcatcatcttgttctcttgtattgcaaagctaagagagagaaaataatctgtcaatggttaaataaaacctgccatagttgcatgtatcacgcgacctgaagcctctacttgcacttctcaattctcagcgtctgaccatctgatcagtaacttatgaaaaatatccgctctgttcataaatgtaaagggatgatgttggtggtactttcaaatgtaaggggtgatgtattccctccttacagaaaaaaaatccaatcatgagtgatgtgtccagatccaaactcaacattgagtttttcttttacatatatctagatttaaatttagaattgggtttctttttggaagaaagggagtagtatttgacaggaatatgataaaaaaatgaaatgccaagatattgaatggacaaaagagaagaggtgatgtgatacattttttctactcaatattttaaaatcttttaaatttatggataaatgaaagaattaaaatccttatacttcacccgtttaaaaatataacaactcctaacatttaatgtttgtcccaaaatatgacaatttcttcataaatattttctgtctcaaccaattataatcttccaccattcaattttcttatctaccttcacttctcaactaatcataatattcttctatttaattttatctacttgcttaatactcatatttaatttaaaaatattcttatattctgtgatggagggagtatatttttaacggaggaacaaatggctggacgatcggatctaagtacggacagctaaaagttgatgtcagtgcatcattaaccattcttctgttcaacttaaacatattcaattccttgattaaattctgcgggcaagagagaggagtcgtttgctgcaaaaacaaaaccaaacaaaacagctacgggcccctgtctcttcccctgtcgtctccacctctcactctctcctctccactgttccggcctcctctcctccatcctccctctcccattctaccagttcttctgttcttgaatgctccggactccatagatcacccttcttctcccaaaggtatgtccagttcttcagcattagttcctgttccttctacctctattagttacgccactcgccggaggagaggaatgctgtttctcattccagatgcaagggaattccatttggctcctgactgcgattaactatgtctccagctgcttgcatgtgcagcattctttcggtatttcgttccattctgtcaaggaatacatggaaagataaaaggactcgattttgacctatttcaagggttcgaatatggcttgttttgattgaacatggctctgtgttttcttcctaatacatgaacaatgaacatgatgttttattatttgttagctagtgccttcagattttggtttctttttttaaaccggcgtctacatcctgaaatggatgtacacagccaatactttggtttcttgttttgctggttatattaggtcgattccatcagcgtttaatttctgcacttctgcaaatttttaggagattctagggactaaaagcttgcaccttgcagattagcttacagttagatttttctttcatactatttgatacaatctcagttggaattttcatttgcaatgaaatttcgtatttctactgcaatggattattgttttctccttttgattaatagctttccattcagattcaacataatgcaatatcttctgtttttctatgtgctgaccatcaaatggtcaagctttatgaaaataaatcttgtaatattccctgtcagattcagttgaagtctagtttgaaggaaggattttttttttttgactgaggaaagaattttttttttctggaagatgtataaggctaaaaggactgctgcccagaaagtaaggcgctgccttggaaaatatgagcttggacgcgcaattggtcaaggaacttttgcaaaggttaggtttgcaaagaacatggagaccggtgatcatgttgctattaagatccttgacaaagcgaaggttcagaagcacagattagtcgaacaggttattttcagagtcagataattactcacaatattttgttctactttcctagattttttgcaacaacgaaaatagccaaaagtatctagaaaaaaaatattcctgtgtacgcgccagctgtgctcatgccactctaaagtctaaactctattgcagattagacgggaaatttgtacaatgaagttgatacaacaccccaatgttgttcacctgcatgaggtaaatctaaagcatgagagacaagaatatatctttcattattaccatgttgctagtttgaaactttgtgcagtagtacacccaagccttctgtttatgataacttggattacttttgtggtgttttataacaggtgatgggaagtaaaacaaggattttcattgttctagaatatgtgatgggaggagagctccatgatattattgttagtactattatacctctgaggctctgatcccctgtatgacatttttcctttgcagtagctgtaattgaagtaatctccacttacttttttttttgcatgacaattaagtgaatttcaataacttcataaattataaccaggccacaagtggaaggttgaaggaggatgaagcacggaaatactttcagcaactgatcaacgccgtagattactgccacagtaggggtgtataccacagagacctgaaggtctagtgttaaccccattgctctggtttataagttataactatgatctggcataaacaattggaaattgacaaattgatgttttatgcatgacagttagagaatttgttgcttgatactgccgggaacatcaaagtctcggactttggcctaagtgctatatctgagcaagtgaaggtaatatcacacaactactcgaaagttaaaaaaaaaaggttcctgcacatctatattgtttctatgtcgattgattgccttttttactgtgtgtgtgtgtcaattaacttcaactctgtcaggctgatggattactacatactacatgtggaacacctaattatgttgctcctgaggtaacatttgcttgtacaacttctcttatttttctttatccagaaatgagtttctcctataataaatatctttctgttttgtaggttattgaagataagggctacgatggtgctcttgcagacctttggtcatgtggagtaattctttttgtgctgcttgcaggatatcttccttttgaggatgaaaatattgtctccctttataacaaggtaaatttagaaatttaaccaaatcttgaacaccaatataccaggttatgatacatttttttttgtcattctgatgacagatttctggagctcagtttacttgtccctcttggttttctgctgaagctaagaggctcattgctagaattctggatccaaatcctgctactgtaagttttttgacacttacaaaatgtggatagaagctcttacagaagtgacattttgaagtttgtttaaactttaaatcttttattttttatcactgattgtactgactagataaagttgcaatttggatcagtaatcagtgcccaaaattacttgtttcttcttacttggttttctttgttgccaaccagcggataactacttctcaagtgctacaagatcaatggttcaaaaaaggctatgagtcccctgttttcgatgacaaatattacccttatttccacgatgtttatgatgcttttggagactcagaagtgagttaattaatcaatagtattatatctacaagggtacttatccttttgtgcttcagatgttcataatcttaaatataccgtctaataaatttgccaggaaaaacatgtgaaagaggctatggaagagcagccaaccttgatgaatgcctttgagttgatttcactaaataagggtctgaatctagacaatttttttgagtctgataaggtaaggatcttttctgattgcagcagtatggttaatgagccagtgggcagtgggatcaaatatgcacgtatcataaacatttttcataaattacttcagaaactatgcaattattgcagtggactcacttttttatttaaacatgacagaagtacaagagagagacaagatttacatcgcagtgccctccgaaagaaatcatcaataggatcgaagaagctgctaacttactaggatttaatattcagaagagaaactacagggtatgctaagaatccttgcaagtaatgtttgtcttactagtaccactttcagctcatttgtacaaactatgaagaagttgaatatcacaatgtgagattacctttatcacccctgcgctgcgtcctgaaccatgacaagcatctcactcgtttttttctactgttctatttagatgagaatggagaatataaaggaaggaagaaaaggacatctaaacattgcaactgaggtatagaaaacacaaaattaaagaagatatctgtcacaagaaacatgaggattgatcaaaatattatcccgctgtataggttttccaagtggcaccatccttacatgtggttgagctcaaaaaggccaagggagataccctggagtttcaaaaggtatatgtctatcaatggggttactcttattatggtcaattgatcaccttcagttttgtttaaatgacaaagtaactgagcaaaattattactatgaacagttctaccaaacgct
